United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 19

SEQ ID NO: 71635 - DNA, 551 bp, Triticum aestivum
  Clone ID: PAT_TA_71635
gccaaaaatttctataaactgtatgcagggtcaaattgttacacaacaaatatatttacaagtgaccaaacttattgtttctgttgcccctccccctttctgaacacttcagtttcagtatattctctactcaagtaaagctcaagctcaagccggtgccaagagccatgtgcggttcaacacatgcaagcacaatactatgcagatggcagcgacaaccatggacctttcgctcatatacctcaagacacacaatccagccctcgctgtggcatcaccgccagcccttgcagcatcatgcagcctccacagcacaaactcaaggaaagaccgcactgcctcgaatgtcgccctgcccgtcagatccaaaacaagcttccgattgcttggaacagcaagcgcactcgagaccgtttttgtccatccttccccaacctcaccattgccactgtgagcatttccattgccattggagagtacgccgtgggaggtcttcaccaacgtctcgacggaagcactgcagagtgccaccaaaagcttttgcagcttgg

SEQ ID NO: 71636 - DNA, 641 bp, Triticum aestivum
  Clone ID: PAT_TA_71636
aggaagactgactggcatttaggcaacaaacatatgtcatacagcatcatagtactccaaacatgtcacacagcatcatactactccatagcatcacgagtaattacttaagattacataagtctttaagaaagcattcagcaaacataatagataacatctccggcaaacaagccattcacgaccacaagcaacaatcatagttttgatctggacgatgacaaaagtcataaagcatggagggtacttcgctggaaaggagcaaccactcatttgcatcaataaccttcaaccactataaataacagctgccgcaatcaccacatcacagctcactccttagaccattttgccaaatagcttctcccttaaacacttcaatgccaacacatgctcagatctcacatcttcaggcatcccggttgtgtcttgcatcaccaatgagcgatatgtttctagcatgaccgactctttgtgatcttttgccgcaaggtgagcaagcttccgtgcttcaagattctcagcagaaacacgcctttgggtctctaacatctctttgcggccttcatttgctgcattctgggcatctacaaacttttgaagcccatcttcaagatctattatacaaacttcatcctttc

SEQ ID NO: 71637 - DNA, 575 bp, Triticum aestivum
  Clone ID: PAT_TA_71637
gtttttttatactataatttactcaaatgggaagcagataacataccatgtcctgccagcaacatcacagattatcttacaatgccatcacaggtcatccagtaatactactactcaagttctagactgaaaggacataccatgtgtccatatctgccaaatcacagatatcttacaacgcaatcacggatgatccagcaatactactactcaagtcatactgtaggtggcagatcatagacatacataatatggtgctagaataaaactgatatcggtcttgcttctccatcaaacaagatacatttcgtcttcaatccagttgcttctacagtttccttttgattctgcgctgctccacttgcttagccacactatcaggcagccggccttgcttcagcagtcggacgcggacgcgggtgcgggaggttccgcccgcactggttgcacttcttgggaacacatatgccacacccgtgacaggcaggccaatcgtcctgcccatctgcagtaacaattgcacccacagcgaccgcaccaagagtgatcacagtccacttgatcacctttttggc

SEQ ID NO: 71638 - DNA, 326 bp, Triticum aestivum
  Clone ID: PAT_TA_71638
atgaggagggggtaaatttatttatacatagactcgttcaagcaaccactgagaagagatcacatcatctaggttataagttaagtttcttattgggttttgattatgcacgcattatttaagaaattagcaattcgcatgttatagtatcgcagtatgatcgatccatgcaaagattgtgaggaatgtgtaaattcatttatacatggactctttgaagcaaccaccatcgggaagagatcacatgatctgcacccatcgtacatgcatgccaataattaatctacttgaagaagtatgggaggtcgagcacgtagaggaggaag

SEQ ID NO: 71639 - DNA, 547 bp, Triticum aestivum
  Clone ID: PAT_TA_71639
gtctattcgacagctttcttcacagttactgctcccttacggacaccaacccttgtgtttgtgtcaacttaagcctttaatagcttgcactggtacgaaagaaactgccctcttctatttcttctagtgaaaggacagtatcaactaagttcagatggaaatttggagcatacaactacagttcacggcctcaccctgtaagcaggcagcccaagcctaaatgtgcacatgaaacagaggacagtaattatgttctagacaagaaaatcacaagagcagacaaggttttacagaagcaaatttaaatgttctactcaagcggcaccagcttatttcagatgcaacatagctaatctcagctaaaatccttcagccttctcttcagcacatccaaggacttcttccgagcactctgcaccacgttcctgcttgaaaggctcccaaacaagctgtcgggagcatcccggaacttgtcacagatgatggctaccttcttgtggtccaaggacgcataactcttctccctgatcacagcattcatgaagct

SEQ ID NO: 71640 - DNA, 403 bp, Triticum aestivum
  Clone ID: PAT_TA_71640
aactgaaaacaatgtacaaatgtggagacagaaatccaaggatgtccctcctatgggcatgtatgtcgacaagcgtatcaatcaacaaatttttaccccacaaaaaacctagcacatgctgcctaccctcatcaggtgaaaaaaaagaaacatttacaactccgggaccggcttgcgcgcttggttacaactctcctatcttttaagttgaatcactaagttaacatctccaactccatctcctaccctacaaatatcagtgagccctatgtattggatgtatagtaaatattaatatagctatttatatttacgcgagagccggaccatttctggagcaactctaccatccggatggcttgtgctgaaaccacactcacccgtccttgtactgaaaatcgac

SEQ ID NO: 71641 - DNA, 345 bp, Triticum aestivum
  Clone ID: PAT_TA_71641
ttatcatacatgctaccaatacagggacaacattccaaatgatgatgcacgacaagtccaatccttctcaaaagatactggaaattaaaaaaaacagcaattatgatagaaagtgtggcaacaaactacattcccatagatcgctatcctgtcttctccatgtacatgtagccaagtccatgacacctgaggggatactcaaaacaacaccccacgcctagcaggtacaacgtacttcacgcttccctggtgatcctctcgcttggccaaaccagcatcctctcctctcttggtcaaatcagcaccctttcctctcttggccaaaccagcactctctcgtccctt

SEQ ID NO: 71642 - DNA, 184 bp, Triticum aestivum
  Clone ID: PAT_TA_71642
atcaataatgggatcacattgttatcagaacaatggtgctgagcacttgactctcagcttcaagatgatctagtcgagcacattatacaagtcatattacaaagttcaaaagcggcgcaacactggcatgagtgcagaagatgagctccgtagacatgtcctctactgttgtgaaggtggggtt

SEQ ID NO: 71643 - DNA, 381 bp, Triticum aestivum
  Clone ID: PAT_TA_71643
agagaaaagactaagccgcgcccgaggaaggcccgaacctagtccgactttgaattaacaaagccatcaaccggccaggattacaagggcagtaccatacaacaggaaaaagaaaacggcgcaagatacaaggagctggagcagcttacaaccagacaaccaagcaagcaacacaagaaagttgaagaaggagtcgccaacatcggagggcagcctcaaatcccacttcacaggaccggaacacggtcgccctgccatccgtctgcctccgaagagggccactaccctctcgccctggctcgaagggcgccggaccgtcggaaggcaaagcgctcaccatgagctcggatgaacaacgacgacagggttggcacgggaagg

SEQ ID NO: 71644 - DNA, 484 bp, Triticum aestivum
  Clone ID: PAT_TA_71644
acccacttcgaattaatctttcaaattgattaggaagtaaaaatagtattttttcccgggatggacccggaggaaaaaaacccggaggaaaagggggggttggccatggaccaaaggaaaaaaacccggacccatggagggggatgagggggaaaataaaactaaaagacttgtccccaaaaatttcttaaagggtgatcattgcatcgggacaaaaacaaaccttgcctaaaccggcaagattcaaagcaacaagccataaatgtttggttcacccctgacacttcccctgtgggggccgccacctagcgtccagcttgctttcttcacctttactttggtcatgcccccccccaatccaatcaaaagatgagttgattgcccctcccttttttaaaaaaaagttgattgcccatccggccacttctttgtttcctcaaagctacccacacttttcccttttccatacacataattgaggaag

SEQ ID NO: 71645 - DNA, 628 bp, Triticum aestivum
  Clone ID: PAT_TA_71645
agtaagttagtaaattcttggtcactgatgaaagacttttcatagtttatactgttacataatatcatatgagttgtaatctaccagtgttactaaactgaattatgaacatattccactagacatcgtcctacaatctatcaaataaaatgactgagatcttccatatgattctatacattgctgaaagcctgaaatcgtggaaaggaaaccaataacgggcagaagatatgctggagtggaactgagacatgcaaatgcatatgcctcggcaatggaccatcaaaacacggcagtttattggtttgtctaataattttattgagcaacttcatgtgcatcatttgcaattgatactttacctgtaagcttggcatacaatgcatcaccagggcgataatcttgctcctccatcactgagagcagaatcaaacactcggcagcattgcccttccgcaatagaccatcaaccagaatcttccaaactatctcatcatagttgtattcctccaataacatgtcacccaaaacctttttagcagtcttaatacttccctcctcacaaagagaacaaataatatgcctatacgattctacacgtggtaaataaccacttttgatcattgaa

SEQ ID NO: 71646 - DNA, 402 bp, Triticum aestivum
  Clone ID: PAT_TA_71646
actaaaaaaagggggacccccttgattaaaccccaaaaaaagggaaacaaggcgggtcacaaagtaccccagtacgggccccagtcccaaaaaaaacccaaacaagttcctccttcaaagttcaaacttaaaaatcgggggccctttcctaactttttcaaacactttttttttcctcgaaaaaaccccggctaaatctttcattcacagggggacccacgaggggcccccacaaacccctttgccacacattgaacacggttttattgggacccagcaacttttttccctcccagggggagaggactactacaacaacaatgggcgggcggacaacaactcggggggggggggcttgcccccggactaatccaggggaatgggtcaagggcaatgcaaaag

SEQ ID NO: 71647 - DNA, 114 bp, Triticum aestivum
  Clone ID: PAT_TA_71647
gttcccttgaggctctgcagcataacataatgcatcccacaatacaattgctctactaaacatatcagtatctacaaaaattaccaccctataaatcaaccccctaactacaac

SEQ ID NO: 71648 - DNA, 257 bp, Triticum aestivum
  Clone ID: PAT_TA_71648
ggaaaattgccccccccccccttattaatcaaaaccatcaggccgaaacataaaagggattaaccaaaaccccaaacctaactcggccccccccccaaaaatccccacaaacaaacttatggccccgacgacaacccattggacatttaaaccccggatcaaccaacccgctagctacatcaaaatttcaaacccaaacctccattttgcccccaaagcttgaggaaaacaaactccccaatcggggggatcccccc

SEQ ID NO: 71649 - DNA, 407 bp, Triticum aestivum
  Clone ID: PAT_TA_71649
caaaaaaaaaccccccccctttcccacgggcctaaccaataattaattgggggggaacctcccttaaaaaatcccctttccccacaaacccggggtcccttttccccaaaaaaaaagagggccccctttttttcaaaaacaaaatggctggggaaaaaaaatttaaaaaaccccccccgtcccaactttgggtccgcaacattaccaccaaaattttatttccgggtttcaccccggaaccaaatacccccccccctttttggctaaaagaataccctccaacacaactggcgcccaaggggttaaaaccccgaacccgaacccgcccttggggttgggggcgggccccttctaaaatccctggatgccacccacaagggctttggagggaaaaaaatttttccccc

SEQ ID NO: 71650 - DNA, 180 bp, Triticum aestivum
  Clone ID: PAT_TA_71650
ggaaaaaaaagggcataaaccagcagttttaccacacaaaatgtgcacgtccacaactgctttttttacaacaaaaattgtcatatcaacaaaacaggctactgtttctaatctgagggttgccaacatcttttcttaatccttttccccccagtttttattattattattccaaaaaaa

SEQ ID NO: 71651 - DNA, 162 bp, Triticum aestivum
  Clone ID: PAT_TA_71651
acgggcaatgctagcaaacaataactttgttcgtctttaattcccaaccttgaactaacactgatccgggtcatacatcatggtgcacactaacttatttttcatccttgcaacgatgggggcatcatctaaacaccaataacccatttacctattagacat

SEQ ID NO: 71652 - DNA, 576 bp, Triticum aestivum
  Clone ID: PAT_TA_71652
gacaaaattcgtcaacgtgattggattagaacacttaacaaaagaacaaagctaaaagaatgctgactaaaaaatacaataatcgaataaccaagaagtaactgggatacaaaaagaagataaataacactctgaatctcttgctctaaacttatgtctgactgaatttaactaaattgaactgaactcatgcttctctctatacaccccacacatactatatccctgctgcacctacaatccactcactcacaaatcctcttctgtccctctcaaactcttattattcacaacccgatttgccttcaatctgtagcctattctccaatccctttcaacaccgcaacacaaatcgtctcgatgcgcaggcgacaaatcataatccagaaaattccgccccaccttacaactaactcttcacgccggtagccatcaatcaagaacactagcagctaagcatgacaatgaccacgtagatttggtgagcttgccatccatggacagaggtaaggagggagagcaaaaccatgtcttccttcagatgatttttttttggagaatctatgtgtatcactg

SEQ ID NO: 71653 - DNA, 428 bp, Triticum aestivum
  Clone ID: PAT_TA_71653
gcattttttattttttcacgaaaaactattccttgggttcaacccccaacccagcacccccccattgaaccataccccctaccccagggggggaacccccccagggggcaagctggcgaaagggaactttttgaaccccaccccccaaggctgacccccttttttttttacgggaacccacctttggccggcgtaatcaaacaacacaaaaacgcggcttgggccattgaaacccaatgtcaccttggacccggggccatgccttttaacccggaataggaaactttggtccatgcctgggcccgcccacggggggcatccgttcatccctttgaaacaactgggggacacatgcctttggttcgggttctctccatggacccccccccggaaatggggcttgccccaggggaccccccctttaaatt

SEQ ID NO: 71654 - DNA, 583 bp, Triticum aestivum
  Clone ID: PAT_TA_71654
agaataatctgcaatacatgctcatttactgacattcttaccaacaataaattgcttacaaatgtgatctaaacaaaattcagagataaaaatgctatgttcctgatggtagaaaatctgaaatgcatgctcttttcctgacattcttaacagtgacaaaaccacaatacatagcatgcttcctaggattcgaaacaacgataaaacagtaaaaaacaccactccgaggtttagacattaagaaattcagaatatttaaaacattacaaaatgaatggcttagcatgttctcgtcaagacatgcataacagtaatgattttagagcataacaaaatgaagggcttatcaagttcagacttggaactttgctaacatcctattaaacatgaccagttggcgcgttttgggttatatcgatctcttctgaagcattaaggccagggattgcttctgcatttagatctggaaaggatctatctctcatgcctccatcttctccaaacaaaaggtggggccagccccttccaccaaccgttccaccaccacttgctccacctcttgcaacattgcttctcactccac

SEQ ID NO: 71655 - DNA, 377 bp, Triticum aestivum
  Clone ID: PAT_TA_71655
ggcgcatcatctttcccaccaaccggatcatcaccatcatcaaaactgaaacaccatgtttgggtcgagggtcccaacaaaaggaattaccgccctcatcaatttatgcacccactctttgggtgtcgggccgacccgcgaccacaaggtgagggggcttcgggggggggggggggggcttttctttgacggggtcctcccggctttttttgccaacatgctcagggaaggctaaaaatttttttcaacttcatcacaagtttccaaccgtccatcgtaaagtcatccctggatttctcctaaaaaaggtcaagggatccccttgtgatgtggctgaccaactcgtcctccatttaaaagggcctgccaaaactttt

SEQ ID NO: 71656 - DNA, 569 bp, Triticum aestivum
  Clone ID: PAT_TA_71656
aacaataaaccaacttttatgaacaaaatcaagagtacagcttgaaccatgtgataaactaacaataaatcaagatcatctctcaatggcaatatgcatgtgttgtgaagatggaggcacatacatgtgtgatgcccaaacaaagagtttgatattgccgtcatgccacgatgaccaaacaaatgcagttcttctctggtgcaagcatgaccaaacaaatgcagcaacactcattcatttctctctttatatgaataaccgactcagcattctggcacagtggtattcagccagtaaaatcaggattatttgttctcctagttattctgttgtcaaataaatttcttctcatgatcggtgcacacaagaggccatagctctgggtacctgcaggctgcaccagttggagcatggaggcggctgtcggaatgcatgagttttcacaacatcagagcagggccgagaagatcctggctgaggcggaacgaacccaacggcggatgaaggatactgaaagtctacaaaacaattggccatacaaaggtggccacatgtagtccttcgagtct

SEQ ID NO: 71657 - DNA, 443 bp, Triticum aestivum
  Clone ID: PAT_TA_71657
gtagacaagaccggggtttgtcttttattcccaagtttgaactagtatagttcaggttcttacatgatagtgcatgtcactttattttttcaccgctacaacgaccaaaccatggactaaaaaaacggtgtatcatatatctactactagagttcttctcttctcagttagtaccgaagatgccaaatggagcaatggtgcaatatggagggatatacacattgcacattgcaggtagcgtctgtagcgctaggttccttattgcctcaaactggggcagttgttgaggctggaaagagccctgggcctgtgggttttgctgagatggttggaagaagccctggcctgatggatattgttgctgaggctgttggaaggagacttggctcaacggttgttgatgttgtagttgttgttgttgttggtggtggtggtgctgttga

SEQ ID NO: 71658 - DNA, 425 bp, Triticum aestivum
  Clone ID: PAT_TA_71658
atggggggtcaagaaaagccttggtaattctacacgaaattacaaaaagctctactgtattcgttacaacacctcccacctatctatcaacaactagctctttcaagctgaaatctaagggttctcggcgacgaacttgacacccttctctatgttgcccttgagctggccaacgcagacatcgacgagcttctgctcgtgctcggtgaccttgccaatctcgtggatcttctcgacaccgttggggccaagctcgacgttggtggcgaaaaaggtgacgccctggtccttgaacagaggaaactcgacgtaagagggctcgatgacgttcttctcgccgccggcagccttgaggagggactcggcgaagcgggcaccagccatggccatggagagggtggcaaagccagcaccgcccttggcct

SEQ ID NO: 71659 - DNA, 270 bp, Triticum aestivum
  Clone ID: PAT_TA_71659
ggaatctaaaaggaaaatgcttgtttggatcttttctatagtttccaaaaagacaaacagccccaggagcctttggagccacatgggacctaaacccctttgctaaaccccgggcccaacatgacaacaataagcgacatgataaaaatcaagtttataaccgccctttattaccaaattattttaaggtccacattgggagggctcaatcaaaccagcgccacagggaggagggcccaatgccctccgcctacctaggggttttaaact

SEQ ID NO: 71660 - DNA, 270 bp, Triticum aestivum
  Clone ID: PAT_TA_71660
acttggttgatcaagatataatgatcgagtaacttttcattaccaaaattcacaccggtattacaaaccttgggaaaaaatggcccatgacccatacatttgcctgacacccgtacttatccctcaaaactgttattctgaatgatagaagaccaagctaacccgtgcacatataaatagcaacctcattcactcactgacagcaacaagccatctcaatgctgggcgggagggtggcaaatcggagtcagtggtgtccgtggtatccac

SEQ ID NO: 71661 - DNA, 337 bp, Triticum aestivum
  Clone ID: PAT_TA_71661
aatgggcaaacacatactcgaaggcccaaaatccccaaagttcttacttttaaattttaaaggtttctgaccataagtacttttaaggctcggggatttgatctcatttacagttacataaattcaaaaatatttaaattaattttccaaatgaacatggatgggcaactaaacaaggactttgtttccacagggggggatataattactaccatgccaaaaactttcgagggggtttttgggtacattattattcaacggcccactataggatcatgggatacttatcaggctctaaaaaaaacgggcgaaataaaactccttgggatgttaatta

SEQ ID NO: 71662 - DNA, 106 bp, Triticum aestivum
  Clone ID: PAT_TA_71662
catatggggctttaacttgattcccaaatttattaaccgatattggggctatgatagagtatcaggtcgagagacgatagatgaattaactggggctgggtcccgc

SEQ ID NO: 71663 - DNA, 101 bp, Triticum aestivum
  Clone ID: PAT_TA_71663
gtagagaataagacttcgggctcccagagatacggtacgaatcatataataaagaatacaatcttaacaaatcctagcctaccataatctatactagtatt

SEQ ID NO: 71664 - DNA, 613 bp, Triticum aestivum
  Clone ID: PAT_TA_71664
gaatgtaattcatgtatgtttgttctatatcgcagacccacaagcgaagatcacaatacatacatcgcctacctcgcccccaaagcctccctcctcgactggccccccagattcaaatatggcgcctcacccaaactcgccacccgatcccccgccctcgcctcctcgtaatcgtacgtcgcacaatgccacgtactccggttatcccagatagccagatcattcttctgccacttgaaccgcacctgcgcgtcatggttctgcgtcacaagattgaacagatacggcaagaggaggtcagactcgtcttttgtaacgccgttgattcgttttgtgaaacctttgtttacgtatactgagttccagcccgttaccggatttgtgcgtatgactgggtgtgtagctgtcagtgcatcgccgtggttcaacggactaccacggaaattcttgcgaagcgggttacccaggcgttcagcttcttcaaggaaaaactttgcgtcgtgcgttgcagttagaccttgtagcattgtccgcatggctggagataggcggtcgtagatttcgtagccggatgcccatagtgtgtcgccgcctgttgcgggtagggtatgga

SEQ ID NO: 71665 - DNA, 184 bp, Triticum aestivum
  Clone ID: PAT_TA_71665
tcccgccccgcgcgcggatcatcctacggtgctgaggcgctgcgccccataccgaccccgcatggccgccgccgcctcaccgagcctcccgatccccggcggccacccctacctcgccgtcttctccttcctcttcatcccgacctacgctacacgcgttccgacaggccggccctcgcctggc

SEQ ID NO: 71666 - DNA, 601 bp, Triticum aestivum
  Clone ID: PAT_TA_71666
agggcatcgactgcatgtaaaaagccaaaagtgcacaaatgatacccttacaagtacatcacatgtgcctgctgtttcttgcaacaacgatatcattttaccattcagaagcattacaacgaaatcatagctcacggcaacaggataaagttgtgagaaggcttacaaatattctgtaactatacatgcaaaacacggtcacatacttgggttctagtcaagaaactcaggctgagaaatctgagaaaccttcttcgcattgctctgcgtcggaatcctcatctgaaaccttttcggttatttcagtatcagcacccttgtcgtcagcttcgtcgccgtcctcactttcatcctcctcatcgctggagctcgattccggctgatcaccgttttccttcaaaccgaggctgcagtccttggccgtctcggcatccggcaagtcatcatctgagtcttcctcgtcaatatcacttccaagctctatctggtccaccttgacaatagggaactccagcggcttagcaggccagtccttgaagaaattgttcaaggccatgaatttgaacgtgtgcagaaccctgtgcctgtccctcttgatatc

SEQ ID NO: 71667 - DNA, 511 bp, Triticum aestivum
  Clone ID: PAT_TA_71667
gggctaaaatttaattggatcataaaattcttgaattcaccaacaatagtgccgcaatcactttcaacaggcattgcaacttcacaaacagaccaaataaggaaatgcccccccggccactttttttagggtagtaccgactccaacaaactgcaacaggcattgcaacttcacaaactgcctttagtatcctgtagctatccttgcaaaaatatcaccccttattgcaccagtccccaaaaagtggattggggcaagtgactcgatgccccccttcctgatttgcttttccacccaacgcctgtgcctactttcctccgggaaccttatcggctttaaaggcgtcaccccttggcatccgtcacatgtcagtctatcaaacaagtaaacatcctctaaattcaccgctgcttccatgacacccctgacatgactcatcatgtagtcttcaaactgaaagcaaaaaatggtgagcttggccaaacgggggtgcttgaaatttgatgtaggg

SEQ ID NO: 71668 - DNA, 343 bp, Triticum aestivum
  Clone ID: PAT_TA_71668
gcttgcatgaacaaataaacaaatttatttatttttcaaacaaaaataaacaaattcatgcaaagctccaacttcatcgacacccatttcatcaccatgtcccaacatgcattcacccctcgtttttgctctttgcttttttgaggctcgccagctaaaacctcacgtcggggagcccgttttgtttcccggacaaacggaacaactcctcccccgtgacggtcctgtagcgcggggggccacccccgtccgccaccaccggggcgcacacgggcgctcccttggccctgaaaaaacaccccaccgacatccggggccccaccctgttggccaccacgcgggg

SEQ ID NO: 71669 - DNA, 658 bp, Triticum aestivum
  Clone ID: PAT_TA_71669
gtaaatgtccatggaaacttggacataatattattacactacaaagatccatacaaaaattgccacgcgaacattgcaggcagatatgtatgtgctcaaaatcacttccgtaataaaaaagggtccatgacatttgcttaacagcttaagtaatacaaataacaccaaacggtcatatagtgcttccacagcgaagacggggaatcttggggcatacttatgacggtttcgaagcggctatagagaatagaaactaagcaaccagaattacggttgatagtaatacacaagtggtgcctactattaaagtttcaataatcagttaccatccagaattcatcattcataaattgcagtaaaggtaataaggcaacaaaaagttcagaacagtaaatctggtcggatgatgcccagccttgtccaatggtgcacaatcgaaaacttaataatgacttcagcagcaaattcatactgaaaaaccaagtttcttcttcagggcatctgaacatttgctggagtagtgaactgactaggcaacaccctgtgcagcttgcaaagagaccctaccacaatgctcaatgaccaaagactctaacttatgtgcacgtcccagttcagccactcctacatcagtcaccttatgacacgcccgaagtgt

SEQ ID NO: 71670 - DNA, 557 bp, Triticum aestivum
  Clone ID: PAT_TA_71670
cgcataaaaacaccttattaatattgtttcaaatgttgttgttacattcaaagggtgcaatccccggaaccaccccaatttgcatgtactccaccgtcttggtctgatttgtgagcaaccgagtagcacttcggattttctacggccacgtcaaactcgcgagacattggagtcacgagctggtgatctcttgtcacaattttgatgttcttcacataggctgctgtaccatctccctctgaagcagggtgtccgctacccatgggtggtggcttatatttaattgtaggaccttcaaccaaaccaccccagtagccaacagtacccttcgatttcaggtaaccgaagagttcacctggccaatatccgactacagtgccctccttgccgaattttacccaccagtttgaatttgtatcctgataaacaaacgtgttcatatgagcttgtggcccatcgtacttcaagattggcgataatttcccccctaaaggtatatttggactcgtatgtataaatccagggcattttagatcaaagcattgtttttgtccatt

SEQ ID NO: 71671 - DNA, 559 bp, Triticum aestivum
  Clone ID: PAT_TA_71671
atgttgacacaggggataacctttttagcaaatccgaattattagcagctacaatttggtcaagcatgatttgtttagttttgggcagctacactactgttttaggggaagtggtggcatgctctgctcgctctggaagtagtcgccagcgtccaccttgcgcttgatctcggcgagtctcctaaagttttccgggccgaaataactctcgccccacgccttggcactttcatagctcgtcacgccatcgaccaccttgttcgtgccaaggtcaaggtcccggtagttcacatacgcgcccctcgggttcttgctcacgaacggtgccatgaagtcgtacaggctccccacccatttcggggtaacgtcgcctccgggcgctgtgccattccagaactccacgtactggatgttgtagagcacgctgctccggtgcgggaacgggatgtcgtcggcggtaatgcggcccattattccgccgtgcggctccaggacgagctgccccgtggcggtaccattgggccagaggaagatcttctcccatgtctccttggtgagt

SEQ ID NO: 71672 - DNA, 494 bp, Triticum aestivum
  Clone ID: PAT_TA_71672
gaaaaggcaaacccaaaacataaaccatttaataccaacccaaccgcaggctattcatcaaatcagtaaataaaaccaaccttaatacctgttcccacatgctggggaggcccacaaaaaaaaaccaaaaggggttttaacctttttttccctcctagccaaacaaaaacttttccagcatgccacaccccaggaccccccttttaaactttctccttacataacattacataacccggacattgacttggcaagctaaaccctaaccagcaaaccctgatttcccccgctgctgtcccctaatctactatttactcctcgccctcctgggcatcatcctaaacgtaaaaacctttttcgcaaacgtaaatcttggcctttttggaactggggctctcctttttgttcaccaccttgtttggtggggcatttgcctttttgccgccatactttgccttttcctaatccaaaatgctgccccatttttccccggc

SEQ ID NO: 71673 - DNA, 161 bp, Triticum aestivum
  Clone ID: PAT_TA_71673
gtttaacaaaacaggaatgcaattaagggcttgtccgaaacaacaatacatgggttggacaaccaacaaacatttcttttctccaggtcaacatgtttttaccaacatccttagggacccaaaaacaatgcagtccagttcacctcccttcagggttaacc

SEQ ID NO: 71674 - DNA, 224 bp, Triticum aestivum
  Clone ID: PAT_TA_71674
cttgttttaccaaacaaaataatcttttttagggggacggaaaaacccaaaccccgaccggaaaactgggtaaaaatgttaaccggcccaccaaatatctaatgaaaaacaaggcccttacggaaacccatgtcaatgagggaaagtcaagaccttacaaacttataaaaccacaggtgataaccctaaggggcctggccagcctgggcagcaaaggcggcacc

SEQ ID NO: 71675 - DNA, 314 bp, Triticum aestivum
  Clone ID: PAT_TA_71675
acgtctaaaggtaccaaagcagccacttgacaaccccctccttattgtttgggttctaacttaaaaatccaatggcctaattactgggggcagaaagaagctggatactacatagttgagctactttggcccagccattgaagtaatagcaggggcaactgactctgagcactggtgcccggggatctggtcaacggcgagcgtgtcggtggggaacgggcaagaaccggcgggggtgccctgcaccggggcgcatggggctggggggaccccggctgaaaccccctcgacgtgggggcagttccacaacacct

SEQ ID NO: 71676 - DNA, 513 bp, Triticum aestivum
  Clone ID: PAT_TA_71676
aacgacactatctctcgcacatactttgagagcgacactttattgtcctagacccatctgaatctcacgacactttgacgactggctgactcatggctgcagcataagctccgactaactgacaaactaaactcgatcgacgatctgcctcccttaaccattatccaaaccaccatgcatgcatgctgcgctccttcactgcgccccggcgtccggcaggtggccgctgctactctcgccgatgctcatcttcagcttgtgcttgtcggcgcgctcctcggcggcgccatctgcgggcattgcgctccaaacggacgccgtgaacaggggccgctcgtgccacatgagcgagaggcagccgccgatctcctggacgcggaacccggcggtggagtacatgcggacaagcttggccgcctgataggctgcgctcggacccagcggcacgtgggtgagacccatccgccagaggcgagcgcaccagcatgcgagcggctcgtggcgctcggtgcg

SEQ ID NO: 71677 - DNA, 287 bp, Triticum aestivum
  Clone ID: PAT_TA_71677
aagaaaggaaggaagagatctttgttttcattgttcccgatggatcctttttgtttgggactgtctatttgacatttgactgttttccaattcagcaacattcaaatttcccaaccaatgaacagatgacacttgtttgtcccaaaaaccccactggccaccgtatattttcttatttcggaaaaacgggtcgggcaaaaccctgacccgttttcaactaaactgtcaccaccacaaaacctcgctggaccaccactaacaactggccacacacctccttggatcca

SEQ ID NO: 71678 - DNA, 180 bp, Triticum aestivum
  Clone ID: PAT_TA_71678
gggcatccaccatgagggcttttatttcaaacaaggaagggacatacccccacataaaacagggggacacactggttgggatactcccgaagggatccaattttattgaacccaaaggggaaaccccacccggccccgggaaatcccaaaccagggacacccatcagaccccatcaaggg

SEQ ID NO: 71679 - DNA, 300 bp, Triticum aestivum
  Clone ID: PAT_TA_71679
ccaggcataaaactggccaacggctttgaaaagcaaaccaaaccaaaacataccaccggaggcctaccagtggagggacctgcggcccattactaataccaaacaaagccaagagttgcataaaagcaccaccttccttagcgaccgaaaacatcacaaaagggctaaaccaaaacttccacatgcaaaaatcttaaaactttaaccccctaaaacacccagcccagaaaagtagggccccgcccacataaaaaggggggccctccccccctcgaagggggccctgaccttgcggggggg

SEQ ID NO: 71680 - DNA, 173 bp, Triticum aestivum
  Clone ID: PAT_TA_71680
aaccagaagttccagcagtgaccatagaagctaactcagcaccagggatctcggttgcagcagcaaaggagttacaagcaggaacagtaatttgttgcccattcttcttcataaggatttgcttgtcgtcattatcaaaggccacagggctactttgccagaccaatgaccat

SEQ ID NO: 71681 - DNA, 236 bp, Triticum aestivum
  Clone ID: PAT_TA_71681
ggcataataattagcattaacataattaacattgaggatctactaaggatgattacaggtcccatcaccactcaattcaggacggcaggtcggagcagacagcattcttctttctttgtacaaaatgaaagctcctacctcccatagtcctggcacagaaagtgaaggaaaacacacacacacactcacacacacggagcaaaacgggaatttggttcggatcggttacctatact

SEQ ID NO: 71682 - DNA, 133 bp, Triticum aestivum
  Clone ID: PAT_TA_71682
aatcacacaacattggataacttcaaaccaaatcatacttgttgtaccaaatatacaaatatactcaggacaaccttccgggagcgttagggcatttaataaaacattgatgtaaagggggacatccccaatc

SEQ ID NO: 71683 - DNA, 228 bp, Triticum aestivum
  Clone ID: PAT_TA_71683
caggaactacaaactgcatataaggaacgaaatacacaaaggtttcacaaaaagacccgaacgtaacgttcaaaagtacccctagttaaaaatctggatgccaattatatttgaaatcaccaacgttgatttgttttggaactaggatcattactcctttaatataaaaaagtcgatggaacggccccttctaaaagctccttactggaggtttgttgaggttaacaa

SEQ ID NO: 71684 - DNA, 407 bp, Triticum aestivum
  Clone ID: PAT_TA_71684
atgttacccacaacaaccttttttacttttaaagttaccaacacgctccttattgttacagttctcacttaaagatccaatagcctcatcacttggggcaacaagcagctggatactactggatacgggatgggtgagctaccctgtcccagccactgaaaaagcagcaggggaagcgatggagtatgaacactgctgcacggggatcttgtcgacggcgagcgtgtcagtggggaacgggcaggaaccggcgtgggtgccctgcagcggcgcgcaaggcgccggggtgacccccgcggaaaccccctcgacgtcgacgcagttccatgacaccttccttttcttgggcatttaaacggggacgttggccatacaaatgcccttgaagggcgccccttggatgccct

SEQ ID NO: 71685 - DNA, 370 bp, Triticum aestivum
  Clone ID: PAT_TA_71685
ggggatgaatcaaaaaagctcccaacacttgcaaaaatcaaataagcatgtgtccacatttgcaccctggctaaaatggcttttgcaacagcgcggtgaggtaaacaagctcgtccttggcgccaatgccggtcttgtcggcgacggcccacttgatggtcttgtaccccagcctccgcagcatggcggcgtacaccccgtcaaggtcccccttccggcaccaaaggtggtccacccaaagcatcccgcccggccgcagcacccggtccgcgtcgtaccacaggaactccagcgccggctccgggatccaccggttcaccgcgtggcccgcccgcaccaggtccattgtcccgtcccccacggggaaccg

SEQ ID NO: 71686 - DNA, 369 bp, Triticum aestivum
  Clone ID: PAT_TA_71686
gttttttgaacaaaaacctcataatttttttccaaacaatcaaatccttgtaatttacattatggtagtacaattcaaaccgaccaacggattacttaaccgtaagcgtgtgcacacacacatacacaccttacttgccgggaacaaatttggtggcgaatgcccatgccttgttgttgacggggtcggaaaggtggtcatcaaggttctctagtggacccttgccggtgacaatggcttgcacaaaaaaaccgaacttggaaaacattacggggcgaccgttcttgatctccttaaccttgaactcggggaatgcctcagggtcttcggcaaggccaaacggatcaaaactgccgcccgggtaaagcg

SEQ ID NO: 71687 - DNA, 481 bp, Triticum aestivum
  Clone ID: PAT_TA_71687
gggtttaaaagatccaccaaattgctggcttcaattaaatttagcaaaaagcagcggaaaaacaacatgagaggatccgaagatcaaaaaaaaaggaaaaccgcaaccctattggttgcaagacaacaccacactcacacgacggatcgccttccagccacaacaggacgacgcagctccgactccggcaaaaaaacaatggataattaggcaagactggcgtcagaggagatcgccgaacagaccacatgtcgcccgtcatcgtacgccaacagggcccagaccacagcttcaacttcacagcaacaagtacccgaggtaatcttgtaaacaccccgaaaaagagccgactaccacaaccaatgccacacctccgacaatgctcaccgccgtcattgttgccacagaagcctaactgacggacacgaccaagtagcacgaacggcaccccccacctatcattggtccctctggcaggcaa

SEQ ID NO: 71688 - DNA, 292 bp, Triticum aestivum
  Clone ID: PAT_TA_71688
cgccgtcgacacgcgcgacgtcgacgacgacgacgacgccatcgccgggaacctggtgctctggttcctgctctgatgtgcgtaggcagtaggcagtagactaagaattagtagtggttggtgggatcgagcgagaggagggaggaagattcgtccggctgctgctgctggcagttgctctgtttcgcttggcctctgcttcgctcggccgcctatttgatttgctctacaaaatatatcggtgggctggaccacggctatggagggctattggagggaggggggggggggg

SEQ ID NO: 71689 - DNA, 418 bp, Triticum aestivum
  Clone ID: PAT_TA_71689
gggttttttaaaaacacagatgaccacaaaaaccattcaagccgggtactgaacattacacgaaaagatttttcataaacgatcagagcatgcttccaaaacctggcaagtcatgataagctgtcagcacattattcccttggtccagcccctaatacgatagacagactcgaagtcctgaacgacgaacagtcacaaataacaacacggcaagtcgagctacagcgacagacatggagtaattctagggattacaacgataaggccaccaaatggtagcttcttcacagcatactgtccgtcctcgctggcagccgcctgaaaaagttcactggcgtcaaaggaagcctgtgtcggaaccttgggtgcctcatggcataaaaccctcccaatgctgcaagaacctggagcggtgtga

SEQ ID NO: 71690 - DNA, 461 bp, Triticum aestivum
  Clone ID: PAT_TA_71690
gaggggtattttctgtctttatacacattaataattgaatgaacttggatttagccagagccacagtacagctgctcggctgaacaaaattgtggccttgttcaatccaatcaggagggctaaaagatacaataaaacaaaatcctctatcctatgtatggcttttcaagaaagaaaaccaactatttatacagatatatgtacacagacactactacagaggatgcatgtctgtctatgcaagcttttgctggtatctcctctctacgcgctgctgccttcttcgcgcgcgcaaattccagggaatgccagcgaaacaaactaacttaactctgctgctggtgcctccgccgccaagtcgccgctattttatttactttgcaatgcaatcctgctgatgtacggcggcaaacagcagcttattgcgttttcatcaacgaatcttcctgctcgagaaaaaa

SEQ ID NO: 71691 - DNA, 383 bp, Triticum aestivum
  Clone ID: PAT_TA_71691
gacctgctttttaataaaacctttttccttcagttaaaacaacaacaaaaaaaacaattttaaaaaaaccaaaccaccattggggggaaaggggggggaacaatttcaaaaaaaccagtttttgacaattttgcataaaactgctaaaaaaaaggttttttatgcccctccagttttcccccggggggggataacctattacacacaagctttactcccatcagccaaccgttccaaatttttactccacaaattgccaaaccccctgaagggatggaaggggggcataatcctcctaatcgacaatccggttttcgcagttatgccttttgccacccaatcgttttttccgcgcgccgagcttccgacaaaattaccagtta

SEQ ID NO: 71692 - DNA, 585 bp, Triticum aestivum
  Clone ID: PAT_TA_71692
ggtttttaacaaaattcagccgtccgattttgttttgaggtaaaaaaaaaacagggaatacaggtatctcttattgttcctgtgagtaatgaactgttcaggtctgcaagccaagcaaacctaacctgaagggtttattctatacacagagattacaagcgagctggacaattggtccagcaacacatttatgctacgttttctagtcaaaacgctgcatttctaacctaatgtctgcagggcaaaaagttgagcttactccaaatgccctgatttgccgtcacaagtcttggtaaaatcacccaggatcaccgagggccttttgaacccaagggccgcgccggagggaccctgggtatcccctcccgcggctgggactacattgccagagctgcattgccagatgttgttggcacaagggctagtatctggctcttgacaacagcgatgtacctctctatctcgctgtaaatcgcgaggttctctggacagcttgggcgcagcatcaaaaaagcacgctccagcacacctgctatcttggcaggcgggtgccgatgctcgctcaggtccttgattgcaataact

SEQ ID NO: 71693 - DNA, 224 bp, Triticum aestivum
  Clone ID: PAT_TA_71693
aacccgtcctaacccccggaaaaaaagtccggccctgcccacaacgggcaaccaaccaactggcttccaccaatttttttatattggcggggcaaacccccacacccataattcaaaacctttttcccctcctggggaacccaaaaaacctaacccaaataaatgggcctgggggccaatttgggcgacggcataagaaaaaaaaaccccggccagaaaccccg

SEQ ID NO: 71694 - DNA, 346 bp, Triticum aestivum
  Clone ID: PAT_TA_71694
aacccggacaaactaacttttttattccggaaacaaaaacaactcactttacccaacagcagctcacaagttaaaacagccagtcgcacacatacattacagcccatgaatgcccatccatcaaaaaccaacttttgtgccaggccccaaccggcccggcccattttacttaacttaggggcaagggggcaaggaccctaagaggactgccggacctaagggcccacaaaatcggcatcggccgccaccaaaatgtcgacggggggcctaaactcggcgcacaccttgatggccccgtggacggggcccaacataaaatcgctgataaggtcctggtagaggggct

SEQ ID NO: 71695 - DNA, 544 bp, Triticum aestivum
  Clone ID: PAT_TA_71695
attctgaacccagaaagcgcccacacaaccattgtttattttgatcttttgttgccaattcacgcgttttattactcaagaccccccaaaaaatcatcaaaaatgattacatcgaggcatgattacaacatgaacaccacacaggctacaactacaaccctaatgtcctatgtgctggcaacaatcaggaacattagctatacctacagctaaccctaaacaatttgctacaaagggatcaccacatttcccccgaaaataagcatacacatatcccgttgcaatcattaccgaagggacgttctttacatcgatactttacacgactgtttgcccatcctttttaaatacgaaaacatgtttaatgattcctttccattaggcctcggtagtggactgggctgcgggtacccgattgaaaaatgcatgccgttcggtgtattatgagctgaaaaaccaaaactagacttataactcgtcgggggaggggacaagctatgggtatccaaggaggttggagccatcaaacgatgacccaatgacc

SEQ ID NO: 71696 - DNA, 324 bp, Triticum aestivum
  Clone ID: PAT_TA_71696
gggaccccttaaaaaagattttttttagtttatttccaaaaggaagtaaaatttttgatgaaaaaacccatggccaaaaaaacagtcaaaattttgagcgacccaaatggggaaacaaacgtcaaatagctagtaacaatcaattggggaggacaactttggatgcatttccttacaaaggaacagccaccctttgtaaatgctcaaaaaaaacctggaagctgactttttgggggaaaatgatgtcaaaacctgggggaacatcatgggctgaattatatggggccgagggattcatttttgttaacaaaaaccttgcctggg

SEQ ID NO: 71697 - DNA, 355 bp, Triticum aestivum
  Clone ID: PAT_TA_71697
ggggaaaagacggttttttttaacttcttgctggaaagttcagtcccaatctactaacatgattttacagtttgctgccccgggttacaatttttatcaaacctctttgtttttaaaaagcttccataacctgctcctttgattagcctcttaaaatctacatccccctattcaaaattgcttgactggaaaatgcagcttacatttttcttctgggcaaaggctatataaaccgaaatcattcgttctgccggaagggacccaaacactggtgtctggtttgggttttcatcgcactgcttgacccggatccccccgaggtcaaaatgagtttaaagcgtctagttgccgttgg

SEQ ID NO: 71698 - DNA, 538 bp, Triticum aestivum
  unsure (1)..(538): unsure at all n locations
  Clone ID: PAT_TA_71698
cgtcggtgatcacggcctgcggaccccacatcataggcaactggtgtcgtggcaacatgaactggagcaaagacgcttctttcaatcaccacattccaaagaaaaataaacgagagcacatccagaaaccacgcatttttcagtcacggcatcccaaggcaaaagagaaggaaagtagtaccaggcaggcagttgcagttgcagttcaacattcaacattcattagcaagggccacataaaagttcaacatgacataatagatgcggattagcaaattacgcagttaaattcctacaagtccaccgcacagttctccgttgtggtaatacgaagagggagcacaccacaggaacaccccaacaagccatttctgcacctcattctcagccacacgaaactgaagaacctacgcccaacccaagcccatctntggacctcttgataatattcagttaatacatcacaatagcatatccatctgatgaatcatcttatgtattatgtaaaagttcagctccatcatgtccaccaccaata

SEQ ID NO: 71699 - DNA, 650 bp, Triticum aestivum
  Clone ID: PAT_TA_71699
ccctgataggggcatactatcatttccatccacaccgtacccccatgtctctttgcagcgtttccagccaccaacacaacatcactgctgtcccaacaccacgggcgtaattccttaaggaactggtgatgccccggcagctcaggcgatgctcctccatagcgtcagcggtgcttcggcaatgcttcgatgacctggcaatgctccagcgcagcacggatgatgctccggcaatgctccgtccgtcggctgacaagctccactagagcaccgatgatgtttcggcggcctagcgatactccgacgaccagagaagctccagtgcggcaccgatgatgtttcgtcggcctgacgatgctccgtcgcagcaccggcgatgctctggcaatgctccaatggcccgcgaagctccactggagcaccgattatgtttcggggcctggcgttgctccgatgacccaagaagctccactgcagcaccgatgatgtttcgacggcctgacgatgctccgtcgcaacaccggcgatgctccggcgacccgataagctccaccgcagcacttatgatgtttcagcagctcgacgatgctccgtcgcagcaccggcaatgctctgacaacccgataagctccaccgcagcaccgatgatg

SEQ ID NO: 71700 - DNA, 505 bp, Triticum aestivum
  Clone ID: PAT_TA_71700
atcaggtacactattatacaagcaggacctagcatcatcttgaccaaattttgccaaaacatgggctgcctcattattacaccgattgacatgctggatgctctaatattaatatctcgagtttacgaatgaatgtctgttcactccattttttatgccttgcctatcatgaattcattgaaccgaaaaaatggactacgacaaaaatagacaagaaaagttttttgtttaggcatttccgcaaaataacagacgcataatcatcatgaacaccatgagaaccacttggtcttcgacttcttgagatgcagcaggactgtgcaactcaactttggcatgggcgaaaggagcatctgccgctgaaggcgcattactcgccggcgagaaagctcatgcataacctggacttgaagatgctctcaggtcccatagccttcccgagctccccctcgccgactaggtccaggttgttcaccttcttcgtaacagcctgctcatgtctttt

SEQ ID NO: 71701 - DNA, 541 bp, Triticum aestivum
  Clone ID: PAT_TA_71701
gggatcaatgcttaatgcttactggagcatagcacaacgcatgacagactcaaatgcaccactctcaagtctgaagcattcaaacgacgagcattcatatccgttccaggaacaagcaaacttgtactagaggctagacctactactagttgaacttctcagctcatcccactggcaacaacattccagcgattcaataatcaccaacgtcatccatgttaccaaaaaagaggaaattaagaaacccagcgcagctttgagagcacgatcagttgctcatgaggatgttggatgttacaccccccagaactccttcgtctgcttctggctgcggagataagcactctcgctgtggtggacataaattttctcgactggcataccatttgccataaacaaatttgccagcttatggactctcccatcattctttgagcatgtgatcttcaccattcgaagatctttgcaagtaaatgatcttctttgtagtttgagacctgtttctgatgcctttctggcattgaagttaattttaagttgg

SEQ ID NO: 71702 - DNA, 218 bp, Triticum aestivum
  Clone ID: PAT_TA_71702
ggggctggccgacgacgacgtgggcggggacccggacgccgacaggaagaggaaggggtcctcgagcctcagggacctcgcgaggggcggcggcaaggacaagcatgagaagaagaggaggaaggaggacgtgggcatggtgagggagaagaggggctcgtcttcgggcggcaagggctccggcggcggacgcgggggtggggataggggtgaggatc

SEQ ID NO: 71703 - DNA, 576 bp, Triticum aestivum
  Clone ID: PAT_TA_71703
gaagagaatcggccaaactttattgggacaaatcctgaagagaatcaataaccattgccctgcaccgcctcgctctccatgaaaactgtcggtttgcagaattggagtgcggtgacgacctactatggtacatcttcagctccacccccactcatgatcagcctgctgccatctatggagttgtacactatctcttgaaacatggtgtgaataaatcagaaggcgaaaacaattagcttagattcaaaatgctaatacaatcctgtatatagtatagcccaatggctaactattctatgtagcatactgcagtacgaggagacacgatataacgatcccatagtcacacatcgatttacacaatgagaggttcaagcccgagcccaaagtacaaagacatgtagttatgcatctccaaccactacgcaggtctccaaaaatcattccctgatgttgtgcaagcaccaattggccatagtcaggtggatcctgttggatacactcttccacaaccaagcataatagcttcctccgttccttcatcagctggcatgctgtgattctttctcaaaaaca

SEQ ID NO: 71704 - DNA, 149 bp, Triticum aestivum
  Clone ID: PAT_TA_71704
atgcagagtcgaatcacattcatccggtttcaacacctaaatctcaattccagtcgatcatccaacaatacatgagtcgatggaccatactatctagctgctactactaacaaaacttgggcaggggaagtatccaagtatcacatgtt

SEQ ID NO: 71705 - DNA, 586 bp, Triticum aestivum
  Clone ID: PAT_TA_71705
gcacgcgccacggctgccgcgccgcggggtgctggccacgcgggcgtatggtgcgttcttgcgcgatcaactccccgtcgagctgtccagcccggcgcctagggtgctctactcctacgcgcacgccgccacgggcttcgcggcgcagctcacgggccgccaggccgcgcagctcgcctcctcgggctccgtgctcgccgtcgtgcccgacgtgatgcagcagctgcacaccaccctcacgccatccttcctcggcctctcgccgtcctacgggctgctcaaggtgtccaacggcgccacagacgtcatcatcggggtgatcgacaccggcgtctacccggaaggccgcaaatccttcgccgccgacccctcgctgccgccgccgcccagcaagttccgcggtgcgtgcgtctcgggtccgtcgttcaacgcctccgcgctctgcaacaacaaactcgtcggcgccaagttcttccacaaggggctggaggccgcacgcggtcgtgccctcggcgaggactcgttgtcgccgctcgacaccaacggccatggcacccacacctcctccaccgccggcggctcacct

SEQ ID NO: 71706 - DNA, 391 bp, Triticum aestivum
  Clone ID: PAT_TA_71706
ggggaaaacccccagggggaaaaaacggccaaaacttttttaacacagttttttaaaaaaaaaaaaggaccaaacggggcttggaaaatttaaactcaaaaccaaaaaaaaaaggggaacaaaactttgaactttttgttggaccctgtttccaaaaaaaacccaaatgggaattttaaagggggtttttaaaaaaaaaattttaaaccggaaaacccttgaagttttggcctaaaaaaaaacccccctaaaccccagggggctggggaaactgggcaaccaaaaaaataccggggaaagtttaaaaaaggatttttgaccccggctgggatccccaaaaaaccccccccccccggggaaaaattccccttgatttttgaccccggcttta

SEQ ID NO: 71707 - DNA, 366 bp, Triticum aestivum
  Clone ID: PAT_TA_71707
ggggccttacaacatgaaaatttttaccggcttttgaatctgaagttcaaaaacaacatgattcaaaaagggggggcaaaggccgaaacaacaagccccccccttttttatgcaaaacccaattcatccattttgttacaaacaaacaaatcccaccccagaggggaacaacaccaccaacgggggggcagcctttcctacaaaaaaaacccggccctggaaaaaaagatccccccggggtcggggtaaaaccaccccccgtcccaaaacctggggcccccaaaggggaccgggacctgcttttcccccatcccctttttggtggccttcatggggggcaaagcaagggcccccccccccatttcc

SEQ ID NO: 71708 - DNA, 601 bp, Triticum aestivum
  Clone ID: PAT_TA_71708
aggacacaagcgccagtaaattgaataattcagcgacaagaatagtaaccatgtttttccaaacagaaaatcaagctagcaggagcacacaagttaaatgacataacttaagcaaattcagagatcaacagacaaaaatagttcagcgcctacagaagagcaaattcttagaagaagcacaagcttgacttataggtaacactactgtccatctgcacctgcaaatgagtctgagaacaatggaacatagggtacaaatagtgttgccctgttttcccgaagactacggatttgatggaatttccgatgctgcatatcatatgacaccaatgtatcaacatcatatgaatccaaaaaaatggtttcacggtctggatgaaaagcagccactttatagtccacaccagttatgctccgcagctcatccttgctgacactatgcttcaagacccactctttactatcataatccttcatgcaccagactgtcgatgtatcattctttttcttcttcctctccttcttcttcttgtcgtcagtagctagcggtgtggcagcatagtgcaagcacccctgtgacaatccaattctaccgaaactc

SEQ ID NO: 71709 - DNA, 449 bp, Triticum aestivum
  Clone ID: PAT_TA_71709
ccaacaaacacatgcaaacaactttgttccacaattcagttcgaactacccacaaaatagcgaactaaacaagggggggttccatcaagctttgggaatctgcgggcgggaacagaaaacctacccgccaaatccgtaaagggggcggccctggcccttgaccgcgtaaacaacgtccatgggggggacggtcttgcggggggcgtgttcggggtaggggacggcgtccgggatgactttctcaaggaaaatcttgacccccccgggggtctcctcgaaaatgacccccgaaatgcgcttaacgccgcccttccgccccagccgccggatcgccggttgggggatgccctggatgttgccccccaggaccttccgggggcgctgggcgccgcccttgccaagccccttgcctcccttgccggggccggacatggttgacaatccttttc

SEQ ID NO: 71710 - DNA, 417 bp, Triticum aestivum
  Clone ID: PAT_TA_71710
gatttttggtttttttttttttttttttttttttgggagcccaaccacactggtgggttataaaaaaaaccagtgcaaaatataccctttttttttgcacaccccaaactcaaaatagctccttacttagctcggttcaattccacccacaaaatttttacagggggagctcctccctggtacaaacgtacgggtactatatgcataattaatctcgtacttaggaaaataatcaatcccaccacccatcaatcaatttaaaatatttaatcccccccccccggaatgatcaggcaaaaatttcgttgaaaaacttggaggcggggggcatgggcccgggggcaaccccctgctgttgttgctgaaactggaactgctgctgcataaactggtccttggcctgctttttgcgcttgg

SEQ ID NO: 71711 - DNA, 435 bp, Triticum aestivum
  Clone ID: PAT_TA_71711
agacaagacctgtgtttgtcttttattcccaagtttgaactagtatagttcaggttcttacatgatagtgcatgtcactttattttttcaccgctacaacgaccaaaccatggactaagaaaacggtgtatcatatatctactactagagttcttctcttctcagttagtaccgaagatgccaaatggagcaatggtgcaatatggagggatatacacattgcacattgcaggtagcgtctgtagcgctaggttccttattgcctcaaactggggcagttgttgaggctggaaagagccctgggcctgtgggttttgctgagatggttggaagaagccctggcctgatggatattgttgctgaggctgttggaaggagacttggctcaacggttgttgttgttgttgttgttgttgttgttggtggtggtggtgt

SEQ ID NO: 71712 - DNA, 312 bp, Triticum aestivum
  Clone ID: PAT_TA_71712
atcatccaaaaagggcttaaaccaaaaaaaacctggccccgatttgagtaacgttcaataacaataggacttcaaaagggggcagcgatcattacatagggaacctaccaattgggggttcaaaaggggggggataacaaagcttgacaacttcaaaaggggggggggaactgagcttgatttacaaacggggatcaatccttttgccccccgaaaaaggccttcaggggatcaccggacttgcccccttcctttgagggccggaacgtcgtgtaccccccgttggggcagggacggtacaacaaagggggc

SEQ ID NO: 71713 - DNA, 264 bp, Triticum aestivum
  Clone ID: PAT_TA_71713
ggaaacaacgtcaaaatcccacccccttgtttaagggaaaaaaatccaaaactccagcggggtcctaaaaaccaaaaggcgggtccaaggggcatatatgtctctttcgcaatcctactgttaaatgccgaccaagttcttttggaaccttgaaaacagccctttggggggcctagggtcaattaccctcattcatgggggccctcatcttcatcaccaccagcaaatgatttgagggcgttgaccccctctacaaaaagggct

SEQ ID NO: 71714 - DNA, 265 bp, Triticum aestivum
  Clone ID: PAT_TA_71714
ggggttttttttttttttttttttttttttcaaaacaaccacgtaggatggccacaaacaaaaaaacagtcaaaacaatcgaaggggcacccccaacgggaaaaccaagggtaaacaagaaggaccaacccagggacattaccggccccccagggagggggaccccaaggggggggggggcctccttcggaatgttgtagcccgcaggggggcggcaatcctcaagttgttggccggaaaaaataaggccctgggggcccgggga

SEQ ID NO: 71715 - DNA, 355 bp, Triticum aestivum
  Clone ID: PAT_TA_71715
gggggggacaacatccaaaaacagtctcaccattttaggaacaacccttaatcgtggcagggtctttgaaaagcaccctggggcatatttacccccccccatcgccgggcaaattcggagtaaaaaagctaacccctctcccggggcaagggttcccctccacgagggggcgctcgattcaacccccctttcaggccgccttgggaaacccgacccccagtttgccgtaatcaaaaacgggggggggggggcccatgaaaacctctcccaggatccaaagaggaccccgggggggggggatgtccatggctgggaatccactgatgcactgggcaacaactccttcgccaacctt

SEQ ID NO: 71716 - DNA, 452 bp, Triticum aestivum
  Clone ID: PAT_TA_71716
acagaaaaatgcatgctttcaatcacaatggtgcacagcattactcaaaagacacatcaaaattccccaaaatagagtaaatcagcaatattaactttcaatggaatcatacaactactcattcatactgcaaaatgaaactgtgccttatcggatctccccgttcgctatggtcttgaccttgcataccccagccgaaattgtgaatgcaacatctttgtagcactccacaatctcactgttgctgtgcaaatcggcggataacttctcccaggttttgcttttggcgttaagagaagcctcaggcccaccataaaacccggcaaacgtcaccttctccccgacagcaacggattctggaggctcaaccaactcaacctttgagtggtcctcgttcgatgcacccaaaaccataccatgtgactttataccgcccattgccaccggtttaa

SEQ ID NO: 71717 - DNA, 520 bp, Triticum aestivum
  Clone ID: PAT_TA_71717
acaggggtatagttaaccatataattcagcaggaactatgtgtgacaaactgacacaacaatcattgttggatcaaggccaacaattacagaccgggttctgtccttccggatgaccacattacagacaaaacagagccaatgtggaccaacttagtggtcaattgtcgagttcgcgtcgcaacctcagcactatcttgaatcatcaacgcaccagcctgacctccagcatttgcttcaaccgctttctctaaccctgctcgatgcgcttgaacttgcagcacggccttgttccaccatctcctcagcctcattctcaacaccgcatgatattgtaggtgacgacagcaacgatggtgggaagttgctatatatatatgccccatactgtgatgcgaccctctcaaactggaatgttttgtccggcgcgaaagtgcctggatcaggcgatgggaattctcaccaacaacgcagaagcaagtaccttccgcttgaacccatgaacctggacccagtaaaat

SEQ ID NO: 71718 - DNA, 555 bp, Triticum aestivum
  Clone ID: PAT_TA_71718
aagtcctcataaagaacgttatattgataattattctcaacatagggattatctataaaacatactgcctttttatgtaaggcgtctattacatagcacaagtagaaattacaaagtgattaccaaatgagggacatgtcccatccaaacattactacccggaaaaaaaaagtttgggcaaccgcctcaggatcatgtttcttttttttacaaactctattgacttctgaaaaaactgaggcaaagtaaatgcaaagtgacctgatttctccattaactgctgggtttctaattccccttgtttgctccctgagcatcgtcgaagattgaacgttctaccatctatgaaccagtcagttcccctggtttgaagcaacctgctatttggcatctctgataatatatgtacaaaaaaatcaaaagatttccctagatatttgtaatacatattagttcttatcttgtaaccaaccaatatgcaagataaagtttctttaggatgaccaagttatatgtacattgtaccagataccaaacttatttctaaacactcat

SEQ ID NO: 71719 - DNA, 588 bp, Triticum aestivum
  Clone ID: PAT_TA_71719
gtctacatcgggcaaagttggttccatttcggttcctgaattaagcatttggcgaaggttagcataacaatcatttcataaacttgagaacatgttagctacatacaaacatcagagcatcaatcctcctaaaacggaagagaacatcataattaacattttggcttcatcaatgtaagggctataggtctcatgcttgcagatggagcatgctctgaattccagcagacaatagttctctatgtttcgctgaccatttcgatgaaccatgccactttccaaacttgaccagtgcttagaaaactcgctgcatgtcttacataaatatactccctgaagaagcagaaacatctgaccaacctacacaatggctgaacaaaaagttgagcactggtagatctttaattgatttgagttggctgtaggagtgcttgcagtctaggaacatataaactcaagacgatgccctgcaaaaaacactgaccatactgggcatatcccccaacaacattcattggtggctgatggcattggttagaaacaaaagatcaagcttctcaagtcctctcctgaaacgactgggagcgc

SEQ ID NO: 71720 - DNA, 429 bp, Triticum aestivum
  Clone ID: PAT_TA_71720
gccaatatatatcaccacttcatcagcatatatgttggcaactagatcccagcacatacacgaactgcggcatatcaagttctagtgtaatgcataacatatttttggtacatgtatcaaggggtttggatcaggtatcgtccaactaataccacactgatatattaaatatcaaatttcatcaggttgtcaaaacagattcacattcagataaagcctgccaccggtgaagcttccgacatttccaggacctcacatcagccaaatatgtaccgcgtataaacttgctgccattcaatcatgtatctacagcaaaaaacagctgttgcgaaaatgacaagtcctctagctcattcatattcaaatttcttcaacaataatatcagtcgtaaacaccaaaagtgaaattgtgctttacaagggttcatt

SEQ ID NO: 71721 - DNA, 319 bp, Triticum aestivum
  Clone ID: PAT_TA_71721
gggaagggaaaaaattcccttcccataaaacccgtttttccaaaattccgggcccgggcaaaaaaaaaaatctccctaaaaaaaaaccccccctcaccggccagggaagcccaaactttctttttccccaacgggaaaaccataaaggggtcaaaaaaagggaaaccctgcccccaaaaaacccggggccttttttaaacccgcccccttttgctttgcccaggggcttttttgctgcctgggcccccctaaactcaggcagccccttcccccctttttatttgtttccccccctaaacccccaggggtcaaccctttt

SEQ ID NO: 71722 - DNA, 608 bp, Triticum aestivum
  Clone ID: PAT_TA_71722
ctcacgggacacaatttaaattagtttcacaagacacgacttccgggtccaagatcatctcccataacaaccagctcatgacactacagatagctgaactagttaatagaccataggaaagactgcatattcttcttccagccagcaagaacatatgacacatttggtttcattagagcaaggaaggaaggatatttctgaatggagtagcccaagccactttaatgttaaccctggagtagacgcttcgaccaaataaggagagaccaagccactttaatcttgaccctgcagctagcaccaatgtcacattctttctctgttacgccgctgtcctttttggattcgaacacagcatcacctattgcaatgggtactttcaagctaccacatgcagagtaggcctgtacagaaacttgaaagttttggttcacatctacagaaacaacacgccttgacagacgaatgttaccatcttgatccatcggcggattatctccgtctggaaaagcaagcaacacaaattcttcaagggggaaggccacaccgtggcaaaaaactttccctgcagatcgaccaggccatgacccatgaataatttgcacact

SEQ ID NO: 71723 - DNA, 515 bp, Triticum aestivum
  Clone ID: PAT_TA_71723
aggggcaccgtgttaatccacatcaacacatttcaatcaagcgggcagaacagtaaacatgttaattgaactgttctgaatcttcagcaaaacatgaaggctaggctaagtaacacacactaggcatcaagttcgacaacatagcttgaaaataccatctctgattacacacagaagcattggaccatcatgggtacagaacctcctccccaccgctgcaataaacacggcatttcacagatgggttttccctcaaaattctgtaggttttcttgcatcctctgctggttggtaaattctcagggtgcaatgtcatggtcattgttttcatcagaggcgcggatctgaacaaaagtttcaagaaagcaatttcaccgccagttccttctgaaccttctatttcaacttcttcaagagctgccagggagatagtctgacttctccaattttggggttgatcacaaggacaatttggtgggcacactcccgtgcacatgaatttgtttatgtccacc

SEQ ID NO: 71724 - DNA, 619 bp, Triticum aestivum
  Clone ID: PAT_TA_71724
ccttgagttgtgacgccgtcacgtccggggccctgaccctcagctccagcaggcctcgatcgatgtcgtgctcgtgcctcaccaccagcggacgaaggaatccatcggcagccacgacaccatccagtccacgaacctctcgacgaccgtcagcgtcgccaccacaagcctgtagcattaccaacagagatttaaaaacttcagattcttcagaagaatgacacggaaaaacaatgcggtacatgtcgatgccaatgtgctacaatttttttccgagattcttatttaagccataatgcacaacttaactacacactgaagcagcacatagctacttccatgacaaaagataacgcaaaagattagaagcaattctgttgtgttggaagccctaaaaagaaacagcacctacgaagcacataaggagttagaggcataattctttcagtaattttctatctgtccatttttctaagtagtcacttcaataccttgatatctttcacgttttcaaagataacaaagtccatgaatctactgttggtagagcatagtgactatacaaactgaagcctgaacatatatacctgccagttcacagacttgacaaatgaattct

SEQ ID NO: 71725 - DNA, 632 bp, Triticum aestivum
  Clone ID: PAT_TA_71725
atagcaaacttaatattgtctcaagaacatttaaaattacacaacctcaaattcttacaatgcattaattcctgaatgcaaatttatctaactttattcagtcttagtacaagaaatattttccttgtatgctctctctcgggtctcatcactaagaaatctttgtttttctcatctggtcttcttcagttgtaggtacctcttatcttcttagctcaccttttttgtgttcttctcacatgcatgtttttcacttttttatatgagtaatctgatcacaataattaagtaatttattttaaatccaaaactgcttttcttttccttcacctcttttttagatttttgaagcggctcaggattctttctagccttcttcttaggcctcgccactggctcctcttgtatttttacaaccaattatattgtgtccttgtttatgacaccctgagcatgtgatcttctgcttgctaatttatttgttcaacaatgccattctgccttactgttgtcttcattctcccttttggtttagtgtaggctggatcattcagatttccaagagaacttccacccaagttggtttacccttcatttgtgtgtgtacttgtcaactctgaatgagaaatatt

SEQ ID NO: 71726 - DNA, 270 bp, Triticum aestivum
  Clone ID: PAT_TA_71726
aaaaaaccccgaaaatgaatttcattcagaaacgacaattcaaaaaggagcctaagggggagcccatacttccataaaaacaaaacaggggcttaacttccaacatttttcacaacaattccacaaccttcacatacgactaacttttaagggattatactatacccaaaccttggaaaacatcgggggactatgaaggtatcgaaaaaatgggacgggaagggatggaacctataacgagaacgatgccgagttcctaggggggggaaa

SEQ ID NO: 71727 - DNA, 340 bp, Triticum aestivum
  Clone ID: PAT_TA_71727
aaagatatgggatgttcaatctgattcttttgatataaataatgcctcaaagtaatactataagaaaggaacaaaatatgaagagacggggtaccatgctctcacctacaataatttccttccatatatgggttttccctagtactgatcaaaccaactttaaatagcagtgatgaccgccaatttttgttcaacacgccaagaggaacccaacaaatacacttttttgcaagacacacaagcaggtgtgaagctgcacaagaagataccatatagaagtcgtcaatggagccagtctgagcgagccaaagaagtgtgtgaccttccggtggccatcata

SEQ ID NO: 71728 - DNA, 284 bp, Triticum aestivum
  Clone ID: PAT_TA_71728
ctttttggacatggtgccgctgctgctggtgtgcatggccgcggccatggagggcgcggcggcgctgcacctgtgcgtggaccggctgtacgacagcacgcagggcaagcacgacgacggcctgccccacctgaacccgacggaggaggcgacctggatggcgctcctgccgcgcaagctcggcgccaaggccgagttcgactggctcgcgctctaccggagcctcacgcgcggcgccggcggcgcccctgcggagttcctctcccaggcgtccctgcacgacg

SEQ ID NO: 71729 - DNA, 260 bp, Triticum aestivum
  Clone ID: PAT_TA_71729
gggcaaacgcaatagggaaaatccctactgtaactcgattttcattagtaagggggtaatacatggcactgtacatggatggtacaaaaggaaaattacagaaatagttcataatgtgtctagccatgattgcattccctcttaaaggctgggcttggctcttttgatgatgtacgacaagttacttcccttatgatctctcaattgcagcaatcttttctttcaaccacaaaaagcctaatccttgggttcttggtttt

SEQ ID NO: 71730 - DNA, 397 bp, Triticum aestivum
  Clone ID: PAT_TA_71730
aaaaaaaaaatgcttatttatcaatttgaaacaacttttccccaaaaatacccttattggggcaaacccaccaaaccacctaaagctaatattttattcggaataccaataacctggccagttttttcacagtaaccaaacgacaaacttagtcaaaacaaagtccacaaacggaacagcgacagccaattactttcacagcaccgcgcccttcttcagggaatcctccttcgcccgccatgcaaggaggttggcgagcttgcctttcttgaccaaagggggggtttgcacactttcggcctcaaaacagtggaaaacggacctgggcgacccggcaaaaacagcaaccttttttttcgcggcaaatctttggtaaatgaggacccccccgcagggg

SEQ ID NO: 71731 - DNA, 347 bp, Triticum aestivum
  Clone ID: PAT_TA_71731
caaaaaaaaagttaaaaaaaaacccttttaaaacccggggggggaaacaacaaaatttgttccttttaacatttaaggaaaaagggccccggggccctcccccaggaaaaaaacttttaaaaaaacccttttgggggggggcaaaattttctctcgtaaacttttcccccccaaggatggggctgggaaaaaggatctactttggccgaagggggggctttgtcctttttttaaaaattttaaaccccctaaacaaacggaatttcccccaaactgggggttttttgttttttccccaaaccaaaggggttagtggccctaaggctccttgaaatcccggccccccc

SEQ ID NO: 71732 - DNA, 597 bp, Triticum aestivum
  Clone ID: PAT_TA_71732
ggatgcaaataccacagctgttattcaaaagatatactatatagcaacatccagcatccactgaaaaatcatcacacagccaacacccccagaccaatatacaacactgcagttcaaaacttgctaaaagccggcacgccaaaattcagctagaacctaaggtctactcgagcagtctaaagtactatccaaacagaaaaaggtttatccggcgagattatagtcattccaaggtaaaaacgcagagcatggagttgcaattgtcctccgaactatcaacattcaaatttcacagaattttgataatcgatcaatcaatcaggacaatgtcctccgagaagatgtctggtgttatgcagtaaagtccacccttgtcgacgatctggtttatgatgatcacaagttcagcattataggccttcagcttcttctggatatatcgcccatctcctgtttctgccttcttcagcttcatgaggcaagcatacctcctccgtaagaacatcatcctgttgtgaatggtgttcaggccgcggttcaaagctcgcacatcaggagtttcaccctctaactcatcagacagtccaaaaaagccaa

SEQ ID NO: 71733 - DNA, 660 bp, Triticum aestivum
  Clone ID: PAT_TA_71733
gcgcctgccacacaaacagcttgcgccccgtgtggtcgttgtacgcctccttgaacttcatcgccacgtagtagtaggcctgctgggcgagagtctggttgttgctctgcgtccgcaccggggagaagtcgccgaaccactcgcacgccgtcagcggggctcggctgatcttctcctcgaacaggtcgtacttgttgagcaccagcacgaatggcgtgtcgcagaagcatggttgcctgatagtagcctcaaacaactccttgctttgcatcatcttgttctgaagattgccattcacaggggttcccactaggtcatagtcactgagtgcaacacagaatatcaccatgcggacatcctcaaacatttccacccacttgcagccatcattcatgcccttggcgctgactctgatcagctgaaatttggtgagaggctgagaatgcgcctctgggttgtcgatgtaaggttcagacatggggctgcgatcatcaagggtgaactcgatgaaagatagcccattcccctgtgttacgccttcagcaaagatcacatctttctctgaaggttcatactcattgcttgatacctcaatggccctgctcaagaagtactcagcaacatcagggagaaaatgcaactcatcctttcttttatatg

SEQ ID NO: 71734 - DNA, 509 bp, Triticum aestivum
  Clone ID: PAT_TA_71734
cgcgattcaaatacatatttcagcatggttcatgaaagcaacacagaaatatgtacggagtttgcaatttttaaatccaatttaggatctcatgacatgagtatgccatgtaaacctcagttttgtgaataaactaaacaaaacaaaaacactataaagaaaatactccacactccttcaattataaagatatgatgatgttgtggtggtgtagtagtatgcccttggccttctccattttattgcaccaaactgcaaaataatgatgggaaggacgtaacatcaggttccacgtttgaggatttctccagattttgtgcatccaactcctaacggatctgatgcaatttcacgataatcagatgcaaaaattccctacaaaaagattcaaccaatcggccagtttctttcacagctgtttaagtcttataccagccatagatcagaggaatacattctttcaggatatctgaagtgacaaaacttcactgccatgaattcccgttatc

SEQ ID NO: 71735 - DNA, 434 bp, Triticum aestivum
  Clone ID: PAT_TA_71735
aaaaaatcactggatataccaagtcatttcttttttgtaactcggctctccatatctcattctttcagcagtagcatgtccgagtgcaaagagcaactcaaaaagccagggattacatcagagtatgttacaacatcctctatagcgaaagcttccttagcgcaagaatgagcagcaggattaactaaacgactagcataccaagtcggtaccttgtgttaccacgctacagagtttggatgatgtgcctagcgatcatgtacactaactaacaagtaggaggaaaatgcatggagcgggtgtggagctggccggcagcgacagccgacagcgagcgcacggcacagcacaagttgaggaaaaagatggcggtgtggacaggggagtaggtggtcgcatgtattctataaaaaaccacagggcaatgtggtaag

SEQ ID NO: 71736 - DNA, 413 bp, Triticum aestivum
  Clone ID: PAT_TA_71736
ggccaaaaaaacaaccctttttccaaaaaaaactaaaaaaaacccaaaatggaaaattttcagttcccaaaaaagggcccccgggaaaaggaaccaaaaaaagggggccaaggaccgggcgggccgggcattaaaacggggcaaactttttaaggggggggggggcccaaaggaccttaaaaaaaccttgaaaaaaaatggccccccccccgttgaaacagggtggggggattccaaaaaaaaaggaaattgggcccttcaaccttgggaaaccaacttgggcccaaaaaaaattcactggggggtttgggggaaaaaagaccctcccggggacccaaggcccaaatttggcccaaaaaaaacttttgttttgttttttagggtaaccaaagggtccatccaaatcccgggcc

SEQ ID NO: 71737 - DNA, 392 bp, Triticum aestivum
  Clone ID: PAT_TA_71737
gggcccttaaaaaaaggggggggattcatttgattccttttaaccctacacccgggtcccccccccccccccgcctatactggttttcaaaaggcaatttttcgacccccccccccttttccaaaaggaaaaacaagggggggggaacctttttttaacccccctattttttcccgggtttaaaacccccctttcggggacccctcccccccccaggggccaaacaggggaaaaccccggccccggttttggccaccggaaaaaccaccccgcggatttttgttttaaaccccttcccacccccattggcccccggggggatcccctccccccgccccctaatttcccccctgttctccctttccttggggaacaaccccctgaactttttt

SEQ ID NO: 71738 - DNA, 165 bp, Triticum aestivum
  Clone ID: PAT_TA_71738
agttaaacaaaacacaccatttttttgaaggaaataccccaatatagcttttttgcaaaactcatgataccaacccaccccaaatttttttttgacatgaataaaaacccaacccaaactacagttaaaaaagcaaatcctacttataaaacccccataaatttg

SEQ ID NO: 71739 - DNA, 431 bp, Triticum aestivum
  Clone ID: PAT_TA_71739
aaggggcggaaaaatgccctgaaagggccacataatttttcccctcccgggtttaaactcaaacaaaacctctaataacatcccccccattttcccccattttttaggagtttggaaacctgcggcccccgcagggaaggggaatttaacattctgtaacacccatctgcagcaaagggcgcaattcacagttccccatccaaaacaagctcacaacaaaaaaaaaaaattgatgtttctaaaacccctcgattcaaaattttttcaaaaacttgccaattgtttcaagctggcagctgaactcattttaaaaatcacatggggatccccttgccgaaggggttaatgcccccctcctttagggcctcactcactgtcggatccccgtggcacctacgggcaatgtccccgctggatgccccatactgaag

SEQ ID NO: 71740 - DNA, 425 bp, Triticum aestivum
  Clone ID: PAT_TA_71740
gtttgctgacaccagttcgtcacattaccctcgggtgttcttctctttccactgacaataacatcaaggtaaaaaggttcaaaaaaagaaaatgcgatgaatctagtacaacataggagtatgctaattcggtcctcctgtcctttctccatttttatccatgatctaaatagatagatagatatgacttggccgattaacaattttttagcagtaataaagtaataacctagaggattaattactcaacatcacacccagcaacaaacaacaggcgagatggatcgaccgcccgaacaagtgacctacttgtcgtcggctcccggcaccaccggcgaagtgggcgccgcgggatccttctgatcctcctgaaccgacttctccttctcctcacggtggccatccccgggcctgggggcaccgac

SEQ ID NO: 71741 - DNA, 279 bp, Triticum aestivum
  Clone ID: PAT_TA_71741
accacacgaaaatgctctccggctggctaattctatgccctctattgtaaacaaacaatgtccactgcaatgtgcgggctggacaatccacggacggcgcgcaggtacacacaacaaatgtgggccttaatttcaccagcccggaaatatggtcatagaatacccttacagccaatagctaccattcccaatccttacataccaatttttttccatgtttgtacctagaaaacatgacctaatgactcgctccttttgaagctgaaaaccatccttcca

SEQ ID NO: 71742 - DNA, 399 bp, Triticum aestivum
  Clone ID: PAT_TA_71742
atacccataactcatgcataattcctatcctttataggcgtaaaaatataaactgtacacagttcctcattggacccataactcatgaataattcctatcctttattggcgtaaaaatttaaactgggcgtggcacctacctacgtaaggggggcctgccatgcaaatttaaaattttaccactacttttaaatgccaaataatgaaacccgttagttgttatggtccgatcaaaatattggatcactcatcaatgggcggcgcctgcccaaactgatctcgcaacctgcagctgcaaaaaaacacactaggcagccttgacgagccacacctaaccgacaacagccgccgttgtgacagggtcacgtccctcaccctggcccccagctccaacatgca

SEQ ID NO: 71743 - DNA, 538 bp, Triticum aestivum
  Clone ID: PAT_TA_71743
acgggaagacttctcaatcagaattttaccgagcacacaaaaatagcaagatgtttgaactcatagctaacctaacactagagactgtaagactgttgccaccaaaaacgtggtaacattcagctgccaccctatcctttcctatccttcgtagaaccactagacacacatgttgctgcaagcactcaacacatcaggataaccgacaaatctgtctgagtggcaatcacgcacgacttaaaacagtccgaagaaacgatgtcgctcctggcttctgctgctgcttcgtccagatcctgctggagtcactgatatcctgtccgcattggcgagcgcccacctgttgaaatccggcgaggacagtaactgctgcataccttttcttgtctcttctttggtgaatgcttcgtattcctctttcgtaaactttctcctctctggggtagtgtggtaggtcgaatagtagctgtccctatcaagaacttgtgacgatgttttcttctgtgagcctggacaagtaaaatcaagtggtatgctg

SEQ ID NO: 71744 - DNA, 332 bp, Triticum aestivum
  Clone ID: PAT_TA_71744
ccggccaaaaacaattttcggccgccaggcaacccggctgcccaacaaattttccccccccaattccctgggttccaaaacccctagggccatgtccatccctcccccccggggggcaaccaattaaaaacctcccgcaaaaaaagggccgtcggctctaccaaaatcccatcggctcaaacctaaaaccacccctggcccttttgggaaggcacccccccaaaagggccctgtagaaaaaaaatgaagggctttttgtaggacaaagggccaaatcttgacacaacaaacctttggagggacccggccccagggcttccaaagctggaacc

SEQ ID NO: 71745 - DNA, 377 bp, Triticum aestivum
  Clone ID: PAT_TA_71745
agcggggaaaacaaaaattttaaaacccagggggtacatgagggccgccccccaacaaatgtccagttaacggggcaaaaggcataaacccctacaaaaaatcgggggtggaacaattgaaccggccgcctttgggcataccatcatccttcaaaaataccccccgcctccaatctttttttcaggggacccaacaccccatcccggggcatttttccccaaagttcccggattgccggggggcaaccaaattcccccccggggggtgctctttgggaacccctgaattaaccccaatggtccccccaataaaagtccttgggcccccaatgacaatcagccgggccccacaggctcggaaagcaaggccccctcct

SEQ ID NO: 71746 - DNA, 611 bp, Triticum aestivum
  Clone ID: PAT_TA_71746
agacatatttaagtcatttgccaacaacagccataagcaccagaagtttgcgtctgctcatactccactacattgtcggcgacacacattcaagcaaacaggtaataataaggtaggttttgttcaaatttaaaagtacctgcggcacataccccctaaaggaaataaagcagcagattgtatactaagtgacaggtcttcatgtagacaggtccgtacgacgaaggggcttcatcgttgagcacgtaatgaagcaccacggatatcagcaaatccaggtatcgtcatacgtccatagccaaccgtcatggaccaaaagagtggatcaatcggcgtcagctgctctagagcttatgcctttttctggcactgggatcctcgcctccctcctctgcatcaacaccccttcaaaaacaaccaacagttgaacacaacagaatggaatcgcatcaacaaacataacagctgattcaaaatatctggaaaagggcaagcaccttaaagtaaccccatcaacatcctgtgttttaggatcaacaactggatccgtgaccttaagaaagaaagccaaacaggcgtcaatgctaaattaagaatcatcttgtcagtcg

SEQ ID NO: 71747 - DNA, 464 bp, Triticum aestivum
  Clone ID: PAT_TA_71747
ccaactttcaacttcttaatttattgcataaccagaagctacatcagacggcagcgatctgcggccacaaaagtcaggtggcgcaaatggctgcttcatcatgagggcctgaggctctcttgcaaagaaactgtaggaggacccttcaaaagcagtaaacaccttgcccggtgcgacctcccttgctttccccagcaaatgtccaaagaaatgatcaccccatatgtcataagtgaactctttcttcagtgcagtgacaccctcatctctcttcacagccttatttttcatcaggttggagccgggagcacgaccatgcggggcaattggggaagatgcggccaacattggtgagcgccatgctgtggtcagtgcagtggatgaagccaatgggtttacagatgtccctggaggtgcaggtggctgctgcttggcagtttgggaccacccattcttcactttgt

SEQ ID NO: 71748 - DNA, 293 bp, Triticum aestivum
  Clone ID: PAT_TA_71748
aatgggaatcagggggcatttgagcccgggaacaaaaaaaaacttcaataaaaaatcgaggaatgcctttttttacccccctttaacaacaggggaatatcaacttcccacaaaatgaacatgcccgggccccccaaaaaaaaattgctggggggggggagggcaccaatccaaacccggcacggttttttggtgccaaaaaaatccaccccccccacagggcaaaaaactcaatcaacctatccccaaaacgaaccccccaaaaaattaccctcccccctgaccaaaaaaaa

SEQ ID NO: 71749 - DNA, 564 bp, Triticum aestivum
  Clone ID: PAT_TA_71749
tctgctccccggcgccgccgtcgcagacggcgtcacgccttccgaggcgcgcctgctacgcgacgaggtgaaagatatgttttatcatgcatttgatgggtacatgcaacatgcttttccacttgacgagttgcgaccgttgagttgtcaaggggaagactcccttggtggttatgcacttactcttatcgactctttggatactctggctttactgggtgataaggagagatttgctgctggtgtggagtgggttggtaagaacgtccgctttgatatcaacaaaactgtctcagtttttgaaaccaatatacgtatactggggggtctgttatcagctcacctgattgccagtgactatgccactggtatgaagatcgaatcttatgatgatcagttacttcatttgtccgttgacttggcccagaggtattccatttggatctgttaatttattgtatggagtcgatgatgatgaaagcaagataacatcgacggctggtggcggcactttggcattggagttcggtgtcttgagtcggttgactaataacactgtttttg

SEQ ID NO: 71750 - DNA, 497 bp, Triticum aestivum
  Clone ID: PAT_TA_71750
gatcaccactggggatctgaatgcttcttatcaacaacataacaatcttgattcttgaaaaacatgagttggaaacaattcaaacaaagcaaaaaaattactgatacatacaaaaatagtccagtctcataactggtcgttctaaagtacacatattaaaaccacttcatttctactccctctgtcccataatataaaaccgtttttgacacgacactagtgtaaaaaacgctcctatattatgggacggagggagtaccttacaaggaattcaaaaaattctggcacctttgtcttctgtttaaaatccaaaaaattctggcacctttgtcttctgtttaagccttggggctcacatcaaataaggtcaattcgaccagcctcgacaaggcccttgatggacttgtaccgaaggacatacaagtcatcagccaccagatccacaacttcctcccctacgtcgtctagctggaatgctcctacgtcactcttggtct

SEQ ID NO: 71751 - DNA, 561 bp, Triticum aestivum
  Clone ID: PAT_TA_71751
caataataaaggattgttatcttccttctgaaaaagaaattacttttatagggagaccataaaagtggcttgccttgctcatattagcaaaaaaaagggcaatgaaagaatatagttgtatttcattagagataaggagcacatcctatatcctatatacctaagggtaatccacactacttctaattatcttaacatgtgtgctttcacataatcaaaattgttgtagttatgagatttactagcttgatccactagcatccgtctgatccatacaagagaatgtgtaccatgcaacatgcattagtgcattctaagtggattttaaattatattgcatttaattgtgacatgcacaacttttccatgttaagatttctttttgcatgtgcagaaaactctacattttaaattggaaggattgaactagtgtccaacacaaaatttagaaactatatatatccaattttgtggcaacgatgtcgtctagtttgatcaaagaacgggctcgatgtggaagcaaattgttttggctacatggacttacccccggacctcatc

SEQ ID NO: 71752 - DNA, 307 bp, Triticum aestivum
  Clone ID: PAT_TA_71752
caaaaaaatattaacatgccatccttgtaatcacggcgacagtttttgctagaccaataaataaatttacctgaaagatgaaatgcccatacttctgctaccactaataacagctgaaaacacatgcccaaaaaaatggaggaatttacaaaaaatccaccaagagttggccctaccactattttaaacaccaaaggacaacatcaacccatgctcctcagtccataaggctcgacagcgtgagtactacaactcgctgcatgggtcatacgacatcccttctccgatcatccttcctttcacgcaa

SEQ ID NO: 71753 - DNA, 541 bp, Triticum aestivum
  Clone ID: PAT_TA_71753
acattataggggcacgtgtaaatatagattgctcaaaacgttctcccccgatgtttttaataaggtcatattcctgatcgtgcatacatgttctggtactctaggaaatacagtatgtgatcaaagcttattctgagcgtatatgcaaataaataacaacgtagatgtgttgtgcatctatgagtagaactatacatgccagcaaggaccacatatcctactactctacagcttgagctgcctatacatacatattacatctgtggtcttgtctggactacgtagatcttcccatccttcactactccctcaacatcctgcggtgacccatagagctcctcaatggcgtggccagcccgtgcaatgcttgagaggattgagctccggaatccagagtcagtgatgagagggtcggtcgtgtagtcgagtacaacttcatcttccacatccatagggacactatcatacagccctgctccagcgtaaccttccagatcctcaccattagagtctgaacggaagatgattgaccgctttatga

SEQ ID NO: 71754 - DNA, 334 bp, Triticum aestivum
  Clone ID: PAT_TA_71754
atttttgggcttttttttttttttttttttttttttttggaaccaaggaactgcatcaaattgcccccccaaaaactaaaaatttcccaaggttccctcacaccaaacgaaaccaaccttatttaccttaccaaacccctaaggaaaattgttcaccgataaaacaacttagggacaacctagcctaccttaaaccaaacccccttcccctggaagccattataccaatctccagcccccctcctaattacttcccaaaccttattccttgaccccacaggagtatgccccccacaaggtatttaccaccgggagccctccatcaccttttcca

SEQ ID NO: 71755 - DNA, 576 bp, Triticum aestivum
  Clone ID: PAT_TA_71755
aaacggattttcagttcacactgaattctacgccgatgtgcatggctttaaaaagtatggcgaattaaccatgagtatacatctgcatctcgaccatcggagtgaatagataaataggaaagctaacttctgtcccactgctttttttgcgacgaaaatctcatggtagcgctttttcaaactatatgatttcatcggcgtgggcaggatgaacccgcatcagaaaatcccggtgcatcttcttcatcctcattcacctctttggctctcccttcatcactgtttccttatattctcttgagctcatatcccacctacaagctaatagtcaccaccacaatgcgggcttctaggatctccttcctagtagtcgccaccaggatgtagcatcagtattcaagtgcatggatccaatttcaatagatgttccaacatcttctgcgcgccagaattctccgcatcctttactcttgacatcggttcacctaaagttaaccaaataccaccttgggtttctacctgaaccgagtaaacaaatgtcctatcatgtgccggcccatctgtcttctctaactt

SEQ ID NO: 71756 - DNA, 548 bp, Triticum aestivum
  Clone ID: PAT_TA_71756
aagggaaaccaaattaagcaacgataacttcaacaacaaagagtacatgaattactaaaggacaagcccgcattaggtaaaaagtacacacacaaaccagctataaccacaaaccatggccggatcaacacgggaaattattacagtacgcaggacgcaaaagctaacgcgcgctgcccacgcggttacccaaattggatgggcttgccctgcgattcttctgctgctggctctggctccggctctccggtgcccttccccggcaccggcacgctgttggacgagctctccttgtcggcacaggctcctccgttgctgctaccttccccgtatccgtacccgtagtattgctgggccacggcacgttctccgccgaacacctggcactgcccgtcgacgttcgcccgcacgggcgttatcccgacggcgtacccctgcaccggagcctggggcgcgtaaacgccccgctgcatctgaacttgcaccggaggcgggggagcgtacatgggccactgcacctgattctgaacctgcatcggagctggggg

SEQ ID NO: 71757 - DNA, 404 bp, Triticum aestivum
  Clone ID: PAT_TA_71757
cccatcaaaaggaactgcttaacattgcaaacaatgggttttgatcctgaataattaaatttgcttccttattatgaaccaaacccccaaaatttccccccggggacttttttaaaatttcatacctccccaaatgaccaaatttaaaaaatttcttggcaccacataattcaaccctcatccataatctttccaatccatgcttcctccaagtaatgaaaaggacccaatttccttatgacccaggttgatttaaaaaaaaatctttttaattttgcagaaaaatataagttcatttctttttgcccccaaaaaaaaaaaaaaactaaattaccgggcttaaaatttaccatttttttttcttaaacctaccaacccaaaaaaaaagacctaccttttttaaa

SEQ ID NO: 71758 - DNA, 590 bp, Triticum aestivum
  Clone ID: PAT_TA_71758
aaaaaaaatgggaaatttttgactttttattgaattactaaaaaaaatttcatccgtggcgtgctgagatccactgtaccgctcaaggacaagcatagatgctaaaccactgtatcttaacttggcactgacagaagtaaatgacacccttattttggcaatttcagaaaatggcgagatacagccttgttgcacaaaggctttgcccagctggtccgcgaatattttagcattgttttccatcacagcagcattgttttccatcacattagcatgtttcgataagctgcagtgcacgacagagatctggtctttcatcctaacatcgacaaaatatacaaaccattcttgctggtgaatggtaggagaagatacgaaaatctgctctatttgctttggttttcccggtctgattctctcatcacgtctgattccctgatcagcaaccactttcgcaatactttccagaactccatcgctggtcaagtcttgtggagggataattattctgcgtttgatgtagccgttactcttatcgtcatccttgaggcatttgacaaatgcattgataatgcccaggccattgtcac

SEQ ID NO: 71759 - DNA, 419 bp, Triticum aestivum
  Clone ID: PAT_TA_71759
agagcaagcaatgtccgtgtatactagtccaccctgtctctgtacaagaaaattccatcaaaatcgcaagatcaagcctagcaatggaaacaactgaaacgacaaattaattctacccaaggccgagactaactacagcagtactgtactatactgatgatgaagcaccgtcaggaacgaattctagaactcttttctcttctctccgtgatgacaacgacgtcgccggccccacccacacgtgccgtgcgtatcaaacgaacatggcacaaaaagggatcctcctcgcctccatctccggcgacgcgcgcggcggagacggacaccgtcgaacggacggacgaaggaaggtcggtaggatcagagcttggtgtggtcgcggcactcctggctgcggacgcccatctccgcgacgccga

SEQ ID NO: 71760 - DNA, 472 bp, Triticum aestivum
  Clone ID: PAT_TA_71760
cccattgcaaaaaacccccctttaatttttataaacaaaaattgtttttgtttaaccccaagtgaagggataccaaccctggggcaaaaaatttgcagggattatttctcgttttgcttccgcaaaatccccgactagttaggggaaactgggtaaaacccaaaaacaattacaccccccccgggctccaaacacggtttaactcccctaaaacattaaaacctttttaaaaaacggccacccgaaccctttttttgggtacccctttacaactaggggctggtcaaatcacccttgtttgtttcattctttccccggaaaaattttaaagcggagctcctttccaatctccctccaatacggatgtcatgttggtgggtccaatgtcaaattccctcacccggggtatttctggtggagggggtcaatgtcaaggcccttgaccttcaccacggattcaacggggcccttg

SEQ ID NO: 71761 - DNA, 483 bp, Triticum aestivum
  Clone ID: PAT_TA_71761
aaggaagggcccccatccaggcatgaattattatttaacctcaacatccccccccccaaatgaaacccaaagcaaaaggaaaaaggaatcgctcgctacataaaaaaaaaaaagggggggccaaaaaaaaaatgactagggggcctcaaataaacaaaaaagcgcatagcactacccccgccgcagggatcgggatcaaaacggaaacctcaacgggggcgggggagggccctggaactggggggttgctcaccggaggaaggggggggtcccccacgtgggaaacagtaaacaccggttttggggccattggtgggggcaatgctgttttatcctgtataaccccaaccaggccgccgggctggggaggcaacatgtaatagggggttttgtcccccatgttcctgcacaaattcaatttgtatttgggagccgcccccgggaaatcggggatgagtccatccactccgcctttttttcccc

SEQ ID NO: 71762 - DNA, 465 bp, Triticum aestivum
  Clone ID: PAT_TA_71762
gacccaaaatgaacaaaaaggaaggataaagtccaaaatacaaaaaagctttttttgtttataaaccaaaaaaacccacttaacctccaatagcctatggtggatgccaccttaaaaaggtggagcaggtactatcttttggaaagcaaatttgctccctatgtgctattcacattataagtgcatgacacatgaaataaaaaattcattattcaatactaaaaaaaaggttcaaagggcaaaatttatcggctcataagcgctgattattttcaaaataaatcataagaaaagcaccattatacctgtggaccacattcctttcatggagataaaccaatccattgaaaatctgccttgtgtacccaaaaacttgtaagtctcccagtttatacttctgatagagggatgaaaaaaaaccttgtgtaacaagctcaataaaaatgtaaagttttgattcttcct

SEQ ID NO: 71763 - DNA, 309 bp, Triticum aestivum
  Clone ID: PAT_TA_71763
cgggaaaaaaaccccccggccttttttccaataacccttttttttcatttaaaaacccccctttttgtcttgaaaccactccaaagggggggctgctttaaaattcatttcaaaaataaggggggaaaaaacaattcttaccccacccccccccccaaattttttccaaaaataaccgggcatttgcttccccaaaacccaacctggggacccccttgttcgcgggcccccttttttttccatgaccccccttctttgggacccccccccctttggccggtaaggggggttttcccctggaaccttttt

SEQ ID NO: 71764 - DNA, 406 bp, Triticum aestivum
  Clone ID: PAT_TA_71764
aaaccggcaacctcatcaattccattggagtatctcaaatttttaaataatcgcaaaacaatttttcgcaaaaaatttctaagtagttattacttactcggccctcggcccccccaaaaaaacaaaaaaacaaaaaattttctaaccccccccccctttaagggcccccctttaatccttgaattatgtacacttaattcccacttaatcccccccccccccaaaagggaaggaccaaggaaggccccgacaaaatccctgaatcaaaaaaaggggatggatcaggcctttttgggggggaacccggaggccatcatgaccttgaactcgtaaaaggaaaaaaccccgtccccgtttttgtcaacccccttaatcatgccccggcactgttgcaccggggcctttt

SEQ ID NO: 71765 - DNA, 333 bp, Triticum aestivum
  Clone ID: PAT_TA_71765
aaaaaccccggcaaaagggggctggatctcaggggatcggggcaaaaaggccactttgccacttaaaatgccccgtcgggtttttaaatcgtctgcaaaggattcccccccccccccgttgggaagggacctttaagggggccggcccgggaattttggccggaccggtttaaccaatggcacggccccttgggggcccaaccccccctaacttgggttggggcgggcgggggccccaagcctccaatgctaacttggattttaacttaaaggcgttcaatcataatccggcacacggtaccttccccccactggtttttaaaccaaccccaa

SEQ ID NO: 71766 - DNA, 247 bp, Triticum aestivum
  Clone ID: PAT_TA_71766
ccccccaaaccaaacaggaacctaacctgctcccccggcacccctgaaccccgatggcccgttgggtccacccctcccaccaaacgggaaaaaaaaccacccccttctaccgttttatttttacagccaactgctcctgaccaaccagcgttgcagggccagggccaccaggggatttgaaattttttccgggggggcaaagggacttttaagttcactgcccccagcccccagggaaaaaaaccca

SEQ ID NO: 71767 - DNA, 298 bp, Triticum aestivum
  Clone ID: PAT_TA_71767
ggaccccacaatccaattggaattcttcaaatttattttccgccttacaagaaaagggctaccttattttttattactcacaataatttcttggaaaaaacagcatgggaatccctcgttcttgttctactctgaaaacaaaaatttctccaccttttccacttcctccacgctcccgaagtacaaaggcactctttgatggacctttgggggcatgatgtcaagtcccctttgggggccgtcggaacctttgccgccggcctgcttggcaaagaaactcatgggcccccactcgtaa

SEQ ID NO: 71768 - DNA, 186 bp, Triticum aestivum
  Clone ID: PAT_TA_71768
atgattgcgtgttctcgtggcggggggcgacggggccggctggcctcccgcgttcacccggctttgctcgtctaggcgaggagggctgaggaggcccagcgccatcgcgcacgccgacatgatgcttcttgccatgctctggatcgcgcccgcggtgtcgtcggcggcagcatcgagtgcggggcc

SEQ ID NO: 71769 - DNA, 542 bp, Triticum aestivum
  unsure (1)..(542): unsure at all n locations
  Clone ID: PAT_TA_71769
gctaaaattggtcttataaatgattttatagccctttctgtgtaatcttttaatgccaaaaaaatcgtttagggttgaattaaccctggctaggccatccggataccaatcctttaaaaagtatagttattcccgtcaaacccatccccaccagcccaaatctagacagaaaaactcgccctcctccactgccgatgctctgcttctccttcctccactgcccatgctctgcttctccttgagtgccgatgctctgcttctccttcaccgccattgctcggccctcgctcctccttctctgccgcgaccaaggctcgatcttctcatgcaaatcctcaggatgaaggtcctcttcttctttctgctcctcctcgcggctggacaccgatgtgcggccgtggccagttcagaggatgcggcatacatgcatcttctggcggcggcgacgggggctgacggcacgctcggctggaaggccgggaccgacccttgcgacggcggatgggcggnggtccggtgcgagctcggcagggtgaccggca

SEQ ID NO: 71770 - DNA, 601 bp, Triticum aestivum
  unsure (1)..(601): unsure at all n locations
  Clone ID: PAT_TA_71770
agagttaaataataatacgtttaatgtatatattacgaggcgacgttttacaaaaaaattcgcaaatacttaacagtatgtacctaggtataatataatatacaacaatattatataacatacatattatcatgaatgtatggttttatttttaaagataaatatttaatttacaaaatatatagtaaatacaaatactcattttaacgacaatacactaatttcactagttttaacaataaaacgaaaaaaaaatacttaagatacaaatttccagtcttgtatttaaaaacagcttttaaaaaaaaaataataataaaataataataataataataataataataataataaaataattatatggatttggggggggggggggggctgcacntttggataaaataaaaagcggcacatgcatttagagtcaaacgtgtcgtacgtgaggaactacataaaccgtatttgcagtaagtacatagttttcgcaaacacacgatacgtttcaataaaaaatattcggtatttaaatcgagcttttcgtgtaagtatttttctagaaaaataaaaatagtaacactctaaaacgatgccctcc

SEQ ID NO: 71771 - DNA, 444 bp, Triticum aestivum
  Clone ID: PAT_TA_71771
aaacaaaaacccggccctaaaaaaggttaatggcacaaaatttggggaaactggggagaaaaaaaaaaactattttattctttctttaaaatccggtttccatgaaaaagtcccaacaacacagcttccttccagttcccctaccggaacaacagggggactaaacgggaaaaagttcatccttgattcaaaaacggtaccaagggacaagcaagggcttaaccccctccgatcggggctccatcactgaataaaaaacggtaaaggggaccccccccccccctttttttttttgggaaaggacaaataattggcccgaggtttccccctaaacagccaaggggacagtttcacccttttgggggtcctggggggcgtaaaccttttaagggtaccaacaattctcccccctgtcagggtgggaaacttccttccaaaaccctt

SEQ ID NO: 71772 - DNA, 549 bp, Triticum aestivum
  Clone ID: PAT_TA_71772
ggttttttactatcaatatgaacataatcaaatctagatgacaaaaatatcatacaaagggtggcattaaaggaccaaggacaaaggttcttgatccgcttctatttagtcaatcaaaacaccttaatgaaggataacaatccacaaactgcaaaaaaaacaatccacgaattcaaccaaagatacttaaaccatactcataatggtaatgatgtaacatgtgattctgtgctaaatctgattcaccaccaatcagccaggcatcacattaattttcccactaaagacatgaaccagggtgcaaaaacctcctcttcaaaacctgaaacaaaaaattcacaaaacgaatagatcttcgaaaaggaggggatgaagcgagggattttgaaatgaaaaatttttctatcaactcactatcaaagggtcaaatataatgactaatcaaaactgatactcactttcaaaataaataagaaacaaactcaatcctcatatactaatatagtgaaaataatgtgattcttcaagcaccggacatttataaaattg

SEQ ID NO: 71773 - DNA, 546 bp, Triticum aestivum
  Clone ID: PAT_TA_71773
aaatctagtcaatttctgatgtatttccttttcctctcaagaccaatactaagaccgacacttgacccatttcagactgtagtctttaaccgtggacacggctattcagataggttttatactgtgcagaggttgtactctttacccacaagtaaaggatttctttagccagcaccgaggcgctgactaattcccattacaatctttgggttaaaaacacacctaaccagcacacaccagcttaactttcctgatgtcaggaatcacccaaagcatcactcaagaaaaactctaagatggagaggtcacaaccttgcatgggatcacaatttataccgtgcgctaactaagaggtgcttcctctcggcctcagccgcatacacccatggccctgacccgatgactggcattattcctagaaccgggaaaccctcatcgcggccctctgtatggtgtgtgcgaaaaaggggttaacaacttactgaaccataccctacctgtgggagggacatgtagtagcacgaatcaagtatgggggttaccgga

SEQ ID NO: 71774 - DNA, 330 bp, Triticum aestivum
  Clone ID: PAT_TA_71774
ccggcggcgggaaaacccacaaaaccttttttaaaaaaaaaaaaaaaaaaaaccgggccccccaaaaaacgggggggccccccaaaccaaccccaaaccaggacccccccccacccccccatcgaccggaaaaaaaacggggccccccccccggggaaaaccccccggcttcccccccaccaaaaaaaaaaaacgggcgggggggattttaaaacaggggccccgattaaaccagtttttccctttttaggcggcaacaacaaacccaaaatttttcggagaaaacccccccctgccccggggggaaaaggtccccccggaatccctatg

SEQ ID NO: 71775 - DNA, 119 bp, Triticum aestivum
  Clone ID: PAT_TA_71775
agattttgatcgattcattcaaaactctgataaagttggggtgaaggctacatccttcattcgcctccttacacaacaacggttaccaatatcacctcacttgcttcctttctatcaac

SEQ ID NO: 71776 - DNA, 587 bp, Triticum aestivum
  Clone ID: PAT_TA_71776
catagtataaccgtcattaactatcattaccaaatgatcataaattgaagtaatcgataacaacatatgatcaatacataagaggtcacatgtgcatgatcgatcatgtttaagtacacacatgatgatattacatcgacggttctttagttcagttggtagcagatggcttagcatacactaatagttgatctcaagtcttatacagacatgtcctgtctgatagcatagaggtaggatacacacatacttagactacaataggcaaggggtatcagtcaaatgtagacacattcgctgcctgatatggtcgaggtagagcagacataatgtacaataagggcaatgcaaatttgcaccaacttagaaagcccaacgataaaccaaaagcgcttcatcctcctcttgtggctgattcatcaagcattttcatcatttcttcacgcatccacaaacaaaaggataaggtccaaaagggcgagcactcaacaacacctgacctcttcggtctcaggccctccttgcctttttagttttttgaatggtggtgccctcaacagccaatggcacctcgcttgtagtaccgt

SEQ ID NO: 71777 - DNA, 636 bp, Triticum aestivum
  Clone ID: PAT_TA_71777
gaagtgagggagtatatttatatatgtccaatgtgtgcaacaaatgtaacatatgaaggagcaatgcccttggaatataataatagataacaatacaaggaatgttttaaaaaggcaaagagaaaagaggtgattaaacccaccaaatgcttgaaaatgggggctttaatacctccattgtgccaccactacatacatatcacataaaaacttccgctaatagatctgctcttccatatgctaatccttggtgcttcatgacaatttttatcacagattcacacttgcgatcgcacgactcatctcaaccacatcactgtaaccctgcatcttctggtcattggctcccaagaagtcactaattaatagtgcaacattgccaatgttatttcaccactccactgatggtgtacagcaagtatccatttacttcatcttgatctttgtgtgtttgtgcttatgccaaatctgctctcttttttgtgagatactatgggtcattgttgattttatcggtgattttattagaccaacatatagcatggcttcaaactgtaagtcagcccatacactccgggacgccatctcaaacagtgtgtcatctttgctgtgagctccccaaagtggttcatgaat

SEQ ID NO: 71778 - DNA, 604 bp, Triticum aestivum
  Clone ID: PAT_TA_71778
gaaccaaacttactagtatgattcttcaccgcactttgatctcccttatgcccaatggcaaaactttacacgtccttggaacttgccaattttacatgtcttaacaacgcatggagacattccctaccaaaaaaacacatgccaggcataaaatgatcctacttgttccctggatacataaatcttcatatttcttaacagcgcatcgagacattcgctaccaaaaaaacacaagccaggcataaaaacatattctgtggccagtgctatctccaacataatattttcattggaagacaccgaacaaacttccggagtaggtatttatcttgctttttgcaggacatgccatttgcaccatctgtgtgtggtatcaggccactgggaggatatagccttctccattgcacgggcttggtctgtcagtattgttcttggagccttccctcccatcaaggacacaaattccttgaacacccactcaaaggtcttcgtagtttcatcgcgaagcaatactcccccaaatatgatgctctggaagtgattgtagacaccaacaaaaaatccgaatggcatgtcgtactggttggtacgatatgttgtg

SEQ ID NO: 71779 - DNA, 175 bp, Triticum aestivum
  Clone ID: PAT_TA_71779
attttatttttggatttttttttgttaagaacttatcacataaacatatataagatatggtaatacaaatttatactgtttggacgtcacataatacatggggggggggatcaaaggaaaaacgggtcattttaccgggcgcacaatgacaaaaaattttataggttcattacct

SEQ ID NO: 71780 - DNA, 550 bp, Triticum aestivum
  Clone ID: PAT_TA_71780
agataattggctactcattaataaacttagcgatccactgaatgaagtctaggcaggacatgcccaatggaaccagatacaagaagggcccaaggaccctcctagcagccaaacagcgccccacaacacacagcaaggtgttcaaatgacaactaaacatgataactaaaggtctatgaattaaagaggccacgcgctcaagctgcacgcccagcaagctcatcaaagatggcttgcagctcagcatcaggcagtgaaagctgagaaggcgaggacaagcccgcgatctcggccagcttggctatgttagccggtggcatcagggcacggaagaactgaatgtactcaagcacggtgtcgtcgttgaagtcctcgggacgcttgatgaacccaagccgggtgctgatctcagcctgagcacgccttgaagaagataagttggagccaaggtgttgcaggcgcgagctctggcgagaagctgaaacaactcgaagcagccgctgcttcagcttgcgaggtggtggagaagacaaggctggaggagcgccaa

SEQ ID NO: 71781 - DNA, 167 bp, Triticum aestivum
  Clone ID: PAT_TA_71781
aaaaactttgttaaccatggaacgacttaagttaaaaatacaaagtccagcaacgggcatttacacccttccacaaacttaaaaggggggaaaaagctggggccctcacttccacagtttccgcaaggacatgtttttttaattggccttcttaatcaccttggcca

SEQ ID NO: 71782 - DNA, 387 bp, Triticum aestivum
  Clone ID: PAT_TA_71782
gctaatcacaaacccacccattttattatataacatacttttattttacaaaaacttgagctaatacttggcctacaaaactgaatatatttttgcaaaaaaggaaacacactgggacaacacatacttgaactggaattacgtaaattcagggcaaatgacaaacatacttgtcccacacgggggacaaatataacattcgcaaacttattttatataggggcatcaactagtcggatcctaaaacacatacactattttatacaagtcctaaatcctgcgatttaaagagagagaaagagatagaacctgcagcagcgagtgggggattcaaaaaaggacagcagggtcgttttttttaaaagggaacaccaccagggaagggga

SEQ ID NO: 71783 - DNA, 500 bp, Triticum aestivum
  Clone ID: PAT_TA_71783
gacgactgcaactgttgtggacaaatataactcaaatgtgcaattttagagttataaatagattataaatcgatcgaaatcactacaaaaactagctacaacaaaattttctgccaactcgggttgatgaccagttggattctaatcaaataacttgatacctttgatccatttaattcctttgcctacatcctcacactccttgacatggcgagacagctcctccttgttcaccgccttcccccggcactccacatcgggcgtcatgtggaagcacggctccatggacacggcgcgcacgcacggcggctcgggcaccttgccgtcttccgggatcatcagcatcgtcggccgcagccccgcgaggctgctgctcatgtagccaaacgtggacgcccccgtggtgagcagcacgtcggagaagctgagcaggtagatctccgccagcgccttctggttgtgcgtccgctgccccatgatctgccgctcctcgtggctcg

SEQ ID NO: 71784 - DNA, 266 bp, Triticum aestivum
  Clone ID: PAT_TA_71784
acatctaaggctcgatgatttgatctcagttacagttacataaattcaaaaatatataaattaattttccagatgaacatgggtgggcaactcaacaaggacttttgtctccacagggggggatataattactagcatgccgaaggctttcgagggggtttttgggtacattactattcaacgggccactataggatgatcatgggatacttatcaggctctaaaatgaacgggaaaaataaaagtccctgggatgttcattaaac

SEQ ID NO: 71785 - DNA, 127 bp, Triticum aestivum
  Clone ID: PAT_TA_71785
cagaactcgagagtttattattctcttcatagctcccgtatgagaagacctggaaggccacttgtataacgaacccaccactcaaaaaactcatttttctattttgcatatgcatatgtgtgtacac

SEQ ID NO: 71786 - DNA, 631 bp, Triticum aestivum
  Clone ID: PAT_TA_71786
ccatgaatcaaatcagcaacttgcagaaatcgatacccatgcacttgcccttgcctcaagatttaaaatccagaaagcactcggctgaagcctattaaaacacaaaacaaactcgtatgacagcgtcgtaagtgtttcatttcccctccaatcaagtaccccgagatgttctggcaaaaccatgacgagttggaacatatagtagtactaacacaaaacacactgcttgtctagattgggcactggctacatattgcacccaaacattttattcttctgagccgacagactccatatacatcattcagagaccatatggatatggtaatggctcatgcagaccccaggaaacgacccatccaagtggagaagcgggaccatgccaggtcaatggccccctgattctcatcagtcaaacccatgcccttcctcctcttgagggcctcaggcgatgcgttcatgaaggcatgggagcatccagagtatatgtggacttcatgtgccactccagaagccttgagcttctcctccaatgatttggccgcggtaacatccgcaaacccaacaaaactgtcaagctccccaaaatgagcctggattggagcctgagccttggaagcatcagcaagct

SEQ ID NO: 71787 - DNA, 184 bp, Triticum aestivum
  Clone ID: PAT_TA_71787
gctttttttttggggtttttttttttttttttttcaacctacatatacagttgaacttcaaacatcaaaatcacttaaagaacaatacaaaacaggacatggaaaggaattggtgatttggtctaaatacaaggaatcggcgatttgatctggatacaattttaggacaggggaaaaaaccaaa

SEQ ID NO: 71788 - DNA, 299 bp, Triticum aestivum
  Clone ID: PAT_TA_71788
gggattggagattttcaccttggatcgagggggaggggacatcgacagtgcctcctaagggagcgcagcgcctacgggggattgccgccgtcatgatcggccaggccaaagaggggctctcttggtcccaccaccctacaaagggagtagtaactactctctatgtattaaaatttaagacgttcattactccctatgtatcaaaatttaaaaccgtttttgatatggagggagtacaatatatgagttctaaaaatcaaaaaaacgatcggctattcttccctgttgagcgtccctat

SEQ ID NO: 71789 - DNA, 484 bp, Triticum aestivum
  Clone ID: PAT_TA_71789
acgcatgtatccaaaccattttatttctttcaacagccacagccacaaagtagatagtagatacattcaacagactaaattaacatagaaatgaagcaacaaagggcagcccgagtagaggaactacatggtactacaactacatgggactacaactaccatttctatttctaccagcagcagtagggactaccaaggagctaaacgaacagcgaccgagctaaactaacaacgatcatccatcatcaatcagtgacagtagcaatgagtggcagcggcgatgttcgagagagcccctccccctgctgctgcttggttgcctgttactgcttggtgtgttgcatcactagtcaccatgaaacgggggctaggaggagcgcagcgtcaccgtgggagcgcagcgtcaccacttgtactcgaaggcctcgcagcggagcgtgtggtcgaaggagcagcaggcgaggtcgggggcgaggttggaggg

SEQ ID NO: 71790 - DNA, 591 bp, Triticum aestivum
  Clone ID: PAT_TA_71790
tcgcgatctagaactagtccggccggcgccgacgcccaagaagggtaaggaggctaggacagcgggcaagacgtcggcgcggatcggcgcggtgagcactccccttggcccgaccaagatcctggggaagccgaagccggtgccgaggcaggggttcttgacgatgggggccagttctgcgcaggtccaacgttccaaggtccgaaaccccatcttgctccgggaggagaatcgcaatgtgcagaatgtttcgtcaacattgcagcaagatgactctcatgcacctgcaaaggaagaagacaactcagaagatacattgagcctgcagctggagttggccataaccgaaacaattcttgcggacgagatgaaagcccgagcagaagctgaggtcagggcaactgctttaggagatgagctgaaagcagcaaatttacgtacccttgaagcttgcaggcagaaggaagccacagaaaaggaactgaaagacacattatctgttttggatgttgttgaatcggagcagatttgtttgataaaggaagtagaggagctgaagaagaagaatttggagcaggttagtttgataaa

SEQ ID NO: 71791 - DNA, 300 bp, Triticum aestivum
  Clone ID: PAT_TA_71791
gggggcggaaagcccaaaattttttttttaaaaaaagacccgggagggcccttttttggcaaatttagccggactcaaccccaaccatccccttttatttatttttctatttaggggggaaccctaaaaaagtccaacccaaaattttaagtttcccaagttggacatttttgttactactaaccataccgggaattttcaaagggcctggggccacggttcttaacaaccctgaaaagggggcttatttgttttttttggcaggggacccaaaaacaaagttaattccttttttggggg

SEQ ID NO: 71792 - DNA, 660 bp, Triticum aestivum
  Clone ID: PAT_TA_71792
agttttgaaagcaaaacattgcatggtcactgacgctacacaggttgcgcgtctgctgacaaaccacacggtcaggttcaaagctgactaatcaagtcaatttgacagacagtttagaatcaggcaaagcaaaacatgcatggcagcaattgccaacagtgccaaaaccgggtccatcacccacgagcgcacagcttatcagactggctgctgtgtatgtgtcctgtcctacatattccccgacaaccgcctcatcctctcctcatgcctcatcctctcctcgcgtagctgctccatcaccttcatatcattcaaatccttcctggccatgtactgctcgtacagaggcgcagccgcgcgtttcctttcctcctcagcacgtttgaactcctcacgtcgaatccggtccttctcttgtatggccaacgcacgcctcgccctctgctcttgcctgcttagtgacttgttggggtcgttaaaccagtagtccttcaattcaaaccggctttctttgctgccgatgaatggtatcttcatctggaacaaagcctcattgcagatgtcgcccaagatttccggggcatgctttttcagctgccccgtaatctctgacccccgatccatcagattctgtccaatatagtagacacccccaacccc

SEQ ID NO: 71793 - DNA, 577 bp, Triticum aestivum
  Clone ID: PAT_TA_71793
ggtttttttttaagcttcacaataaccccaattatcatcctcatggagtttatcatcttcctcgacaacaatggggtaaatcttcaagggccaaactttaaaaatgacaatgaacctgaccattgatggaagggtaacaattttacacgatcaaactttagcctggggccacaacttaacttttttcccatgccaccttcctgggggtctccctcctttctcccagctttgtcacctccctccatccttcctgatcctcccttttttcacctccctgggttgcatgtccaccactcttggcacaatcagcaaaagacatgttttgaacttgattccaacaaaaaaaatctacgcaaatgcctaatgtgaacaactgtcattgttcaaacacacttatcagttactctttggacctttgcatttactcctcaatcaccctgcaacaagacatgacatcatcttcattcacctaatgttaatattaaggtcaaaaaacatgaaaaacttgagactggggaatcgatggaatccattgtcttgctctacaaactttattatttcagcatattttcttcta

SEQ ID NO: 71794 - DNA, 290 bp, Triticum aestivum
  Clone ID: PAT_TA_71794
gttttttcaaggctgatgaatgtttgtagatctgacaagcctgtataaaactacaaaattccacttgatgataaaattacagcgacgattacttaacagtccaaacacgtgcgcaggtttcaacatttaggtacacgcggtgcgctggcgtacattacctctccccatattgtctggcttatcggtgatcttcaccatttccaaatgacgttggatccgcacttgaacttctccttccccttgcacttaatcttcacttcgtcggagatgaacgggacttttttttgctt

SEQ ID NO: 71795 - DNA, 363 bp, Triticum aestivum
  Clone ID: PAT_TA_71795
acccaaaaaaccaaaataaaaccggacaaaataattttttttttccgaaaacaaaaacaattcattttccccacaacaaatttaaaagttaaaacacccattcccacaaatactttaaaaccaataaatgtccctccataaaaaaccaacttttggcccagcccccaaccggcccggcccattttatttaattaaagcccaagggggcaaaaaccctaaaaaaactgccggaccttagggcccaaaaaatcggatttggccccccccaaaattccaacgggggccctaaatttgggccaaacctaaagggccccgggaacgggccccaaaaaaaaattgctaaaaaggccccggttaaaggcc

SEQ ID NO: 71796 - DNA, 487 bp, Triticum aestivum
  Clone ID: PAT_TA_71796
gtttgatttgtcaacttccaatggggccagtaaacaagcaatccggcaccaaaacaacaacgacgacgacgacgacatcaccctgtagcctattgggtgagtagagtatgtgatttgtcaactttcaacagcccccctcacacctcgtgtggggggctaaaccaaaagagttgtcgtaacgcgagcaaaaagccaccacccgaagcacgcccttcacttgcatatcttggtgaagacaccggtcggttttaggaatagtacatcgtagcacaggatagcatcgaacagctgcaggtgtctgatcatccgcgctcccgatcccacgtacttgttgcactcctgcacctcaagatcgaaatccgaagtgggcgtccttggagggccgccgtggtaaatgaagtacacctctgctggatttcttttcaaattctcacgtaacccgtctgggctgattccctccagtacttgccctccaccagctgctatg

SEQ ID NO: 71797 - DNA, 308 bp, Triticum aestivum
  Clone ID: PAT_TA_71797
ggggtttttttttttttttttttttgcacaaaaattttaaaatccctttataaccgcaacaaaaaaaaagctaaaaaacgaacagccacaaaaaataaatacaaaatgtaaacaaataacagtttaccgtaacaaaactagcctagcgaaacaccggggggacaaaaaaaaatgggattattcgaaaaaaagggggatcatttggcactttggccccacaaaacaataggcagtattttcagggtggttgcttgcggggctcctaaatttgtgctggcaaaatgggtgcggataaacttggccgggga

SEQ ID NO: 71798 - DNA, 446 bp, Triticum aestivum
  Clone ID: PAT_TA_71798
gacaaacaacaagcgttcttcaatcacaacggtgtgcaaagcagtgctcgaaaggcgtcaaatttttcaaaaaaaaaaagagtaaatcagcaatattaacttccaatgaaatcaaacagcgattcagtcaaactgcaaattgggcactgtgcctagcgaatctccccattcgctatcgtcttgaccttgcatactccagccgaagttgtgaatggaacatttttgtagcacgccaccagctcaccgttgctgtgcaaatcagcggacaacttctcccaggttttgcttttggcgttaaaagaagcctcgggctcaccagaaaacccggcaaaggtcaccctttccccaacagcagcggattctggaggctcaaccaactcaacctttgtatggtccttattcgatgcggccaaaaccatagcatgtgattttataccgcgcattgc

SEQ ID NO: 71799 - DNA, 570 bp, Triticum aestivum
  Clone ID: PAT_TA_71799
gcaccaaacatttttttattccattaaccatttgtcacatacatacacttcagtctgttctaaacacaaccaccgagacaccatacatcaggttcacaaaaggacaggtaaaagatgcaaggatgagacatcagttgtacaaaatgaaatctaaaacatctagttgacgtaaattgttggcttcatggttccgtgtgagtgtcatccttttgtttccttccttcacatgccagctcaggaaagatgtttttccatctagctacgctcaagataaacgcgcctggtccaatgtggtagctatatattgcagtgatgagattccttgccccaagattgattgatgccctcacccagatataagaaatcttgctccactacctgcaacggaaaaagggtttcttcagatcctcacaaaccgaggtatacattcatcaagatctagaattcttttagtttctcctcgatataattattttaatatttacatcaccaataaaacaatactatatgaaaagtttttattttgtataaaacaaatatgaattcaaacatctgctaatagtatatgtc

SEQ ID NO: 71800 - DNA, 399 bp, Triticum aestivum
  Clone ID: PAT_TA_71800
ggggggcaaaccaatcggaaacaaaaaaagggggggggggaccatctctcgttttcataatccctcccaagggaaacaagggaaccccagggttcattcccgggttcacaacttttttacaggaaattggtgcccgttgacccccaaacccaccaaaaaacctacaggaaaccaagttgtaagtccctttttttgaaaacccaataagggttttattggcaggcaggttcaaggatcacacccggtttccccccccaagggaattttgggcccctataataaaaaaaaaccccccccatttacacgggcttttgtttccactttggggccccccaaggcgctgacccaaacataaggaacgggccgaaacttttcccaggggggggttccaactttttt

SEQ ID NO: 71801 - DNA, 420 bp, Triticum aestivum
  Clone ID: PAT_TA_71801
ggaaaaaaaatccccccaatagttcggatcaatttttatttttttgcccccatgcatgcagtttttgccccaaacatgcttgggcattaaaaaaaaagacattttgatctaactactggggttcgcgcaattttccggagcaaagtaaagtcaatttttggcgacgtcaagggggaagcgcgggcccacctggtgcccggggccaaaaaccgttttttttttgtccggaaagattaggaagcaaacttgtggggctccggggggcatttttgtcacaaacaacaaatcccatttgatcgtaagctcggcgccttttttcagggggaccgggatgcttgggaacttttggtaaatcccctgcttcgacccgatgaaacaaaggggggagcccggtactcggtttccggcacggttcacccc

SEQ ID NO: 71802 - DNA, 179 bp, Triticum aestivum
  Clone ID: PAT_TA_71802
agactcgatcaataagcaatttaaatttgccccattggcagtgttaacatgaaaataacagaaggtgagagataaaagctaggtggtaggactgtaaagagtggctgcaagtcagcgtctctagtattcagtcacaaagacattcaactccaccagagcaattctcagccatgcttcct

SEQ ID NO: 71803 - DNA, 362 bp, Triticum aestivum
  Clone ID: PAT_TA_71803
ggggctggaaacaaaagtagaagaggagtccttcacatatgtacaataagcgatgataaaccgtttttgaccatagagacaacaacaaaatctaaagatcatagactacatcatagactacttttcaccatagaggcagcaaggaaggactaaagtctatacatttcttgctcaaattactccaacccaaatcggaaaaggggcatggttaaatcgaaaatgtgttagtcgtaccgtatgtacatatctaaattacgccatggaaaaactactgcttcgctttcttaggtatgccagcccccttgctggtattggtagttctcttgggcttaaaggggtcaggaagggtgttctttggatcc

SEQ ID NO: 71804 - DNA, 329 bp, Triticum aestivum
  Clone ID: PAT_TA_71804
aaaactatatatatatgacattacaaagagaaataggcctatactgggcaatattactatgatgacgtgaaagtgtgaaatgcagagtaggcctatttatgtttgtaatgtgctcccacttccgggtaatcataggataacattgttgctgaacttacatccagcctgaactacatattcaagaagctccataagctttcaccttagaggcggggcacattgtcttttggccggaaactaaagctagcatagattttctgattgtctgctcacaactatcctcagtgaattggattgaagtggctgattctacggtacactttggacag

SEQ ID NO: 71805 - DNA, 434 bp, Triticum aestivum
  Clone ID: PAT_TA_71805
ggggggaacccctatcccgggccctttttatttcgggatttggaaaaccccaaaaaaaaaaagggccccggggggcccccggggggttttccaaaacagggacccccttaaggggcccccgggaatttgggcagggaaaaaaaaaaaattttttcgaaaaaaaaacggaagccccggggaaaaacccccaactaaccggggggcgggggttttggggggaaaaccttaaaacccccccccaaaaatggacaaaagggcccaagggttaaaaggggtttcccaaattccaggcagggggacttaaaacttaaccaaaactggggggagcaaaaatctgggacaccgggcgcaaaaataaaaaaagggggccccacaaaggggaaaaaaggcggggccaaaatttttgggaaaaaaaacaaagccctcaaaaaaac

SEQ ID NO: 71806 - DNA, 407 bp, Triticum aestivum
  Clone ID: PAT_TA_71806
ggggttgacattatttttcttcttccatttttttatccaaggccccacatcacaacagcatgcttgaaatgaaaagttctgaagcacatatttatacacccaaaaggcaggggaaccattgatgtatgcatattgcaaatccaatacaaggggtcatgtatgcccacgtcacggacacatttctagggaggagagcaacccccacaaaccgccgcaggcaaggccatcagggatttacggaggcagaaaacggggcttacaccggcactcccaacactcggggcggtaggagcaacacacgggaactccgggcacaaccctgccctgcaccttcgccgacgcggccataatgaaaaacaggcacacctgggctaggaggaaaaccaccaaggcccggaggtgaccca

SEQ ID NO: 71807 - DNA, 483 bp, Triticum aestivum
  Clone ID: PAT_TA_71807
cccttcgggacccggggtacaaaggctgaaaacccataggccccggggtcggctttttctgatcccacgggtccagttcagtcgggcgacatcaaacccagtcctttttatgggggaccacaacaaccccccaatgccccgcaacaaaaccgggttggggggcaacaaaaaagcggccgaacaaaaatggcatgagtccaagggggaaccgttcaaacttgacccctacctttccggcccaaacttgacccccttttcaagggaaaacagcagctcccccttgaggctttccaccccctccttttccaaggccgacagttcccccacccccataatttcctccactccgtttttccccagcctaacctgggaggcaaaaaagggcacctctgttccgggggatgggacaaaaaacccctctacaatgtcaggaaccccgtggacccccttaaagcttgcttttccaaaaacagccccagcttt

SEQ ID NO: 71808 - DNA, 316 bp, Triticum aestivum
  Clone ID: PAT_TA_71808
aaaagggcaagtccttgggtaaaaaccaacatccaacgaaagagcccccatcatgttcaggggaccccgcataaggcccaaccccaggaaaacccccccagaaacaaaacttccgatgaaaaagcccccgtgttcccccaaaacggctttaattcccaccccaaaaaaactgaaagtggggggtaaatttttccaacaaagtacaaaggacggtaaccattttaaacaaaggcagcaggacccttgggggcaaaaaacaatttaaaccccctttgggccatgctctcgctccgggggcccctttggtccttaaacc

SEQ ID NO: 71809 - DNA, 381 bp, Triticum aestivum
  Clone ID: PAT_TA_71809
caaaagggggggccccattttttctttaaaagggggggcccaaggaaggacattccgggtcaaacccccccaacgggggcttacaaaactacggaacacaaaggggggttttattttattaagggcccccccccccaaccccttgcggggggggggaaaaatccccggggggggggaaaacgggggggaagggggctggcttgcttgccctcctaatcctggggctcccctttgccggccggcctctggggccccggttaatttgcacttgcaaaaggaccacccgcccgcggggccccatttgcggggggggcagtccaacccgccggtctcccgggccgtttaaaacccgcgggacctcccttggggggaggggggggg

SEQ ID NO: 71810 - DNA, 456 bp, Triticum aestivum
  Clone ID: PAT_TA_71810
gggggggggacacctgctatttttttttccttcatttaacataccccctgggctacataggcggccaggaaaaacttccctggctttcatacgggccccatgggagggaggggtccaaatttttggttcccctgcacaccacttttaatggggtaaaaaaaacagctttcccgggaaacggggaaaaaaaggggaaaccccccaaatccctaaaacaaaatttggcaccctcaccttctgggggggacttttggtcgcaagggcctaaacctccctggggctacggggctggactgaaagggggttgggccatcctcggggaattgggactgggacgggccctgccccccaatccggactacaaggggccacatggggtccccaggatctggatttttgcaactccctggcactttggggggggtgaatgaaccctgttgccatccaacggggccc

SEQ ID NO: 71811 - DNA, 388 bp, Triticum aestivum
  Clone ID: PAT_TA_71811
caaaaaaatgccccaccagggcccaattaaatcatcatcaccaggcgtgccaacaactttgcccaccccgggaaagaaacccataaaaggacacccaaggaaacttttttaaggccccaaaagtttaacctttttttcattctttcccaccccccccggttgggaaacccccccgggggggggaccccattttttaaagaaatccacatcccttaccccaaaccttggccaaaaaaaaaactgggggtaattaaaccaaaggggcaaaaaacggttaaaccaaattggaaggcaacggcccacggcctaattttttggaacctgctgaataaagggcacttgaagggcttaatggaacccccttgggccggggttacccccccccttt

SEQ ID NO: 71812 - DNA, 550 bp, Triticum aestivum
  Clone ID: PAT_TA_71812
cactaacccttttttttcaaaaaaaacccccaaggggctttttaaatctgataatcattatccagtaaaccacccagtacaccggaaagacatttggaggcaaaacggccattaaaaaaattaaaattacagcgaaaaccgtactattttttttcctccaaatgattgccccccaccaaagtgaaaatcacactgaacatcaaaaacctgacaacaaatgaattaccatttttggcctatctgaaccacatgttctgctcctgttgaaatcaataaaaaacttctgttacttaaaatgaaaacctaacacagtttgcttgtgtacacttctgatgaaacaaacagcagggaattaccttgtatccacaactaattgaggttcaatgccgggggctgggtcattcattgtctacccctaaatcccaaaccaccgtcttgctgctcctggggccagggctgccatctttaaaatctatgatgattgctgggaaatcttcttccttgatgatgatcatacggatttctcgatcttgccccattcctcccattc

SEQ ID NO: 71813 - DNA, 462 bp, Triticum aestivum
  Clone ID: PAT_TA_71813
acggcgagcgcgagcgcggggactgcgccggctcggaccatcgacgctcgggcgggccgcccgcgtacctgcacggccgcggccatgcacaggatggctgccggtgacgcggcctccttgaggatcctcaccagatcggggaacagctccgacctgtcggcgattgcggtcttcacgtcggcgtccggcacgggcgacgtcaggatcgcctcgagaaccacgacgccggtgggacctgcggagagcagcgttgccacgacgcgtcccagatcggcggccacgagcgcggtgatgagggctttcctggcatcttcgctgactccgcccgcggacaagacggcagccatggcctccacggccatcttgacccgtccacgcttctccgtgccgtcccgggtcaggtagggcaccatctccggcgccacagtggccaggatcctcaccgcgtcgacgcgcgcgtcg

SEQ ID NO: 71814 - DNA, 123 bp, Triticum aestivum
  Clone ID: PAT_TA_71814
aaaggaaaaggcacctttacctttaggggtccatacaaataaaacccaaggcaagtgttacccggaaatccaagaaagtgtttagcaataccaaacactaaattttgaatttcggacccgggg

SEQ ID NO: 71815 - DNA, 393 bp, Triticum aestivum
  Clone ID: PAT_TA_71815
ggagacaagacctgtgtttgtcttttattcccaagtttgaactagtatagttcaggttcttacatgatagtgcatgtcactttattttttcaccgctacaacgaccaaaccatggactaagaaaacggggtatcatatatctactactagagttcttctcttctcagttagtaccgaagatgccaaatggagcaatggtgcaatatggagggatatacacattgcacattgcaggtagcgtctgtagcgctaggttccttattgcctcaaactggggcagttgttgaggctggaaagagccctgggcctgtgggttttgctgagatggttggaagaagccctggcctgatggatattgttgctgaggctgttggaaggagacttggctcaacg

SEQ ID NO: 71816 - DNA, 288 bp, Triticum aestivum
  Clone ID: PAT_TA_71816
gggcaaacatattcaaaaaacccatgcctattttcaccattggcattgataatttaacaaagcacacattgacctattgcaacaacctactaccgagcatgcccattttattacaaaggtgaaaggacgatcacctaaaaaaagaacaaaacaggggacacggggaccgccccaagcaaaccaattccaccggggacggtgtgacgggaaaaggagcttgccggaccaggcactggggcgggcgcgtgactatgtggcaaccgcgcaagggatggctcatagggcccg

SEQ ID NO: 71817 - DNA, 499 bp, Triticum aestivum
  Clone ID: PAT_TA_71817
ggcatattactccctctgacccgatttatttgtcattggggcaattctccgaccagatgaaaaggaaaaaaagtacgaaactacccccaatttgaaaaacacttgtcgctcggatcgtcctcttcctccgtcgctattcccgtccgccaggctccacccctccgctgcagctccggcgtccgcccccgccggccgccttcctccactccgatcgagaacccaaggtccgtccttgccatacgcatctccctcgtcgtccgccacaggctccagccgcccgcggctcctgcctgtcgtgccgcccgtgctcctccccgcactgaccagcagtagcagcgcaacccgacgccctcctcgattcatgcaccggagctcctgatccggccaattgacctcgtcggcgagcagccaggtcgaccagtcactccaattgatctcttcctcgccggcagtcctgcagtctgtgttgatcgcctgagtctttgctggagtagatact

SEQ ID NO: 71818 - DNA, 405 bp, Triticum aestivum
  Clone ID: PAT_TA_71818
aaccggacaaaccactttttttattctggaaacaaaaacaacttattttacccaacagcagttcacgagttaaaaccagttagtcgcacacatactttacagcccatgaatgtccatccataaaaaaccaatttttctgccgggccccgaccggcccggcgcattttatttaacttaggggcagggggccaccctaggaggactgccggacctcagggcccacaaagtcggggtcggccgtcaccaaaatgtcaacggggggcctaattttggcgcaaaccttgatggccccggggacggggtccaacataaaattgctgatgaggccctggttgatgggctcgtccttgtccaccgtaacaaacccctggtgggtaaggatgtaataaaaacggggcgcccatt

SEQ ID NO: 71819 - DNA, 522 bp, Triticum aestivum
  Clone ID: PAT_TA_71819
gcaaggaataaaaacatgtagactgggaaactggcaacacaggtcaagcaaagtatcagctcatctgtcttgctgcatactagtttacatcaagcctcaaatttgtcagaccgtcacaaagggcacgactagcaacacacatagttttgcatcagaaaacagtcacaccacttctccacagaaactgaagctcagccgaccacctccacttcggagaaggggtcatggaacgaaaaatcggcccgtctttcaagctccacatcttaccacctgcagggccggtgctcccaaggacaaccatgttggactcacttgccatgatcctcgagctgcgtttcactttggcatacgcctcctgcgtcgagaacggcgtgaagcttgggttggccatggaaacggacgcggtctccagcgcccgcgcgctccggaagaagaactcgaggaagccgacctcgccggggtcccccgtgaactcacggaaactcatcacggtgatgcgcgagacgaggttttcttcggggt

SEQ ID NO: 71820 - DNA, 373 bp, Triticum aestivum
  Clone ID: PAT_TA_71820
gggactggggggcatatttatgcttcatgtgccactgcctaatatcacgagtccaggcggatatgaatcacacaggtttaccgataagccacatacttgcaccctcaaacacatctaccatcgtagcagtagttagcaaatgatttacaattttacagacagacatcgatacaaaaggtgtcattgtcgtggaccaggattccttaacatatatatctaggacatgatgcgagcggattagcaaaataagtgtaccccaccctgggtgtatcgccatagcattaactacttcccaattgatttggcgtgaaccgactccatagacaccctgttagggccttgtgggcagcaaccaggtaccggatggttgatc

SEQ ID NO: 71821 - DNA, 272 bp, Triticum aestivum
  Clone ID: PAT_TA_71821
tcgcatgcccgccagagccattcccacagggaaagcaagcatcttaagccctctgcccgcggatcctcgtagtcagatgattgttcttgggaatgatggccacccgcttggcatggatggcgcacaggttggtgtcctcgaagagacccaccaggtaggcctctgcagcctcctgaagggccagcaccgcatggctctggaagcggaggtcagtcttgaagtgctgggctaactccctaacaagcctctggaatggaagcttcctgatgagc

SEQ ID NO: 71822 - DNA, 140 bp, Triticum aestivum
  Clone ID: PAT_TA_71822
agagcaaagagcatagccatatgcctgacatactttgtacaccatgacacatgctactgaatccttcttgaaaagcttctatctaatctaacaactggacttccttaccacatgctgcaacaagaaacttagattttgca

SEQ ID NO: 71823 - DNA, 611 bp, Triticum aestivum
  Clone ID: PAT_TA_71823
aattaaacaaaataggttattccacagacgataaaaacatgcttgatgtacacactgataggtattttacaacatggaaatgtagctaggtatacaccggcgggtggtgcatacacatggcagtacacatacagacaatactagcacaagagaggcatgccaagcaagacaatgcatacaaactctcttgtgatcatgctgaaaaatgaaatgcggtgcaaaccaatacagatgttggtatatatcaaccgatcttctggtggatgattattttatgcatgcacacatgtatatgttctcgcgagtcatatgatcgtcaatacttccacatgccatccatgcccatgttcattgacaagatctcgccggaggttgctatgccaccgttaccctggttgttgttgctcaaccaggtcacaacgtcctcgtgagacactatggacgatgaaccatacccaggatcgactccaaccatgaagccctggtctacactcatctccatcatctgttgttgctggtggtggttgtaggatgacatcgatgactgtggtgaggccatcatttgttggtagtggttaccaaagtcatggttgttcatcattggaagtacc

SEQ ID NO: 71824 - DNA, 271 bp, Triticum aestivum
  Clone ID: PAT_TA_71824
aaacaaaaatcgaacatcctaaaccaacatcattccatctttgccttataaaaaaaacattcgctggtgctaattatgtgagccgaaaaaaggcaactcaagtgaccacaaattgctggggggtgttattcaaacaactcccaatatttctctataaaacattggtctcttacatttcaagtggttgaaaacaaccaaaggagggaggacaacatgcctggtttaaaacggcccctgaaaggaattgaaaccccacaaaatgaaccttacc

SEQ ID NO: 71825 - DNA, 445 bp, Triticum aestivum
  Clone ID: PAT_TA_71825
aaggaggacaaaatttgaactagatgaaacaacattaaaaatacatcacgctgaatagaccgaacgcctgaagaacaaagctaacatactacacatctcaagaaagaaaacacaaactcgtcagcaactcattcaccatcatctaaagaagcaaagagaacgccacgtcacatggccaggtcagctgaaagtccaggaggcttcagaatgcatcttcgtcgccgtcgtcgcagggcaccgtgcactggatcacgacgcgagctcccgacgacagcccagtgcagtgacaaaaagttggagcacttaactttcctcgatcttgacgagcttctccttgttctccttcctgaaggactctaccctcgacgaagcgtcggtgaaccgcttgctaccgccgtctatcgagtccgtccccgccgaggagctcctcctgcagtccgacacc

SEQ ID NO: 71826 - DNA, 273 bp, Triticum aestivum
  Clone ID: PAT_TA_71826
gggggaacattccgggaaaaaaaacaaaagccggatgtctggcccaattacataaaaaaattcccgctaaagggttctcgggtaatttccccttttggggggaacaaggaatgggatttttttttttcctgggccggaaaccacctcatcatcataaatccttaaaaactggggtcaggcccccaaaaattaaaccccatccttgggaaaaacccggccatggggctcataaaaatccaaacccaaagttgcccatggggttggcaaggggcc

SEQ ID NO: 71827 - DNA, 553 bp, Triticum aestivum
  Clone ID: PAT_TA_71827
aatgccacagtctgtactccttcattgggttgcatatttcttatcttctttttttgcgccggcggcacatgatacatttatttcggtctaagaattgatcgaacaaaaataacacaagagcattcttcctcaattattccctaattagcacatagcacctgtattatccctatttcttacaagcctggtctaatccgttcattggcgcggaatcacactctgatcgtccctgtctgggtccaaccaatctaaactaagcaaaatgtatgttgcaagatcagtaatcttgaactcggatatgtagcccattgggagcttccacccgggggaatttcaatatggtgttcttgccttcctcctcccatctgtatcgagtcacaaaatagtgtaggaaagttgcaatctcagccgtgcccagctccttcccagggcacatccggctgtctcccccaaacaacatgaagtgtgggtgtgattccatgttcttctccagccatctccatgggttgaaggtcatcgggtcagagtacatgaacgaatcgtagtttatttc

SEQ ID NO: 71828 - DNA, 196 bp, Triticum aestivum
  Clone ID: PAT_TA_71828
attttggtttcttaatattaacccaaattaacacacagaagatactataaaccaataatacttcaaccatctaatcttaaaacaagccttatactctttttatgaatcacaacaacccaagacacaagacatatcaatctacatgacatggcattgatatatcaatctaaccgaacgcccaacactatttcaaaat

SEQ ID NO: 71829 - DNA, 464 bp, Triticum aestivum
  Clone ID: PAT_TA_71829
caaacaaccacggaagggacatgccaaagctgacccccaaaaggaggagcgggggccatgctgacaaactccaccaaatatactttaaccctaggacggggacataaataataaaagtctttctaacagggaagaacgggcctaacaataatacttgcccttaaacatacggccggacggacggacggattatgtccaccgaaaaagctagcccgggggcccatatgtccataaaactacttacacaaaaccaaacaatcgggttccccctctcgctcggccagggcaggaggagttatccctaggcaggcctaaaatcgaatcgcctccagggccaaaataatggctaccatttgggctgggttgggctcggttgggtgggcgcccaccgttaataccctaaggggggggcccgccggcgcccctttaaagggggtgctgaaggcgaatgcgcccaatttttt

SEQ ID NO: 71830 - DNA, 270 bp, Triticum aestivum
  Clone ID: PAT_TA_71830
ggaccacaaaacattgcaaataaattgaacttccaaaaaacaaaaaaacaccaaaaattttgcaaatgccgtgagtaaagcttctaccacaaaacattgcaaataacttgaactttcaaaaaacaaaaaaacagcaaaaatattgcaaatgccatgggtaaagctttaggtacatggatccctatctgctaggacaacccctatgtatgttctgtaaaatcatataaagaaattaatcacaacaaaatggtttctccaaggcttttacca

SEQ ID NO: 71831 - DNA, 253 bp, Triticum aestivum
  Clone ID: PAT_TA_71831
ggaaacaacttctccccaaaaataccctcattggggcaaacccaacaaaccacctaaagctaaaagtttattcggagtaacaatagcccggccagctgcttcacagtaaccaaacgacaaacttagtcaaaacaaagtccacaaacggaacaacgacagccaatcactcccacaacaccgccccctcctccagggaatcctcctccgccccccatgcaaggaggttggcaaacttcccttccttgaccaaagg

SEQ ID NO: 71832 - DNA, 256 bp, Triticum aestivum
  Clone ID: PAT_TA_71832
aaaagggcaagcccttgagtaaaacccaacctacaaccatagagcccccatcatgtccatggaaccccgcctcaggtccaaccccagaaaaactaccccagtaacaaaacttcccatgaaaaagcacccatgttcccccaaaactgcataaattaccaccccaaaaaaactgaaagtcccgggtaaatttttccaacaaagtccaaaggactggacccattttaaccaaaggcaccaggacccttgggggcaaaaa

SEQ ID NO: 71833 - DNA, 384 bp, Triticum aestivum
  Clone ID: PAT_TA_71833
gctatttccgtaacatcttattattggatcggaagtttttttacacacacacaaaaagttgactagagatagcaaagccgatttatttatcgatttcaaaatttgcttctgcctgacgtttagcgagatagatttcaaaaatattttcagctaggacttgagcgagacttcgcgaaaccagagaaacacatcattcttttaataagtttaaacattggcacgtcgtcatttttttttattaatggcgcagcatacactgaggacagccacccaattattgtgacacactgactgcaggctgctgctgcagcaaggtacttaatactccagtacttagcagtacggacgcggcgatttcagtggagcgcacgcccgggaaacgac

SEQ ID NO: 71834 - DNA, 564 bp, Triticum aestivum
  Clone ID: PAT_TA_71834
ggaaacaaaaggaacattgcatacttaagagatactgtacttgaccgcgaactgaatgatcacgtataagccactgatgcacaatattgggcaaatgatgtatgagcgagtacttaagaatattcactcacatagcccgatcttgtgattttacatttttacccataatcatccacaactacaaaaaaaagattgtgatttactgtcatgcattttacattttcacccgttcacaagtatgtgttgtagcacttccttcggtgccgcaattgctttgccagagagtttaccatcgagcatttggtgcattcctgcgtcaggatctcgccatcagaaattacgggtatcagcacagcaagcaaagggcttcaccttcactctgcatctttggacattcatttaggtgatctactaacggtagttagtagttcacgctgtcacggtggagtggtagatttcactagtcatttaacagttgggccagcatagcatctgcactctcagggccatcattgtttacactgggaactatatgctctggtgatatgaaccggacaaattctc

SEQ ID NO: 71835 - DNA, 420 bp, Triticum aestivum
  Clone ID: PAT_TA_71835
gaccgtgaaatattgtcttgatcttgcacagggactagaattacacaacagaccaatatttcttatatacaaagggatatcaaggaaatattgcacatagactagaattacacaactgaataatatttcttacaagaaaaaagcataaacgaataacccaataggttggcttctgggtcactctcacacgtgatactgatcaacaattattctggcgcccttgtcatcttccctagctgcacttgtcatttctgctactaacgacttggtgcactcacctgctttgtcatgcactctgagatggacctctttgagctctgtgaggttttctaagccatacagtccctccaacacgctgaaccgcagctcaagcctttcgagctgtggcactgcaccttctataaagcttagcagtggcac

SEQ ID NO: 71836 - DNA, 385 bp, Triticum aestivum
  Clone ID: PAT_TA_71836
gggcagggcatgaaccccaaacaaatcgaggcaatcatttccatcccggattttttctatggaccggggaaacccacaaaaaggggggcttttacatgtacaaaaaacccccaccacacccgacctttgtaacaaaaaaaactggacatgctatggacttgcaatccacctgcagtcgctctgaaaaactaaccaactccaaaatgttcaccccatcgtcaaaaaactgaaaacagcgggtttttcaacttgggccctacaaatgcccccccccgctggcaggatttacaggacccgtccagggaggaggaaaaaaccatggtaaacggaccagggcgggttgaaacaagggccccccccggagggcataggggacccttgaaaa

SEQ ID NO: 71837 - DNA, 244 bp, Triticum aestivum
  Clone ID: PAT_TA_71837
aaaaatcaaaaaatcctttcaagtttcgttggatacaaaaggaaaaaaaaatcccttctaactgattcaggacagcacacaaccaacacaaagcttcaccggctcgtaaattctaccgacttaaaactaagggttgcaccaaagggcaccaaaactgttccattataccctcaggagtccacaaaaaggcaaggaccgaaacttccgaaatgtgaaggtcctaaaaccaagcctatgtctccct

SEQ ID NO: 71838 - DNA, 194 bp, Triticum aestivum
  Clone ID: PAT_TA_71838
aatcagggggattccttaatacaatgatattaacaccactaccaggcataaagaggtccgaggttccaggtttaaaaaggcacaatgataaccctacttacaacggataaagcgcctacgatacaccaccacataaacatatcaaaataagtcccaagcgcaacaaatcaaagttgtaaacaatatacatttct

SEQ ID NO: 71839 - DNA, 118 bp, Triticum aestivum
  Clone ID: PAT_TA_71839
gaaaaattaaaacgtccgagtggtttccacaaactagaaccctgttacggaaaggcctaatccccgccaaaattttgtaaccccccgaaagatattcaaatccacgcttttgaaacgc

SEQ ID NO: 71840 - DNA, 570 bp, Triticum aestivum
  Clone ID: PAT_TA_71840
ggtacaatctgaactatatagtctctcaagggggaacaaatcgagtccaaatttgcccaatccactgttaactcagttcttgaggaaataggtaaaaggagatgggctttaccaacagacagtaagtaatgcatgaatgaatccacgacattcatacaggatcctgaaacggcctgcgctattgcaaagtactagatatgtataatatgaacatgcaccgatagcgggatgtattttccctaatgtacacgctatatatttgcttgtaaccaaagcaaaaagagcagcagttctcggacatcctcacaagttgtatattgcttaacgcactgcaaacgcgcgagaggtacctgtaaaatgctcgatcgaccctatcagcggcttggaggcaccgaaatgccgtagcctgtaaacaccagggacggcatcttcaggaatggtccactccagcgtcgcaaagctctccggactgagtttcgaaggcctcgaccacttgaatcgcaaagaccaatcgtcatcgtcgtagacaggaatccagttgtcaccattcaacctctcaacgagcgcgaa

SEQ ID NO: 71841 - DNA, 407 bp, Triticum aestivum
  Clone ID: PAT_TA_71841
aggcccgggtaaaaagttgggagttttttgaaagcaaaaaaaaccctggggcgaaaaaaaacgggttccataatcccctattaggggcttataaacaaatcccctaaacaaaaagggaaccgatacctaagctgaaagtccccggcaaaaaatgttgcctcaaaaaagtcaaaaacttggggggcattacaacctttttggccaaaaaaacccctacccttttccgggaaaaccgggttggattttgaaaaccctgaggggcccgccggggtatccggggtaaaggggggttccgtccgccctccaaataaagcttgggcaaaaaaaaatttggtttttggaaacctgcacttttgggttgagggcctgcacaaaatgcttggactcgagggcccaaattttgaaaa

SEQ ID NO: 71842 - DNA, 425 bp, Triticum aestivum
  Clone ID: PAT_TA_71842
aacccacccgtccggccgaaagaagcgcagccgggcaccaaaccctactccgcccccgcatgcgcccgccggagccctcctccgcctcgccgatgcgccggcggcggcggcggcgggccccgacccagccgccgtgcgggccgagtgcgaccgggccctcgcctgcctccagcggggcaaccagcccaaggcgctgcgcctcatgaaggacgccctcgcccgccacggcgaggggtcgccgctcctcctcctttacgaggccgccagcgacaaccgcgcctacgaggaggtcatcgccgagtgcgagcgcgggctcaggatcgacgaaccctccgacccagagccccactccctcaggctgcccgcccccgaccccgaccagctccgggccgagctgcgcaacctcgtccagaaggccaatctcg

SEQ ID NO: 71843 - DNA, 312 bp, Triticum aestivum
  Clone ID: PAT_TA_71843
ccacgcgtccgccctccccccctgcgcggctgctagcaaactcgtctcgccatggccgtgctgtcacaccacgaggacggcgcggtggttgcacagacgctgcttctgctgctgacggtgtcgccgtcgttgctgggggcggtggtgccggccctcgccgccgacccacccttctcctgcgggccgtcgtccaccgccgcgacgcaggggtacgccttctgcgacgcgacgctcccggtggcgcagcgggcggcggacctggtggcgcggctgacgccggcggagaaggtggcgcagctgggcgacgaggcc

SEQ ID NO: 71844 - DNA, 617 bp, Triticum aestivum
  Clone ID: PAT_TA_71844
ccacgcgtccgatttagtttgcaacatttgtgaagccaggctatgtctacaggttttgttgttctttctagacatgcccagggtcccactgggctttgttggtggattcctttctaaaatcctgtttgttgaagtgatatataatgtaatgttaggttaattttttttagctttcacccacttgatgatgagaaggcaagcaatacgagcagaaaagcatgtgtagtatcgaatttgcagttggatatattacttcaccgttttgttattcaagaataatttatttgtccccgagtgcattttataatgctatgttgccttgctatttgtcatacattgtttgacgaaaagccagtatttactcatcttccaaggtccgggttagtatgctaatattgtggaacaagggctctctgaattgctgtgatatgctaggttgtaaagtttccattagtgtcaagcttattttttcttttgattacaacatagtacataccacaatttgttgttttctgactcattgatttattatgcagatctagacagctttggtatggagtgctatgtctattatttaattgatcgcaagtgatgtttaaatattttcacaaacatga

SEQ ID NO: 71845 - DNA, 383 bp, Triticum aestivum
  Clone ID: PAT_TA_71845
ccacgcgtccggtggtcgtggtggtgggagggagcgtggcgggcctggcctgcgcgcacgcggtggcgggggcggggtggaaggcggtggtgttggataaggcagtggttctgaagaaactactggaaattttcatctgactgaggatgattggcactttctaccagaccctgaagattcagaacaacactgaatattgaaagctacaatgattactaattacttataacataatgctattttcatgtttagacacttatgtacaattgactgttgttaattattttcattctgttaattttcttttacgtttcagttattttaacatgttgtataagcacactgtgaatatatatccatacattgaaattggatattgtttt

SEQ ID NO: 71846 - DNA, 395 bp, Triticum aestivum
  Clone ID: PAT_TA_71846
ccacgcgtccgcaaagcgcgagaaatgacagtgatagccgctctgttcgtgctcagctgcctcctcaagacaacgacgagccccgccacctcggcctactcgggcgcatggatgcccgcctcctccgtactctatgagctccgccacctcggggtccgtgcgctgatccgttacgatgccgaggccaccgggcgggcgtccgccgacttcggcaacgtgtcggacgcccagccaccgccggcggccgtgctctacccgtcgtgccccgaggacatcgcctcgctgctgcgcgcctcgtgcacgcacacctccccgttccccgtgtctgcccggggctgcggccactcgacccgaggccaggcgtccgcaccccgcggcgtcgtcgtggacatgct

SEQ ID NO: 71847 - DNA, 548 bp, Triticum aestivum
  Clone ID: PAT_TA_71847
aacccacccgtccgcgccattgaccgcacctggggcctcctcctcctcccaatggccccccgccgctcccgttaagccgtcttaccttaccactgcaagagaagcagatcactcggagctcttcttattcttcctcctgctgctgctgtggcgcggcgatgaggtgagtgagcagagcttgcccgggagggggatcgatgcccacgcagcagctcacgacattccagctgctcccacccgctcacgcgcacggcgaccggcgacagtaccagtaccagcaccaccaccaggaccagcagcagcagctcgcctgcggcggcggaggaggaggcctgtgggaccccgcgtcggtgctcgaccgccgggccagccccgccgcgcatcccacgctgtcttccccctcgcccctgcccgccggcgtggcggccctcgccaagaacgtctccgcggccccgccggcgcaggcatggccgcccccgccgggccccggggcgaacgacgacgacgccaatgacgactgggtccaccacctgccgcccctcgacatg

SEQ ID NO: 71848 - DNA, 404 bp, Triticum aestivum
  Clone ID: PAT_TA_71848
ccacgcgtccgatatttgagaaaatcatcagtgttatttagcattagttaaatcagtttgttgagctgagctttttatcttgatggtagtgagaattctgatggtagaagaattcttctattgagatggttcttctatttttaatgtactcctactattttaatgcaacattgctttttagtgctaaattactagattacatcctttcttttcccttttcccttgaaaagcatggtagaagttgtgtttaaacactcatatatagaagactaagaatttctttttgttcttcttgctattggctggtagcttttagtagcaatttggataattatgtgcataatattctgtatgattttggggcaagaaatgtcggggattctgtcgtgggtggatcatagcct

SEQ ID NO: 71849 - DNA, 562 bp, Triticum aestivum
  Clone ID: PAT_TA_71849
ccacgcgtccgacaccgtcccgtgctatacgactcctagttaacttaacccctctcaaattcgcacaaaatctccaccctaaaggccggatcctcatgccaccatcattgccatccccagcgacccacaaagatttcatctttgcttcctggtaaaggcccgcggttcatggctggcttcttctagaagtggagcgcatccagccagccagcctgccggccggccggcgtccgcggactccccgccccagcccgcacgccttcccagccagccccctcccaggcagcagcgctacgtacaaaccgcgcagggatttctccctcgatttcccttttctttttctccgccgccgccgccgccgctgaatctagctctcgccgccggccgtccgcccccagatcggccgtagctaggcgccatgggcaactgctgcggcgcgccgtcgacgcaggggggcggccgggggaagaacgacaggaggaagcccaaggcgaacccctacaccgtcgcctacaaccgcggcgcgggggcgccgccggcgcgggcggggctggtggtgctg

SEQ ID NO: 71850 - DNA, 695 bp, Triticum aestivum
  Clone ID: PAT_TA_71850
ccacgcgtccgccctacgcgtccgcccacgcgtgcgaggaaagtggtgccgaacatgaaacggagaacaaaagacaagatgataaagataatgagaaggaagagaaaactgagatggaggtggagacagagaaggagaaggaaactgaagaggagaaggataaagacaaggaaaaggacgaggaaaaggaaaaggaagtcacatatgaaaatgagaaagaaaaggaaatgcaaatcgagagcgaaaaggtgaagaacacaaaactggttcgtgtagattatattttggagaaggccgaaactggtgttcattttgtcaacaatgtcttacatagtaatagtcaaataaggcgtgcacactgttggttcccttgcattgatagtgccacacaacgttgtccgtttgacctggagtttacagttagcacagatctagtcgcagtcagcaatggggacttgctttaccaggtcttaagcaaggaagatcctccaaggaaaacttatgtatacaaattgagcactccagttagtgcacagtggatatcgttggttgtaggcccatttgaagttcttcctgacaagaatggaataagtgtatcccacatgtgtttatctccgactttgtcaaagctcgataacaccgtctcattctttcacgatgcttacagctgttatgaagattatctcgcggcatca

SEQ ID NO: 71851 - DNA, 612 bp, Triticum aestivum
  Clone ID: PAT_TA_71851
ccacgcgtccggtgcaacccacaccaaacatataaaacgtgctcaaagggggagcctccgcccaaaatacgcggccttttccgtcatccttcctcctccagttcggtcggtctcggtcgactcctccctccgagtctccacctccgacctccgacgctcctctccaacccaccttccagaagccccaccagcaggatgtgcgggatcttcgcctacctcaactacaatgtctcgcgggagcgccgctacgtcctcgaggtgctcctcaacggcctccgccggctcgagtaccgcggctacgactcctccgggatagcggtcgacgcggacctgccggcgccgcttccgtccggctccgcgccggctccctacgccggggcgcccccgctcgtataccgacaggagggcaagatcgagaacctcgtgcgatccgtctacgccgaggttgatgagaaggatgtgaacttggatgccgcattcaatgtgcatgctggaattgctcacaccaggtgggccacccatggcgtaccagccccgaggaatagccacccgcaatcttccggcgctggtgatgagttcttggtcgtgcacaatggcataatcacaaactat

SEQ ID NO: 71852 - DNA, 658 bp, Triticum aestivum
  Clone ID: PAT_TA_71852
ccacgcgtccgcccacgcgtccgacggggacggcgcacatgccagtgtccggtatgttgtttctcacggctcaccccacccatggctggatgctcaagctgtggcgccgctgctttccatatgcttgtgttgtttctgtgtctgctgtgggttcagcacggatctgaaggcttccttcatggatgatggatgatgtgatgctgaatgccaggctaacatacaacctgagagacatgagctactaataacatttccttcttggactaataaaatttaaaaaaaggagttcaatgatctgtattaccagcttcgtcatggaaggaatggacggctacttgccaaatataatccaggatgattatcatgcatcctcagatgcctgctcattgccagcttgcatgtatacatgggacaaagttagtttttatctgacaaaggtatcgcagagtgctttatttgtgatacagcttcagcgcacacggagattgggcgaaacagcatgccccccctctgctggccacgcctctccgcagactcgggcctcacctccggaccgctggtgacggcaaaggcaaaaacgaggatcatgatgagcattacgacggcatggcgaagaggtacaaagcaaggagctggcggcggctccatcatgcgccga

SEQ ID NO: 71853 - DNA, 147 bp, Triticum aestivum
  Clone ID: PAT_TA_71853
ccacgcgtccgctagctacacacatatcatgggggtaagctaagcaagaaagaagcactcgcccctcggcgaaagtgcaatacgtctgatcaggtggtgctggtcgtcacaagttgggggaggagaagctgatcatcctgccggagg

SEQ ID NO: 71854 - DNA, 186 bp, Triticum aestivum
  Clone ID: PAT_TA_71854
ttctccacgcgtccgcccacgcgtccggttacctggcgccagtcgatccatctcacgcgcagaatccaatctagagcgcagagaagagaggagagagagcgggggagggctgccgtcatccgcccgcagccgcgcgtattactacgggcgagacccggtcgccacgtgctcccactcgtccactcc

SEQ ID NO: 71855 - DNA, 159 bp, Triticum aestivum
  Clone ID: PAT_TA_71855
tccacgcgtccgcattgacaagatcaaagttatagtcaaatgtcaatggtctcatttcaaggactacagacctatgcccgaattgggtgaatgattctggcttatccacaaatgatgttgatgaggtcctttttgttggtggtatgacaagggttccca

SEQ ID NO: 71856 - DNA, 663 bp, Triticum aestivum
  Clone ID: PAT_TA_71856
ccacgcgtccgcaattctctattttttcagttgtactaacagtagttgtttgtgcaaaatgaaggcctttgtgatgcgggttgaggaggaagatgactcggaagaggaagatcacagatcatgagctatacaatactaatccatgggtttgctcctactcccctcttccaccagattttccccagtgaatcatgtaatggaggaccagtgcttcatcgagtccatcccgccccttggcactgccattggcgtcttcaacaacctcgctgagtacgacgtagcatgcttcgacgcataaagtaatttgtgccatcatctttgccatctatttatgtttaggactgtgacatgttactactaactgattatgcatgttgttagtatatgatctgtacaagatcaacgcctaaaagggtgtctacatcgcagttgagttggatacctgaagctcgagtatgtttaagttctttcctgtgcagtttcttactgttgcagtagcaccggagcctttcttagtagtgcctaacatttgattgatgtgcgtgcataaaacttgaacttttgggattgatgccgacataccgtaagtttgtctgttgggtaatttttctcttagacactaaactgttcagtataagttttaaacaactacatctttgaata

SEQ ID NO: 71857 - DNA, 270 bp, Triticum aestivum
  Clone ID: PAT_TA_71857
ccacgcgtccgggctccaacgttctagaatgggacaaaccctcaaccaggttcgcacctctcctcctctgttcctccagccccctcaccggagccgcctgtgcccccaccaagaaaagccctagcaagacgcctaaacccaatccatggcgaccatccctaccaccggctccgtctccctactccggggctgcggcgccctccatagggacgggaggtgaaccaggccgtcctatgcggccaggccgattcccgggcgccacgcgcgctc

SEQ ID NO: 71858 - DNA, 759 bp, Triticum aestivum
  Clone ID: PAT_TA_71858
ccacgcgtccgcccacgcgtccgcttacagttaagggaggatgcgaaaaggggtatgcatgttgagaatctgactgaacatgaggtttctaatgcccgagaagcactgcaacaacttattgagggggcagcaaacagaaaggtggcatctaccaatatgaaccgagcaagtagccgttctcatagtgtattcacttgtcttatagagagcaagtgggaatctcaaggtatcaagcatcatcgattttctcatcttaaccttgttgaccttgctggctcagagaggcaaaagagttcaggtgcagaaggggaacgcttgaaggaagcttcgaacatcaacaagtcactctcaaccttaggacatgttattaccagccttattgctgtgtcaaacaaaaagtcacagcatgttccctaccgagattcaaaattgacatttctgctgcaggactcacttggaggtaactccaagaccactataattgcaaatataagcccatctagctgctgtgcagctgagacattgagcacattaaaattcgcgcaacgggctaagcacatacggaataatgctattataaatgaggatgcctctggtgatgtgctgagcatgcgtttagagatccaacatctcaagaaagagcttagtcgcctgcaaggacaatctggatttactaacaatggatttgtctgcgagtcccctagcgcattcaaatgggatcaagctaatggcacattcagtccacttatgtttgataag

SEQ ID NO: 71859 - DNA, 608 bp, Triticum aestivum
  Clone ID: PAT_TA_71859
ccacgcgtccgctcgatcctttcaaccggcagtggcgaggccctctccagtggagggactgcctagtcgccggcgacagcctgtgcgcaagtccggcctgcatcagttgctgcgaagaccacgctaccttggcaaccgcgtctcgccggagttcttcctacgaccttggactcctcggccgcttgcactccgtggagatgtggccctacaggccgcaccggatgcagagcgggggaaattcgcagtcatctctcctgtttccctcccgaaagcacttgaagcaaaggccgaacaagtcagccgggatctccctcctctccggcgacgcggctggtgagcgcgacctggatcctcccgccgccgtcatcttctggaaagccttcctcttgcgccatagagccttgcgcgaaggtcccagcttgcgccatggaacggcagatccggcagccggcccagggttggcgccagccggtgcacctccagcaccgttcgaacctccctcatatccagacgagcccgacagcccaagcccggagacgatacgctggggcctggaggacaccgacgccgggctcgcaggtccggaagccatgccgaacgcgagtggg

SEQ ID NO: 71860 - DNA, 450 bp, Triticum aestivum
  Clone ID: PAT_TA_71860
ccacgcgtccgcgagaccacccagcagcacccggctcccgcccgccgccgcctaaccctcgccgacgaggagtggcacccgctccccctctctctcgccgagctctccctcccgctcaccctccccacaggccagaccttcctctggcgccgcacctccctctccccgctccgattcaccgccgccgtgggcccgcacctcgtctccctctcccacctccccgacgacgaccgcctcgccttcctcctccacaacgacgaccccgcctcctccccctcctcctccgtggccgccgccgggccgcgctgtgcgactacctcaacgcggccgtccccctcgccgacctctgggtccagttcaccgccgccgacgcgcgcttagcggaggtcgcggcgcggctcggcggcggcggcgcgcggctgctcaagcatgacccggtcgagtgcctgt

SEQ ID NO: 71861 - DNA, 256 bp, Triticum aestivum
  Clone ID: PAT_TA_71861
ccacgcgtccgcccacgcgtccggccggaggaggacgaggagatcgtttcccaggtcgttgccgggaagatcccctcgtacgttctggagacgaagttgggcgactgccgccgggccgccgggatccgccgcgagtcgctgcgccggatcacggggagggagatcaacggcctcccgctcgacggcttcgactacgcgtccattctcggccagtgctgcgagatgcccgtcgggtacgtgcagctgcccgtgggcg

SEQ ID NO: 71862 - DNA, 736 bp, Triticum aestivum
  Clone ID: PAT_TA_71862
ccacgcgtccgcccgtggcgccgatgcagttcaggcaagctgagctcagggtgattacttccgtcgagtcacagctcggggaaccgttgagggaggatggaccagtcctcggtgtcgattttgatccgcttcctccaggcgcctttggtgcaccaatcgttccggagcagcaaaagcagcctgtccgatcatatgacgcaaagatattttctaggcatgatccgaatctcttaaaggtgtcctcatttttgcccagcatggagcacccttttgttccgaattcgtttgctggaaagagaaaatcaatggttggtaatccaccacctcaagttcaccctcatggtggatcgagggcagttcatgagtatcaatttcttcctgagcagccaagtgatacatacgagagagcaagtagatctcattactatgacactccggttgaagcttcaaattcgaggattccatctgtcactccaggaccgcaccttctccatgtatctgaggagatggcgcctggttatgcttttgaaggccaaggtcttctgcctcaacctggcaggcctcaggtgtttcctgcagtatcgacagattacgagatgaatcaatctaatagcaacattaattctgtgccagtcgatggtcaatttggtagttctcatgttgctggctttgaagacccacttatatcatcggaaacaagggcttatcatgatgaagatgcttctcgagtggatag

SEQ ID NO: 71863 - DNA, 518 bp, Triticum aestivum
  Clone ID: PAT_TA_71863
gacaaatggagagttccaatattttatttaaaaaataaaaaggttaaaaatagatactctagtagtgagagagaggctatgactatatttgtactgcagccgtccacgcggcggcagtacatctattttaacagcagccgtccacgcaggcaacgcagctcacatgcggctcacggcgtgctgcgccgtgccggtggccctcagctcgccgcggcggcgcgtggcgaacccgagccgctcggcggtggccggcttgaacacggcctctgggtcggcgtccacggcgtcggcgagccgaggccacatcctggcggtgaccagccacgacccgtctcccgcggggctccggatcactgtcatggctgccgacccgagccggcccggacgcacccacggcatcaccagccgcggcgggccgaatccaaagtcgccctccacgcggaacggcacgaacgcctacaccaccagcgccgggctgcctgtgcccagccccaccgtctccgtccacttgccgccct

SEQ ID NO: 71864 - DNA, 571 bp, Triticum aestivum
  Clone ID: PAT_TA_71864
cccctctggtaaaatcttccccaaccctatcgctccgccgccgaccgaccgcacgccgctcctacgccgcgcgcgctctactactgcgtcgcctcccacgccgtcccgtcggatgcccgagcgcgctcggctactgcacgcgtgctcgacccctccttctacgccggcggcgcggcctcgttcttccaggcccggtaggagcccgtgaggctaccgtagcgcaagcccaggcagcaacccggcccagctcacccgtcttcatcagcaggggttgtccggccgccaccgcgcgtcgccggtcgtgtcaccgccgccacttccgctgcttatgagagccctcactgccgccacaatctcctacccgatacgcgccctcctcctccaccacccctacttccgctcaaccctccgcctccctctcaccatgaacccctcctcctcctctggctaccgctccaatgctgccgcctttgcctccacgcaccagctgcgtggcggccgtggcggtggcaggcgaccgggtggacgtggcgatggcggtggcgacggcggaaaccgcatcgacgccctc

SEQ ID NO: 71865 - DNA, 478 bp, Triticum aestivum
  Clone ID: PAT_TA_71865
ccacgcgtccggtctattaatacctcctccacggcgacggcgacattacaaattgccgaggcaaaacccgattcctcatttagtaacgcccacaactcttacgctccccgaacactaccgtgcacgccatcatgacaaacagcgggaggaacgagatcatcccaacagaggcgccatactagaaccaccagctaactcacgcgttctacgattatgcttgcgctattaacgttttgcaggatgatggtgaagagggtcgaaaagcaatccggcagagtatatgatgactgggacatccttcctgccaagaagaaaagggatcctaatgccaagaagcctgaggactgggaggacgatgagttccttcatgaccccgaggacaagaagccagaggggtatgatgacattccgaaggaaatcactgaacctgatgcaacgaaacctgaagactgggatgatgaggaatatggtgaatgga

SEQ ID NO: 71866 - DNA, 526 bp, Triticum aestivum
  Clone ID: PAT_TA_71866
ccacgcgtccgcccacgcgtccgcaatcacctctccacatatctagtcttccacaccgtagcaaggcagtagatccgagagggtgccgccgcgatgtcggacgtgacggcggtgatggctctggagatggaggagccgaagctggtgcttccaccgggcttccggttccaccccaccgacgaggaggtggtcacccactacctcacccgcaaggtcctccgcgaatccttttcctgccaagtgatcgccgacgtcgacctcaacaagaccgagccgtgggatctccccgggaaggcgaagatgggcgagaaggagtggttctttttcgtgcacaagggccggaagtacccgacggggacgcgcaccaaccgcgcgacggagaaggggtactggaaggcgacggggaaggacaaggagatcttccgcggcaagggccgggacgccgtcctcgtcggcatgaagaagacgctcgtcttctacaccggccgggcccccagcggcgggaagacgccgtgggtgatgcacg

SEQ ID NO: 71867 - DNA, 531 bp, Triticum aestivum
  Clone ID: PAT_TA_71867
ccacgcgtccgcaatctctgaatctactgcaccatacgaaagtaacacagtcaatattcagaacccagggtagcagaatcctccgttcagaaaacaacattcatcagaaaggaaaacactgttgctgatcctcttctccgcgtgcacatgcagggagtgataccgatgtggaaggaggtggagtacttcaaggagtaccagcgccggctggcgaagcacgccgggcgcgcccgggccaggcacatcgtggccaacgcggtgtacgtcgtcagcgtgggcaccaacgacttcctggagaactactacctgctggtcaccgggcggttcttcgagttcacggtggccgagtaccaggacttcctggtggcgcgcgccgccgagtttctcacggccatctaccggctcggcgcgcgccgggtcaccttcgcggggctctccgccatcggctgcgtgccgctggagcgcacgctcaacctgctcggcggcggcgcctgcaacgaggagtacaaccaggtggcccgggactacaac

SEQ ID NO: 71868 - DNA, 524 bp, Triticum aestivum
  Clone ID: PAT_TA_71868
ccacgcgtccgtttgcctcgctcaatctggaaccctcgcgccgcctccgcacaaaccagagcgagtggatcagtggagaagacaacctcgtgcacaccgggctgcccgcactcaccggagatccttctcatggacgctgcgggcatgtaattcttgctggatgcagttgacagggaaaccagaggctgagaacagcagttcatgtagatgtgaatgcccagcgctgatcaggcttcttcgtgcatcagataacaactggtacattactgaacaccgcgagagccacaaccactcgatgtcactaacaatgggacagaaggtgcactggccatcgcataaacacatagatgtgtacataaaggacttgataaggcagcttagggaaaataatgtgaatctgggaaaggtctacagtataattggaagcttcttcggctcggttgaaaaggtgcccttcacgaaaaggactcttaggaatatctgtgggaaaattagccgcgagcaggccgatgatgatgtgtgga

SEQ ID NO: 71869 - DNA, 484 bp, Triticum aestivum
  Clone ID: PAT_TA_71869
ccacgcgtccgcggacgcgtgggtcgaccatgtgggcctactgcggcaagtacaacgatgagctcatcaagaacgctgcctacattggcacccctggcaagggtatccttgctgctgatgagtccaccggcaccatcggcaagcgcttcgccagcatcaatgttgagaacgttgaggacaaccgtcgtgccctccgtgagctcctcttctgcacccctggtgccctccagtacctcagcggtgtgatcctgtttgaggagaccctgtaccagagcaccaagggtggcaagcccttcgtcgacatcctcaaggcgggcaatgtcctccccggcatcaaggtggacaagggcaccatcgagcttgctggaaccaacggtgagaccaccacccagggctttgatgaccttggcaagcgctgtgccaagtactacgaggctggtgcccgcttcgccaagtggcgtgcagtccctcaagatcggcgcca

SEQ ID NO: 71870 - DNA, 410 bp, Triticum aestivum
  Clone ID: PAT_TA_71870
aacccacccgtccgcccacgcgtccggcaagtggggtaatttggatctgctggaagcttcagccacactcactcttgctgaactgtggctagctctcggatcaaaccacgcgaagagggccttaagtcttgtttatcaaagccttcctatgatcctcggccatggcggtcttgagctgcgtgctcggtctcagatagtcttagcaaaatgtcacttaacagatccagaattttcagtttctgaagatccctgtgctgttctggaccctctaaatcaagcggctgaagatctgcaggttttagagtaccacgagatggcggcagaggcgtactatctcaaggcgatgacgtataaccacctgggcaaggaatatgagagggaggaagctgcggtttgtttcaaggagcacg

SEQ ID NO: 71871 - DNA, 402 bp, Triticum aestivum
  Clone ID: PAT_TA_71871
ccacgcgtccgatccatggacctggtgaatgtcgtcggcatgtcaagaggcatggaggtaatctgggacccttgtgacttctccgtgcttcgatgcactgccaccattggtgactacaagcgtgtcaagcagatccttgacaacctacttagcaatgccatcaagttcacgcacgaaggccacgtcatgcttcgggcatgggccaaccgcccaatcatgagaagatccgtgattagcaccccgacgaggtttgccccccgccttcgccctggtggggtcttccgatggctccttggaaggagggagaactgtaatgaacataatggttgcatgttcttgcaaaacgatcccaattcggttgagttttactttgaggtggttgacactggtgtggggataccc

SEQ ID NO: 71872 - DNA, 727 bp, Triticum aestivum
  Clone ID: PAT_TA_71872
ccacgcgtccgcctagctccgacccaaccagagagcgccgccgtcttcaaggaaaccctcgcgtggcgatggcgcctcctccaacggaagagcagctactgcgtggatcggaggaaaccgaggtcctccgcctttctgttgacggcggcggccaccccagcgtttgcacggatcagccgtcagcaataggtggccccgcggcccagactacggaagaaccccgtgatgaccaggcgctcgtctccacagaatcagatcagttttccttgcgcgctcctgagctcgtgagcacacaggtggacagcgacgaccagcgcgatgcccaagtgatggaggaggacagcgatgacaaggagggtagtgatgacgaggaggataccgatgaatatgatgcccaaatggtagacgagaacagtgatgaggaggaggctggggatgaatactatgcccaagtgatcgacaaggacagcgagacaaattgcccaggaaaaaactactccaaggaagaagcagatgaagtagtgtccagatggcttcacagtttcaacaaagcgtatcatgactgcttgaacctgcgcctagagattctagcccggggtgataagaatgctcgtcttccttcttttcctttgaaagttctccctgtggtaacaagtctatgcattgaaagcaacatctgttatcaccgtgaatacattacccatgacacttccacaactgcatcatt

SEQ ID NO: 71873 - DNA, 654 bp, Triticum aestivum
  Clone ID: PAT_TA_71873
ccacgcgtccgggggaatggagcattacaaggacaaactgattgatcttatcacaaatgaccgcgaagctccactgcttgctatcactggcatggctggtgtggggaaatcaacccttctcaaaacattgtgtgaatctgtgccactttatgatttttttgaagagctcatctatgttagggctggaatcaagccaactgttcatgagctgcagcaatatgtcgggacttatctgggaatacacctgcctgatgatcacaaaagcagaaggtcagctatattcacacaactcgcagataagagttttctgctcatcctagatgatgtctgggagagtatcaattttgaagaagtcggtattcctgtgcccctgggggaactaatggtgcagcctgagtatgggatcactcgaacagcactacgtaaagttgtgtttgcagcaagagatgagtcagcatgcaaaacctggagggggcactcagcatatgtcaccaggatggagtgcttgaatgaacaagacgcttttgaactcttcgcccatcatgcggggaataccatcacgaaggaccagcgaatccttcagcttgcacatgagatcgctgaagagtgcagtggcttaccaattgctttgtgcaagattggagaagctatgtc

SEQ ID NO: 71874 - DNA, 623 bp, Triticum aestivum
  Clone ID: PAT_TA_71874
ccacgcgtccgctcctcctggtgctgcgcgccggaccccgccccctccacctcccacttccactcctccgcccgcggcgccgccggccccatggaccacccgcccccgcagccgcagcccgccgcgggcgcctcctcctacgccagccccaacccgccctcctacacgcagccgcagtcctacccctccagctacaccaagttcaactccgcgctcaacgccggcctcctcaaccccatgtccccgccgccgctgcccatcgacaagacgcgctccagccccaccctcttcgacatgatggccaacgagcaggactaccagccccgctccgccgccgccgccgcccactccgccccgccgcacccgcacccgcaccacccgctcgcccccgcgcgctccatggaccgccaggcgctgctccaggaccgcgtcgccgagctcatcggcagctgcagccccgggaaccagttcaacgacgccgactcctccgacgtgcgcctcaccctcagctccaaggacggcctctccctcacgctctgcgtgcaccgccacatactcgtcgcccacagcaggttcttcgccgccaagctctccgaccgctggtccaagcagcaagcgcacgc

SEQ ID NO: 71875 - DNA, 703 bp, Triticum aestivum
  Clone ID: PAT_TA_71875
aacccacgcgtccggcacgttgttgccatatatgcggagtgcagccagcttgctgcaagagtatatgctttctggaattgtgccggtaaagttattgtacagaagatctaaattccttagactgagcaggcttgagaagttgaccttggtaagttctccgttgaactggttgctcttgagatcaactgttacgagatttgtgcagttgctcagagctgacggcagctcccctgacatcttgttgtggtccaaatgcaactcctctaatttcttgagctggcctattgagttcggaatcttgccgctgaaattgttccctccaagatttaggttagccagatttctgagtttgattatctgtgcgccatctagctttccatctaaatgattgtccggaagcgagaggtactccagtaaggaagcatcaaagagttcattggggagagcccccctgaggttgttgtgtccagccttgagcactctgagcatggagcagttgccaagtcctggagggatgctgcctgtaaattggttgtaacagagctcaaccacagctaacaatgacgagctgctgcagaaatgactcggtatttgcccactgaagctgttgttgctggcgttgagcacgaccaggttgttcatcacttgccacgtggatggaaacgctcctgtgaacaagttgctcgagatgttcaatacctgc

SEQ ID NO: 71876 - DNA, 270 bp, Triticum aestivum
  Clone ID: PAT_TA_71876
ccacgcgtccggtataaccgtgcatctggttggactgatagggaaagggttgattttagttctggcctaactgtctacaacagtacagcacatttaattcataattcatcacttgcacaagatgatcaaaaggttaccagactctcacctcccatgaggaaagccctaagggatcacaaatctgaaaagcagaactacatgaaaaatgatagtggaattgatgcatgtcagcctgaatataatgttcaccaggtaaagcatttgcaacag

SEQ ID NO: 71877 - DNA, 733 bp, Triticum aestivum
  Clone ID: PAT_TA_71877
ccacgcgtccggaaaatattttatttatctgtgtgataagaggatgatgtcaaagataaaatacatgtttctcaactccattcattgattcaaattacatcgaactacctgaagaaatcgcagagtatattgaatccaaattcttagatatcagtctaacacaagcaagttctcttcgtgcctctagttttgttcaaagtaacgaatacttgtttatatgattctgagttcttttttacaacaacaggataaaatcattcttcaattaaaagctcaagatttctatagaaatatctttcggaacacaactcctaccatgaaaacctatgtagatgacatccattcttcatttctgaagaacatgacaacttccagcagccaaaatgtgcaaattaaaccagcactttcagaaaacacattcaaagttcctacatctaaagaattgttggctatacaatcacctcgcattttcccaatgctagatgttccaacaataattgatgaagataaacaagtcaacatacatgatattcttgattcattggtcaatgatttcccgcagtctgtcaacataacaagtacaaatctcactctctctttctgtggtggtaatctaccatcttttgaacaacttgcttgctcggagctttttgtcaagagatcaattccaaaagtaacacccaccattgatgcttctgcactgttacatcaattcttttctgaaacaaaatcc

SEQ ID NO: 71878 - DNA, 270 bp, Triticum aestivum
  Clone ID: PAT_TA_71878
caaaaaggtgcttgtaaaagtaaataatcatgcaatcatgtaatattattttatgttggcttgtttccccaaattaattatgcaacatccgattaaaaatcctaaattgaaatccaacccgaaattgaaatcctaaccactttccaaaatttacccaatgtaaggctgcaaaaagtgtaatccctttgtattttccaaaaaggggacagtttcactcaaaacgtgtaaaccttgtttttcgcataaaacattattacaggcggataaacc

SEQ ID NO: 71879 - DNA, 99 bp, Triticum aestivum
  Clone ID: PAT_TA_71879
ccacgcgtccggtgatgagttggttcttgatgtagtagtaaagcttagctgtagcgactcataatcctcgtagctaatatatggaaagagtacattatt

SEQ ID NO: 71880 - DNA, 442 bp, Triticum aestivum
  Clone ID: PAT_TA_71880
ccacgcgtccgtgttgtcgttgttgtcgttagtgtcgtcgtcgtcatcgtcgtcgtcgtcgtcgtcgttgttgttgttgttgttgttgttgttgttgttgggtctggggaaattgttgttgtggttgatgggggtatgttagtagatgttcgcgctctcctccatcaagggtgtgggccgtcgtttctccaacatcttctgcaagaaggccgacatcgacatgaacaagagggccggagagctttccgcggaggagatggaccgcctgatggcggtggtgcacaacccgcgccagttcaaggtgccggactggttcctcaacataaagaaggactacaaggacgggaggttctcccaggtcgtgtccaacgccgtggacatgaagctcagggatgaccttgagaggctcaagaatatcaggaaccatcgtggtctgcgtcac

SEQ ID NO: 71881 - DNA, 567 bp, Triticum aestivum
  Clone ID: PAT_TA_71881
ccacgcgtccgagcggcctccagctcaccagggtttccgccgcgcgcagatccgcccaatccgtgcagcctcaggccaccgctctggtacggacgccgcttacccttgctccttaccttgctggcgtgtccctcctggatcgagcgtcagccgccgccctccagcatccctaatccggttcgaccaaattcgttgtaatttggcgaggcgtcggccccaatcgttggagtttgctcgtggttcgtggcgggctggtgtctgggttgccggaggttggccgaggatgctggcggagggggtagttctagggttaggatttggtgcggtggtgtgaggcgatggcggacggcggaaagatgaagggcgtggagggaagcggcgagggtaccgggcatggtgaagatatggatgaggaggcgcgggaggagctggagctcgcactgtctctggggcgccagggttggcatctgccgccagtgccggtgccgccgccggcacccgccttgagatggtcgatggtcttcccggcatgggaccctgacgctgctgggagttctcgtgctgctg

SEQ ID NO: 71882 - DNA, 624 bp, Triticum aestivum
  Clone ID: PAT_TA_71882
ccacgcgtccgaaactttttgaaaggaatgagtaccacaacattgttgaggagttgacagccattctaaaggacggcaaatcactgagagtaaaagtggacgaactgccatttgttgaaaaagaattaaagaggtcctcctgcaggaagcaagcatccgaggctcttgcaacacaaatgtccctgcagtttattaaagaaattctgatacaagcctccatattaactattgaagaggagcaaccattcgttggtctgtcggaggtgctaaaaaatgccactgcttgggaagagaaggctcaacgtatgcttgagcagtcagcttctctctctgagtttgaggatcatatccggtggtcagaggatataaaagctatacttccatctgaacaagttatgaaaacagagattattgctgctaggttgtggatggacaaatgtcaggcctatctgagacctagatgtgatagacttggatttggagtttgtcttaaagttgatgacttgaaggatttagtctgtcagcctgcaactatgaaagtcattctcgacacttctgcacttaattctgttctcagtaatattgaagagtgggaacagaattcacagagtctgctaagcagtt

SEQ ID NO: 71883 - DNA, 504 bp, Triticum aestivum
  Clone ID: PAT_TA_71883
ccacgcgtccgcttcggactcccttccaccggctcttcccttgcgcgcttcgatcgggatcgatggcggcggaggcggacgacccgacggcggcgtcagcgacgctggagaagttccgcctctacgaaacgcgcgccaggttctacgtgatcgggagctcgcgggagaagcggtggtttcgggtgctcaagattgaccgctcggagccgtcggagctccacctcagcgaggaccccgtctggtactcccagcaggaggtcaagagcctactccagcgcatcgccgagggcaaccgctccaccggcggcctcaccttcgtcaccaaggcctacggcatcgcaggttgcatcaagttcttggagtcatattacctgattttagtcaccaagcgccgtcaaatcggttgcatctgtggccatgctatatattgtatagatgagagccagatgatcaccatcccgcactcatctgtacagacagatgttgcaacctctaagaacgagc

SEQ ID NO: 71884 - DNA, 530 bp, Triticum aestivum
  Clone ID: PAT_TA_71884
ccacgcgtccgcccttttctctcgaagcaccggctccgctccactccactcggccgctcttcccttcttccgcgattccctcgcccccgcctctcccctcttcccccctcctgctttcgaaattatttcggttcctcctcccttccgcggaactaccagggcgggcttgcgcgcgggggcggaagaagcgcgcaagcttagcacatgcggacaccgtcggggccccgccgccaagcttgaaaggtaaggttccatcccggcgcggcgtcgtgtcggcagcgtgccgcgatctggttccggcgtgcgtattttgcacgcccatgatctaatcttatcgaatattgttttgcttcacctaacccatcgcatgcccccctgcttgcgaacgaacccgccccatgaactcatgcttactgattgcgctgtgctggatgtgtcgagcgtgcaaattatggaaccctacaatatttgctgtgtgtttgatttgatccgatccgacgctcgtatgtggtgtatacggagtacaatgc

SEQ ID NO: 71885 - DNA, 497 bp, Triticum aestivum
  Clone ID: PAT_TA_71885
ccacgcgtccgaccggccccactccacctcggcgccgccattgcagcctctcatggagtcccggtgggttatcgcgttcctcttcctgtccctgcagccgctgctcggcgcgtcctacctgcgggcgaggaagaactacatcgtgcacctcgacccgaggggcggccccgtcgactccgtcgaggagtggcaccgctccttcctcccgaggacggccgcgctcgaatctgaggtggaggcggacggcggcgccaaggaccatggcccgcgcatcatatactcctacagcgacgtgttcaccggcttcgccgcgcggctcacggacgaggaggccgaggcgctgaggtccacggaggggtgcctcaggctgtacccggaggtgttcttgccgctcgccaccacccgctcgcccggcttcctcggcctccacctcgggaacgaggggttctggagtcgctccgggttcggccgcggggtggtgattggcatcttggaca

SEQ ID NO: 71886 - DNA, 544 bp, Triticum aestivum
  Clone ID: PAT_TA_71886
ccacgcgtccgtgcagcagtgatgattgaagggatcctgtgcggtgtgaagacagcaaacagttggtgctaagttgctaactcagatctcctcttgcagcactctcatcagtctagttaccggtctgtacccagcttgcgagataactcgtagtgtttttacgcaagcagaggagagagaggtgctttggtaactagtgttgtttgctcttgctccagtcctttgctcttgcttggctccagtatgctgttattggatctgggaaagtttcgtctcggttgcttctgttagtcgcgctcctgttgctccacaggtcacgtatgcttgaactgatcctgtgccgctctcctcgatctcgcagcactctcagcagtggcttctcagtctagttacaggcatgtagtattcaggtgtagcagcatggttttctcttggtgattgaccgatactcttctattatctgtttttattctcgcttgggttgtccatcggagtaaactgcatctacaaaatgatcactattgattcttattattgacggttt

SEQ ID NO: 71887 - DNA, 703 bp, Triticum aestivum
  Clone ID: PAT_TA_71887
ccacgcgtccgatcagttgaaccatctcctcctggggcacgcttctcacctactcccttctctgcttctcccccaattctagatcgagatctctggttcatcacaaattggtattcagagcctagaaattgttttcccacctcggtctctgccgctgatctctcacactcttggtcgtcggtaaaatccaccgggtcaggtgaattcgctcaaaatcccgttcggggtttggtcgatttggagcgaggccacggcgccatccaaacctttggcgcagacccgccgcgtgctcgacgccatgtcagagaccaccgacaaagctacagaacttgctcgagacggtcatccgccgcctggacgcgaatcggaagacaaccgacgagtggccccaggcgcagctctcctacaatgaccaggtctccgccgagctcaaactcctctccaaacagatcgatctcacccaggccgatgtggatgaagctcgcaaggccgtgcccacggccgatcctatcgccacagcaagtgcgggcaccatgtcccctttggcgaccgtggactccttcacgcatggaccaccaccaccgtcgacccgccccacgccgacccccctctatacggacggcgcgacgcagcttccgtttgccaggctggtcaaccacggccccccgctgctgatcaccggggccccttcaccgacagagcg

SEQ ID NO: 71888 - DNA, 630 bp, Triticum aestivum
  Clone ID: PAT_TA_71888
ccacgcgtccggcggcggcggcggcggcgagtgtgccacacgcgagcctggttagcaatctgaatagagaaagagagagaaagagagagagagagagagagagagagagagagagagagagagattgatggcgcgcggcggcggcggcggagtcgagtttcggccgcctcctgagatggcgatggaagagatggatcggcagcctgtcgttgtttccgaagcaagaatcctgaggatggagattgcgtccctggtgaacttgctcatcgagaaacaatctgacgttctttcctacgatcccgagatcgtgaggaagatcacgtccctgaggaacgagatcgcgtgccagaagctggccagggagcgcaaagccttggttacggaggtcaaacgcacagtgccgcggaggcgcaaaaagttttatgcagtgcggagggtcgctgagaaggagatcatggccgatcaggagagcgtggatctgcctaactccgatacgcatagtgtgacctcccaagtcagttgcatccccgagcagttgcccgagccctgcgaccagaaggagatcgactcggagaataacaaatcagcttccagattcaaatccaacttcgagcatgtatattcacccta

SEQ ID NO: 71889 - DNA, 664 bp, Triticum aestivum
  Clone ID: PAT_TA_71889
ccacgcgtccgggcgatggattgatcggccccacgggttagggcaatgagagactgtgcgggagatgtaggccgacactatggctgtttggttgagcacaactgctccgttgggatttgaagaaccaatcattcttcggtttctctgcattcatggcaggtgatgtgcccatccttccgctgcctcggtacaggtacgtgtatttatgcccctaccactcttcactaattctttccactctggcaacacaacattcatcagcatggcgctcggctaggttcccctatatttctttcccgttcttacaccaaataattacattatcctgacatcctctcaatcccaaattttgtgcaggtgatgctcatactggttgtggtcaatttatttgggcatcttggaggcttgtactcccattttcttacttccgaaattcttcaactgataatttccgatggcctctgacagatttgtttttggtctattgcagaatagtggcgggggagcaggctctggaagcttgtgtatttggttggggttaaaattttgagcacccgagaggttgagaagctgctactaacgtgctaattagctcatgctgtgtgctgattaacctggtgccttttagatgttaagcttttgctgtgacccaagcttatctttg

SEQ ID NO: 71890 - DNA, 570 bp, Triticum aestivum
  Clone ID: PAT_TA_71890
tttcacgcgtccggtgcttcaacccaatggcattggtaagcctgcccatttcatgaggaggaaaaggataaggaaaccaagggcgctcaaggagaacagagttggtggcgatgaccctgtcagttgcttaaaaactgagaatggcactcatgatcaggacatcacaacaaagtcttgttcggaaaatgatctctcggttccaaagctaccaggtgaaccatctaaacctgttcatgttgataaggatagtgctgggcatgcgcaagggcacattgatgttagcttggaagaaaatgctgctatgatgctctgttctctgtcagataatagacatgatgacccattgaggaaccgaatgtcatcaccagatagatcatcaaaggaatctaatcttcaccgctctaatcgcttgaacaatccatacaagaatgaagatgatgtagcaggtccttctaggttgctacggaagcgtgacggtaaagggccattcaggaagcgtcgcccacgtcgtcatttttatgaagtcagccctcatgatctggatccattttccattgtaaaagagaggat

SEQ ID NO: 71891 - DNA, 130 bp, Triticum aestivum
  Clone ID: PAT_TA_71891
ccacgcgtccgctaggggagtgttgttcgaggagaggggagggggagagactatttcctaacgtgaacggaaaataaagccaagccatctctcgcgtaggctaacgacaaggcttcctcccttgctccct

SEQ ID NO: 71892 - DNA, 503 bp, Triticum aestivum
  Clone ID: PAT_TA_71892
ccacgcgtccgggttttactttgacttctcttgtacctatgtcggagttggaatgatttgcccacatattgtcaacgtatctattctattgggaggcatcctctcgtggggaataatgtggcctcttatagccaataaaagaggcagttggttctctgccgatctccctgagagtagtctccgtggaatgcaaggttaccgggtaagagttacagtcttccttgaacctcgagttatcctttttttccctactaaattccgatgggtatgataggtcttcatagccattgccgtgattcttggcgatggcctctatcactttctcaagatgctcattctgacggtctactcattaagatctcgactcaagacgggcagcgctagtccatttcctgtctctgatgatgaaacatgtaacggtacagctgctatctcatatgatgagcagcggcgcaaataactatttcaaaaggatcaaataccctggtacattgcatatggag

SEQ ID NO: 71893 - DNA, 307 bp, Triticum aestivum
  Clone ID: PAT_TA_71893
ccacgcgtccgcgcacaagagacgaggcgcaggggacgccgcaagcaacgcacggacactcaccatggctcctcgccgctttctcctcctcgcgatcctcctcgtcctcctcggtgctcatggctttggccgtggcgccgcgcaggccgccgaccagttcgcctacaacggcttcgcggacgccaacctcacgctcgacggcttggccgccgtggcgcccaacggcctgctggcgctcatcaacggcaccagccaggcggcgggccacgcgttccacccgacgccgttccgcatgcggaacggcacc

SEQ ID NO: 71894 - DNA, 271 bp, Triticum aestivum
  Clone ID: PAT_TA_71894
acaccaattaaaatattatataaattaaattaactaaaaccattaataaacttgatgttacatcaaaatgaaacaaataattcaacaaatacctttaaagttgaaaaaaaaattttttttttaaaaaaccctgcgtactcaaccttgacaaatttattatggaaaaaaaacaaccctttcaaacttgggcacctaaactggaaaccggggaatctcctaaatccatgggttgctgggggcttcctttaacgggtaaatgtccttgaacccc

SEQ ID NO: 71895 - DNA, 399 bp, Triticum aestivum
  Clone ID: PAT_TA_71895
ccacgcgtccgcttctgtatttttagatacatcgttcatataggagcaagctggaattgttacattgaatagtagcatgcagatttaataggccatgaggattagaactaatagtgagccttcaagttttaaaaggtaaataaaagtaatatgttgacaaagcgccaccatgctatgatatttaacaataatctgttgattaaatatgccatgctcattagtaaaaacattgagcaaagcagtcctattataaactatttgtaattgcaattcatatgttgccctttttatatggtttcctggtccatattacatgtgtaggtgcagttgagtaattttgagtctaacaaacctggtccagcaactgaaatttctgcaaatgaaaaggaagaactagag

SEQ ID NO: 71896 - DNA, 360 bp, Triticum aestivum
  Clone ID: PAT_TA_71896
ccacgcgtccgcctgtactgcatatacggtcgtgcacagtaatgctttcacttccgcggcatctcttcccctccgccacctccaacttttaaattccctaactcatcccggtcgctctttatctccggcgacgcccgccgcgatgaagggcgccgacctgataaacgtggcccttccggaggagctcctggaggacgtgctccgacgtgtcggcggcgaaaagcgcgacctggacgcctgcgccctcgtctgccgccgctggcgccgcctcgaccgcgccacgcgcaggtccgccaagctcccagcatccggggttcacgcggacgaggtggtaggcctcttcgtggaacggttcccggc

SEQ ID NO: 71897 - DNA, 266 bp, Triticum aestivum
  unsure (1)..(266): unsure at all n locations
  Clone ID: PAT_TA_71897
ccacgcgtccggtagaacaatttactacaggttggagcatacacacacgcactacgaacttaattaaagctactacagaaatttatcccacccattcctcgctttcatcagggaagagagagggaggaagaaagctatcaacggcgacgcggcggtccagcagatccgtactgctcgggggatctgggggaagggagaaccggtgggggccgcctatgcgtcggngagggcccagtcggcgctagagcaggaatggcggtggcggt

SEQ ID NO: 71898 - DNA, 435 bp, Triticum aestivum
  Clone ID: PAT_TA_71898
ccacgcgtccggatgacgcttggtcctacccggggcaagattttcgacaagtatcagaaaatggttcacacgtatgaccctatgtctgaagctctagaaaccattctttcaatcacggagacacactcaactccatattatgggcccactacttcaaggattattttcattcaagagacccttgctcctgtgcataaaacagatgaagagatagccttatcatctgacctgtctaaggtgattagagagatcctactccgcctcccagctaaagcagtggtacactccaaatttgtctgcaagcagtggttcagattgattgaaagtgaaaacttaattcaatcatactttcagcataagaacatggacaaaagacctaaggtcatgcttctggtcaagggcactggacagttggccttcagtttttctcccttg

SEQ ID NO: 71899 - DNA, 309 bp, Triticum aestivum
  Clone ID: PAT_TA_71899
ccacgcgtccggccttctcctgatggccgccgggtgcccgcacgtcccgctgctcaactcagtcgggcgcctgccggccgcgctcatcgccatcgccttccctcttgtcggggtttctgcagcacttgacgctcttgtagatattgcagatggcaaaataaatatccatgtacttatggctcttgcagcatttgcttctatatttatgggaaactcattggagggtggtttacttcttgcaatgtttaacttagctcatatcgctgaagagtactttacaagcaagtcaatgtatgatgtgagggaact

SEQ ID NO: 71900 - DNA, 459 bp, Triticum aestivum
  Clone ID: PAT_TA_71900
ccacgcgtccgagatcccttgcaaagcaatcaacataattcaaataaattgccaatagcaagaaatcccttgcaagcaaacaacaaaatcaattcatgtagttgtatgtacacaatctcaatcacatcatatctttctttacctttgcatatggactccctctccacatcatatctcaatctcaacccaatcaaaatttttctatgttgaaccactagaataaagttgcccccattgcaacacatgggtatttagccagtcatactaattgcattattggtaataggaaactgacgctgcattttgaatataatagctcttctgcaaatttagacaatccttactgtttcttttttgtgctagccaaactgaaggacatactgtctgaccagttttacagcagaatctcctcgctaagagttttgtataatattctgaatggagatatgtggtgttgtg

SEQ ID NO: 71901 - DNA, 544 bp, Triticum aestivum
  Clone ID: PAT_TA_71901
ccacgcgtccgcatctttttgtaatgctttgatcacaatgtatagcaagtgtggtgatgtcagtgagtcagagttggtcttcataaatcttaaaagccaggacattgtttcgtggaacacaatgattgcggcatatgcacaacatggcaaatatcagaaagctatttctctcttccatgagatggaaacacgtgggctgataccgaatgatattaccatccttagtgtgctatcagcatgtgggcatgttggcagggtggatgacagcttgaaactatttgatcttatgtcattcaaatacgcgatatatccaggagctgaacactatgcttgtattatcgatatattgggtcgagcaggacagtttgagaaagcatgtagttacataaaagacatgccatttgaatctgagaagaatgtttggggtgcattgctgggggcttccaagactcatggtaatgtgcagttgggtgaacttgcggcgaaaatgcttgtgcagtcatactcacgaagttcagggccttatgtgatgctttcaaatata

SEQ ID NO: 71902 - DNA, 364 bp, Triticum aestivum
  Clone ID: PAT_TA_71902
ccacgcgtccgaccacacttacgcctggctgacgaagccaagtatgctccttcttcctagttgctctcagcctctctatatctagaaaagcaagtaaagcggtcaggctaatgcgaaggcttctaaaacatctaatcagactatcaagagatattgagacgtaccacttatgtccatagcatatgctgaaacacgaaatgtgctcaaggaccagaaactatttgatattggctcacaacatcttgagaaaggcgaaacacaccaaggcccagactgtacttggaattgctcttattgccatgtctgaagaattatgagctgaaatggctgtacgatcacttgaacgtcttctacagtatggcga

SEQ ID NO: 71903 - DNA, 461 bp, Triticum aestivum
  Clone ID: PAT_TA_71903
ccacgcgtccgcctcagtctgcggtggccgactgactggcttgtgcctggttcgcgactggcgtggtgctccgcgcagccaaaccacaaagctacaaaccccactccacccccgcctcatcgcctcctccgtcgccctccccccgccgacgaccgcccccgcagccgccttcccccccggtgaggtgacgccgccgaagcaggaggtacggttcttccggcgccggccgccggggtatgagcaccatgcgccgccccgcatgatctagggtgccgaccaccccactcacaatatggcgggtgctataaccttcacagacattatctggataaacactcatgtattatgacgatactgattgacatagccgaaattttcaactacctggtgaatacaacatttaatccacatcaagatcgcggccatttgcactgacgaaacttgatactgacgaccaacta

SEQ ID NO: 71904 - DNA, 214 bp, Triticum aestivum
  Clone ID: PAT_TA_71904
ccacgcgtccgcagtcctcgctcctctgggctagctgtttccccatggacggcgatggtcgcagcgacgactgcgacgccggcggcgagtggatctgggtgcgtcgaccgcaggaagcggaagctgcggctgcggcggcggggtggccgacggaggaggcgccgcctctgaaggtggtgttcgcgtcctcagcgaggtactttaccgactcggt

SEQ ID NO: 71905 - DNA, 383 bp, Triticum aestivum
  Clone ID: PAT_TA_71905
ccacgcgtccgatcagctagccacctaccacccttccacgccgccaccgcccagatctccgtcctagaaacccgccgccagaagcaagtgcgtgatcacctcatcgccaccatggatcccgcgctcaaagcttacctcgacaagatgagcgacgaggccaccgcccgcgccaacaagcaagacggcgacaacaatgccatcctccaggccttggcgacgcagacggcgcggattgactccctcgtcacctggaagccggagttggaggcgcggttcacgcaattggagctctcggtcgcggctttctaagccgcatcatcttcaactgtaccatacattggatcgccgtcacttgcgaccccttccatggttgcgcgcgagat

SEQ ID NO: 71906 - DNA, 350 bp, Triticum aestivum
  Clone ID: PAT_TA_71906
ccacgcgtccgcaaagataccgaccccggccccggatccatccgcaatcccctctcgacaacaacaatcatccagtactcagtgcaccgtcggaaaaggagatgcgcggcagcatgcgttcctccgtgaagaagaggagcccccgtgctcctcctcctcttgctccggtgctcctgctggtctgcggcctcgcgctgctgcagcgcccggcctctgccgagataaagtcgtatgttgcgtacctgggatgccactcgcatggcagagagggcgcggcgctcgcctccaaccaggaacgcgccaagaactcccactaccagtgcttgggctccgctctgggaagcgaggag

SEQ ID NO: 71907 - DNA, 260 bp, Triticum aestivum
  Clone ID: PAT_TA_71907
ggccgccgccggcgccgagctctccctcccaggagccgaggtcggctcgtcccgtgcccggttcaacgcgcctctcgctcgccccccctcggcggagggaggtcgccgggtccaaactggtgtaggcagttctactgtttgcctaagctacccttgcttcatttagtatggacgtcgatgatgatgtggaggacgatgacatggatttcaaccctttatatagggaaggatcaccattcgagacctcgtcaagcctcacc

SEQ ID NO: 71908 - DNA, 547 bp, Triticum aestivum
  Clone ID: PAT_TA_71908
ccacgcgtccgcggacgcgtgggcggaaggagcggagccgccgagccgggaagagccaccatcccatcgcctccgtttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggcaggctctctgagccatacaagggtattggtgactgctttgggcgcaccatcaaggatgaaggctttggctcactgtggagaggaaacactgctaacgtcat

SEQ ID NO: 71909 - DNA, 381 bp, Triticum aestivum
  Clone ID: PAT_TA_71909
ccacgccttcggatatattcctgcctgcactttatgttcctctagccagcccgggagagtgtgagcgagcaaacgagaaattggtaacaatggacctaagtgacaaaaaatttcagatccttgagagtgttttcatggagtgccccaaccccgatgaggcccagcgcgctcatctcggtcgcgagtttcgcgtggagccccagcatatcaaattctggttcaagaaccatcgtgcccagatgaggagggctaggcacgagcaggtggacaaccacttatccgactcggagaacgacgagatcgactcagagagtgatgagatccactaagaccacttcgcgatgtgggtttgaggatcaagggctgatctattgaaataaa

SEQ ID NO: 71910 - DNA, 161 bp, Triticum aestivum
  Clone ID: PAT_TA_71910
ccacgcgtccgctgggatgaagatggtgagaaatcacaaactttataggctagactgcttactcctgaagcttgcggagctgggctacaagaggagcgccaagaagtgcaaggagaagttcgagaacgtgcacaagtactacaagcgcaccatggagggcc

SEQ ID NO: 71911 - DNA, 541 bp, Triticum aestivum
  Clone ID: PAT_TA_71911
ccacgcgtccgaaatccggattgttcagtaggttcagttgtgtcctgagacgaggaagctactataggtgggaagaagttcggaaaacatggccacgatgggtggggaccgaaggcagatgatggaggatgcggcggatgacaagttcccggaggggttacgcatcctcgtcgtcgacgacgaccgcgtctgcctcacggtactagaagccctcttgcaccgttgcaagtaccaaccaacgacggtgatggatgcaaagacggcgctgaggatgctcatggcagggaagcagcagttcgacctcgtcatcaccgacgtgcgcatgccggacatggacggcttcaagctcctcgagctcatccgcctccagatggatctgcccgtcatcattttttttgactgggaactgtgggtcaagacccccacagcagatccaaactttattgaagaaaacagatacaactggttgattacaaggagtaaccaggttacgagaaagaacaaaaaagaaagccctaccaaactagcttaaggggggagg

SEQ ID NO: 71912 - DNA, 202 bp, Triticum aestivum
  Clone ID: PAT_TA_71912
ccacgcgtccgacccgatctttcaacccctgtgcggcttcttcaaggaggtgctggcgcatcaccaggaccccgcgcggcccaagccggagagcggcggcggggacctcgtgcccgagtacgagcgcgactacgaggaccatgactgctccctgaaccatcaggaggacgatgccctagacgagttcgtcctccgggtcctc

SEQ ID NO: 71913 - DNA, 476 bp, Triticum aestivum
  Clone ID: PAT_TA_71913
ccacgcgtccgagaggatcttcagagacctcggcggcttcttcgaggaggtgctggagcatcaccaggaccccgcgcggcccaagccggagagcggcggcggggacctcgtggacgccctcgtcggcctctgcgaggagcatggcttcacgacggaccatgtgaaggccgtcctcgtggacgcgttcctcggcggcatcgacacgagctccgtgacgatcctgtgggcgatgtcggagctcatgaggaagcctcgcgcgctgaagacggcgcaggaggagatcagggccacggtcggcggcaacggcgacagggtgcagccggacgacctgccgaagctgacgtacctgaagatggtggtgaaggagacgctgcggctgcacccgccggcgacgctgctgctgccgcgggagacgctgcggagggtggagatcggcggctacgaggtgccggcggggacgcgggtgctggtgaacg

SEQ ID NO: 71914 - DNA, 553 bp, Triticum aestivum
  Clone ID: PAT_TA_71914
ccacgcgtccgcccacgcgtccggaactagtgggcaccaatccatcatgaacaccttcctcgtctttgcgcttgtagccgttgtggcgacatctgccattgcacagatggagactagctgcatgcctggtttggagagaccatggcagctacaaccattacaacaaaaagagacatttgcacaacaaccaccatcttcacaacaacaacaaccatttcctcaacaaccaccatttttgcagcaacaaccttcattttcgcagcaaccactattttcacagaaacaacaaccagttctaccacaacaaccagcattttcgcagcaacaacaaacagttctaccacaacaaccagcattttcgcagcaacaacaccaacagcttctgcaacaacaaatccctattgttcatccatccattttgcagcagctaaacccgtgcaaggtattcctccagcagcagtgtagccctgtggcaatgccacaacatcttgctaggtcgcagatgtggcagcagagcagttgcaatgtgatgcagcaacaatgttgccaacaa

SEQ ID NO: 71915 - DNA, 627 bp, Triticum aestivum
  unsure (1)..(627): unsure at all n locations
  Clone ID: PAT_TA_71915
ccacgcgtccgtccagttgctcttgagattgcgctagctgggccggcccaattactaatggatcatcttctttgtggcccagttactgctgaatggggcgatctctttctcgttattttttcgtctttaactctatattacatggcatatttttatttatttttatatatacttgccgtgtccccgatgggctgtttttggaaaatgccgtatcccgtgtccccgtatgcgtgtcgccgtgtccgtgtccccgtatccgtgctttttagggtagaaatgttaatgtaaataggatagatgaacatccacaacgattggatatttgctcgccaaagtgcaagaaagaaccatactaccaggccagtttttctgagggagacataatataaaaagtaatacaatactatcttattagttttttttattacctctgaattatttctggcagccattctcatctccctttggttagcagccaaaagttatgtgtagaggccaccttctagcctgtcctactaataaaatagtacacctgaggttgttctanaactcgaaacactaatgatatgcttcatttggtgtgcaggaatccactggtgtgtcagacggcgatttcgtttcatatgt

SEQ ID NO: 71916 - DNA, 297 bp, Triticum aestivum
  Clone ID: PAT_TA_71916
ccacgcgtccggagtgttccggatctctcctgggcccagatccaccacccgccccggcgacggccaccggcatggccgccccagccacgccgcgcctccttctctcgccgacgtccaaggacctcatcaccggaaactccttcgcctcgccttcttcccccaccttcttcttcttcgaccccggcttcccggtcgacgccttcgccttcgatcccgtccttttcggctttcttttcccggtctttttccccttcgaattattcttcggcgggcttttcttcgggcttggcggcttcc

SEQ ID NO: 71917 - DNA, 441 bp, Triticum aestivum
  Clone ID: PAT_TA_71917
actgcgagacctccgcgctcgtgggcaacggcggcggcgatggcggcatcggcgagcacgtccggcgagtggctgaagggcgccctgcaggaactgaggggccgcacggggagcgccctggagctcgacgacggcctcatctccggcctcgtctccttctgcgagctcgcgcctccgcccgacgcggccgactacctcgcgaatattgttggagcagaagctgcgcaggacctcattcaggagtacttgcagaggaggggctacattgacccctcaaaaggagctggaagctcgcagtcgtctaatcttcagccttatttgaagccatctgctgatgcagcaactgcccaaacaaagaaacagacacgtacacaaaaagatccagcatcttcttctagtcagagttccaagagtcaatcagatgctgctgacacccatgct

SEQ ID NO: 71918 - DNA, 625 bp, Triticum aestivum
  Clone ID: PAT_TA_71918
aatgcaccatgaagaccttactaatcctgacaagactcgcgatggcaataacaatgggcaccgcctatatccaggtcgaccctagcggtcaatgacattggttacaacaacaactaatctcctagctacaacagtcattatcccagcaaccacaacaaacatttccccaacctcaacaaacattcccccatcaaccacaacaacaagttccccagcctgagcaaccacaacaaccatttctccagccccaacaaccattcccccaacaaccacaacaaccattcccccagactcaacaaccacaacaaccatttccccagcaaccacaacaaccatttccccagactcaacaaccccaacaaccattttcccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctg

SEQ ID NO: 71919 - DNA, 648 bp, Triticum aestivum
  Clone ID: PAT_TA_71919
ccacgcgtccgagcctccggccacctccctccgccaccattcagccttcggccacctccctccgccaccacccgcctcgagccacttccctcctggctgcacgccccgcgaagaagacccgccgttcgccacctactgctggcccagctcctggagccactacatcagcgcacgcatgttcagtttcggtttgagttcaacttctgctgtctgtccttttttgcgtatgttcagttcgatatctggtggttcttcagaccaacatagtgtgccttttcaattcatcttgcaggtgaaaaaaggagctcccctttgagttcaaatgggttcaaaaaatggtttgctgcattacagttagtgtttttttgtgtgttgtttgtatactcgcagttactttttgggcatcattcgatctggaccatagttgctgcagggatctatttagcacatataattaaaaaaacatagttcaaataatattcccccaaaagttcaatatttagggttctgcgcgtgtccttacattagctaatcttcatcatgtccagataatgcctaaagtgaagagatttttttaattcaacttttgaacgcctttcagttcatcaacttctcggctgtcctgagttgcagcattgctgctactat

SEQ ID NO: 71920 - DNA, 223 bp, Triticum aestivum
  Clone ID: PAT_TA_71920
ccacgcgtccgcctagctcgcccgcagcgccggggacttctccctcccatcctccaccggcagccatggcgacggacctggcctacgcgccgcccatgaagtatggcaatctcgaactcgagggagccaaggaggtgaaggggaggaccgagatggacgtgggctgcaactgcgtcaacaacctcaagatggggtgctcggatctggtgtacgtctccatgga

SEQ ID NO: 71921 - DNA, 223 bp, Triticum aestivum
  Clone ID: PAT_TA_71921
ccacgcgtccgctcacatctcctactctcccccgccttcctcgcttctccggcctgccttcctcgagttgagttcggctggaatcgcggggtcttgcgaaccgtgcgtgctcgaggacgcggtgatcgcgagcgcgcgcgtccggactagcatggagcagaggagcctgctcgcctcggcggtgggcatgggcgtgggcgtcaggctggggctcgcgtcggcg

SEQ ID NO: 71922 - DNA, 465 bp, Triticum aestivum
  Clone ID: PAT_TA_71922
ccacgcgtcgccgcttcgccacgggaggtggcgaccagaaggttcgcatatggaacatgaaatccgtgagcaaagacaaccaaaatgatgattccaaccaaagattgctggccacaatgcgtgaccattttggatcagtaaactgtgtgagatgggccaagcatggacgctatcttgcttcaggatcagacgatcaagctatcctaattcatgaaaggaaagctggttccggtacatctgagtttggaagtggagaacctgcagatatagaaaattggaaggtcgttatgaccttaagggggcatactgcggacgtggtagatctaaattggtcccctgatgactcgacgttggctagcggcagcttggacaatactgttcacatttggagcatgacaaacggtatttgcactgccgtcttgcgggggcattccagcttacttaaaggatttacttgggatccta

SEQ ID NO: 71923 - DNA, 396 bp, Triticum aestivum
  Clone ID: PAT_TA_71923
ccacgcgtccgatctgctgtgtcctgttttagttaggttttgaagcagtttttgcttatcatcagggtttcttgttttagtcatagtcctgcatagtctgtagttaaatatccaaacaaagtggcaggtgatcatgcaagattgtattttcttctaactgagctaggtgggtttgtgttcctgtgattttctcttacctttgcttgtttattactgtttggtttgtgatatcttgcaagctcgcatgagactgtacattgctgaacttttctcactaccagcttcctttgtctttgtgttttccttttgtcagggtgaatagaaagcaagtctctttgctattaggaacctgatcatgcgaacgtgtcgtggcaatttgcattgattttatctatg

SEQ ID NO: 71924 - DNA, 500 bp, Triticum aestivum
  Clone ID: PAT_TA_71924
ccacgcgtccgccctcccagccctctcaggtcatcagcatttctaatcgttggatggtaacttttagtcgtttttggccgtccgattacctcttaatcccacatcgatgcttcgttccgatccgatcgagcgatagcctgatcgggccgctgctctggtggttttttggggcgtccgacattcaattgggcctactgggcctgtaccaggctcccgtgctgcaaaaaaggtaaaacctaaaacacttgatgcctcgcgagtcgctcacgaccctagctctctcgttcgctcgcagcctcgcgtggcggcgtctctccctggtcttccttcccgacctttcctctctctcacgacttgacggatgcaaacctcgatctgcagtgtccttctctagatctcaacttttagcggcggcaaccatcgcaaggctcgctcaacccctcccactagcagatcctaggtgtcctccccaaccacgacctcaacctagggcggaccta

SEQ ID NO: 71925 - DNA, 674 bp, Triticum aestivum
  Clone ID: PAT_TA_71925
ccacgcgtccggttgttaagctgcagctggcttgtgggagtcgcaggcttcctgttattgtcttgcactggtctgctgggtcagcaaaagacaccactaaaggcgggaaactttttgtatacggtggcgatgatatggggtctgaagaagttctgacggttcttagtctggaatcatctaatggattagagtcagtaagatgcgcgtcccgggtggacctcaaacttgatggatcctttgctgatatgattcttattccagatactggggttccagataaaatacgaacttctgcactttttatattgacaaatcctggacagttaaatttctatgatggtggtgctctattttctgcacggaaatcagaagaggaatatgctcagcctgaggcacaaaaatttccagtcgtagttcctacaattgatcccagcataactgttacggatatgtattcactaactgggagagagcatccaagtatttcactgaagaaattttgtgctaggcaaattgtcgcacctccaatatcagggaatatgaaatggcctttgactggtggggttcctagtgaaatgtcactgaaggaagatcatgcagttgaaagaatatatgttgcaggctatcaagatggttctgtgagaatatgggatgcaacttttcctattctgatg

SEQ ID NO: 71926 - DNA, 588 bp, Triticum aestivum
  Clone ID: PAT_TA_71926
ccacgcgtccgggaaaggcaaaggctggggtgggacagatagaagaagcggggggaggttgccattgatagagaccacgagctcttctccaagccaccgctctgcaggactcctcctgaccctgcttgctgccccctggatctcggccctgcccgctgccattgcctctgctgccactgcccacccccctggccacctacctacctactgctctacgactaccaccacacttgtctccagccgctcggattggatcgcttcggctcgagccccgtccgtgcgtcagcgggctagagattggattgctgagtggaattggggatggagaagaggggtggcactccatcgccgtcgccgaggtcgacggagaagtccgggaaggacttgacgaggtcgggggacgccaacggcggcgcgggcgccggcggcaacgccaccccgaaaggcgataaggagaagggagtcaatgtgcaggtcatccttagatgcaggccactgagtgatgacgagacaaaggggaatactccggtggtgatatcgtgcaacgagcgccgccgggaggtcgccgccacgcaggtcatcgccaat

SEQ ID NO: 71927 - DNA, 568 bp, Triticum aestivum
  Clone ID: PAT_TA_71927
ccacgcgtccggatctggtggccatcaggcagctgctgtcgccggcggtggtggaagttttgaagcttcttaggtgcagggctacgcgcgtcgtcgtggctgtattcgatgatggacgaagaagaggagaaagagggtttgtctgatggcatggagtgtgaggaggagatggaagagagcttgccggaggcgggggatctacgtgttttgccagaagatcagccggtcattacatctcgtcagtcagtcaagcgtgttgtagatgcagttagcaaatttgatgaatacaagagatggctcgtatctgagattggatttggtggaatcctgaagttgccgatgattacaaggatggatctgaaaatgagtgtttgggtcatgacgaaggtaaatgctcggtgtcacgtaattgaaatagatgatgacaagaagattgctttcacagtcgaagatttccacaaggtattcgacatcccgtgtgggaaccgatacgtgagtggcagggatgcacaaattgctgctccggcaatccagttcataaagcgtacaattggtatggatggttcag

SEQ ID NO: 71928 - DNA, 678 bp, Triticum aestivum
  Clone ID: PAT_TA_71928
ccacgcgtccgcgcactgtatacattgcgtgatggtcaaaggagaaaacttgatgaatggagaacacacaaacagtaagctgtggctcattgacctagccggaagtgagcgtgtggcaaagacagatgctcaaggcgaacgactgaaagaagcacagaatattaacaagtccctttctgcacttggagatgtcatatctgctcttgcaactaagagccagcacatacccttcaggaattcaaagttaacgcacttgctgcaagactcactaagtggagactccaaaacattgatgtttgttcaaattagccccaacgaaaatgacgtgggcgaaactctctgctcgctgaactttgcgagcagagtgaggggaatagagcttggacaggctaggaaacaagttgatgttggagaactgtcaagatataagcttatggttggcagagccaaacaggactgtaagagcaaggatgctcagatcaagagcatggaagaaacaatccaatcccttgaagccaagaacaaggcaaaggaccttctcaccatgaatctccaagataagatcaaagagttggaatcacagctgctgattgagaggaagatagcgcggcagcacgtcgacaacaagatcgcccaagacgtcgagcgaaagcagcagcagcagcagcagcagcaaag

SEQ ID NO: 71929 - DNA, 308 bp, Triticum aestivum
  Clone ID: PAT_TA_71929
ccacgcgtccgcctcccgcactcgcgccgcccgggtgcctcacctctctctccccctcaacccgcgacctaacccccgccgtcgccgccgccctcctgcctacaagccctaggcccctgccggatccgcccctccccaattcttcgcggccaagaagcggaggccctcgtcgcagcatgggagccccggggccgccaaggggtccctggtccggtcccctcccgccgcggcggcggtggcggggttgtcgtcggccctggccggctccccttaaggcgcccggagcgagctgcgcgcggagccccacg

SEQ ID NO: 71930 - DNA, 643 bp, Triticum aestivum
  Clone ID: PAT_TA_71930
ccacgcgtccggggatggcgtcgggcctgcctggccgggggtgtacagcactatggtcgatgtgctgtccaaatcagggaggcttgacgctgcgatggggatgtacagggagatggtggcagtggggcacagggtgagcacggctgtgagcaccaccatggtggaggggcttgtgaaggctgggaagctggatgcagggatggagctttgggaggagatgcggcgaggagggctacgaccaagctttgggttgtacaccatggtagtcgaggcaaatgcacggtcagggaggctggatgtcgctgcgaagctgtttggtgatatggagaagtctggcttcttccctactcctgccacatatgcttgtttggtcgaaatgcatgcttcagcggggaatgtggatgtagcaatgaggatgtaccactcgatggcaaatgcagggacaaggccagggctgagcacatttacagcattactgaccatgctggcgaataagaagctgcttgatttggctgcaaaggtgctgcttgagatgaaggcatcaaggttccccattgaagtgaccgcgagcgacctgttgatgatttacatcaaagatgggtcgacggagcttgctctccggtggctgcggttcatgggttct

SEQ ID NO: 71931 - DNA, 599 bp, Triticum aestivum
  Clone ID: PAT_TA_71931
ccacgcgtccgcggacgcgtgggcggacgcgtggggtctttcggatttttgggctttcatgtgagagttgtggttgcctcaaattaagtgagatcgaaacttcatatgtattgcctttttcttttgctactgctatggatgatttttttggagatttcttgtcaacaaatataggagagagatagattcctagagaaacacactggatgattcaaacatgtttctgcatctttgatttctttcaagatctggtgttcagctgtcagacaagcatgcatattgtctgtttacatattgaattttttcccccgcaaaaaaaaaaacaagcatggttggtatcaatcgaattaaattctctgtttacaaaacacaaatgaacacatgattggctaggcgaagatagacaagtttcagtcagattacttactaataaactctatagttttcaatggtaaatttctttactcctacagtttgtacacagctaagtcggtgctatccctcaaccagcatgaaaaaaagacatgagaatgccctattaattggattgtttctatctaaataagcaagataatttaacaatatatcagtgtctcctt

SEQ ID NO: 71932 - DNA, 212 bp, Triticum aestivum
  Clone ID: PAT_TA_71932
ccacgcgtccgcccatggacggcgacgactgcgacgccggcggcgagtggatctgggtgcgtcgaccgcaggaagcggaagctgcggctgcggcggcggggtggccggcggaggaggcgcggcctctgaaggtggtgtttgggtccccagccaggtacttcaccgacgcggcgccgatcgggaacggccatatcggcgcctaggtctggggc

SEQ ID NO: 71933 - DNA, 527 bp, Triticum aestivum
  Clone ID: PAT_TA_71933
ccacgcgtccggctcttcccgccgccacctcctgccccgcgccgcccgccccacaccgcctcgatcgggaccgcgtccctccccaaacgacagcgatggttgagggcgccgcccaactcctggccgacggattcgctggctccccgctcctcggggccagcccatcctccgtgtcgggtcgagcatcgacttggaggccacttggggctgccgccggtgcgggagtcccgtgcagccgtgagggctggggaccgagcggcggggcccgtggtgcgacgcttgatggatggcctgcacagcgtggacgactgcttatctcccgggagggccataggcagaaacttgtcctgtcacgcaggtgctaccaatctgcatcaaactgttgggccatgagaagaaaaaggttccatgagggtgtctattttcagaactggagaaagagctcgcctaccatgcatgttgcctggtccgatgagctgtgctacgccgagtgccctgtcacagtgcagccgcacagcactgcccgc

SEQ ID NO: 71934 - DNA, 199 bp, Triticum aestivum
  Clone ID: PAT_TA_71934
cccacgccctcctcctctcgcccctccccttcccactccccacagcgacggtcgacggcctcaccgcggcgcaaaatcccccaccaccatgaagccagcgaggatgttcccgtgccggccgctggtgtccccgccgctaccgcgggccctcgccgccgcgccgcacgtctccgtgcggcggctgccatggccatcgacg

SEQ ID NO: 71935 - DNA, 664 bp, Triticum aestivum
  Clone ID: PAT_TA_71935
ccacgcgtccgcggacgcgtgggaggacggttgacatggcggctcccggcggctccgatggagcacccaagggcagagaccttcctcagccctccagatccagatccagcataaacagtaccctgggtaccaaattagaaaatgcaaagagaatatcaatagaacatttggaaatcatcacggacaatttctcccctgaacgggtaattggtcgaggcggatatggaacggtctacaagggggtgaatagcgacgggaaatatgttgctgtgaaggtgctccataaaaacgcgacaggaactgacaatggtgaattcaaacatgagtttgaaagtctgatgaggctcaagcatcacaacatcatccagttagttggcttctgctatgaaacacgacataatccaatgttgcacgatggagaaaccatttttgctgaagatatatacaaagcgctctgctttgagtatatgcaaaatgggaaccttaaagagcatatttctgtggaatgtgatggtcttgaatggaacacgcgctacaaaattatcaagggaacttgcgaaggactaaattacctccatgaagaattcagagaaccaatttaccatttggacctaaaacctgaaaacatactgctagatgagaatatggtaccgaaacttgctga

SEQ ID NO: 71936 - DNA, 596 bp, Triticum aestivum
  Clone ID: PAT_TA_71936
tcattatggatctatgtacgtttgaagtctctgggtcttgaattaggcaataaaacgtgggttgtaagataattgggttcataaattggtcttcggatttataattttgttttttgaattggaacctcatgattccatgacttaaactggctcagcaacatcgctggccaagagtacagatacatcgttcggcaggtcgtccaactacagccggtggggcacctgaccaccactacccattgcagcaagggcgttggctaccttattacaatcacgaggagtacaagaaaacatcacattggtgaagttcaatcgaataaacatcacattgggatatatattagcttcaagagtaacagttgagctcaaagaagacgaagcaaacattataactagtactgagatgagaagtatctcaggtctgtagttgcagaatcaggatggatattataatggattttcccatttgaattgggtttcaaagatgagttgtcgcgatatgtattttctatcttcttttatttcagttcataaaacatatagggtaattagtattacttctatatttctgtccacttaaactcttactgatttat

SEQ ID NO: 71937 - DNA, 243 bp, Triticum aestivum
  Clone ID: PAT_TA_71937
ccacgcgtccgggcgggcagagacggaggacgccggcgagtacgcgcggacggagcagaggtacgagctggccgtgtccgaggagcccaacaactcgctcatcctcgccaacttcgcccaattcctctacatcacgcggaaggaccacaagcgggcggagcactacttcgagcgggcggtgcgggcggagccggcggacgcggaggcgctgagccggtacgcgacgttcctgtggagggcgcg

SEQ ID NO: 71938 - DNA, 590 bp, Triticum aestivum
  Clone ID: PAT_TA_71938
ccacgcgtccgaacaccgtaatccccctttgcaattgttgcatgcttgtacgagtgtgattataaattagtaatttcttgtaagtatgtggtgttgatgtaagacttgacatctctctgtgttctttcttagagatgtattatacaatttattgtctgagtaatctactgtcctctgtataatttgcgttggataaaaaagttatatatagttccactcactgatgtcatctgattttttaatgctattattgtttcaatagatggaccaaagaacattatgcttacagtattacatgcattattatcactactacatgtggaggagaagattgcttgctgccattattgtgtgtttagggatgtactggtacaagattaatgtccgaaaaaggaagagaaaatctataacttatgctcccatgttcgaacgagatgttgaaaggatgtcacgcctgaaccgcatgtattatggaaccgaggctaattgcataagtgagctgcgcatgcggaaatttgtttttcacaaattgtgtgccaacctgagacgtcgtggtctactggtagatacattccctgtaactgtggagg

SEQ ID NO: 71939 - DNA, 559 bp, Triticum aestivum
  Clone ID: PAT_TA_71939
ccacgcgtccgcccacgcgtccgccagaggcctccttgagcgcttccttgcctgcagccaccaggacgccatggatgcaccaactcgactcgatcccggcaacctcgaccctgcgctgactatcgcctctactccggtcgccctcgcgtctccaggccgccgtcacgcactctacctcctctgccccgagctccaagcgccgccccatgacgcccatggccccgcctctccttcacgcagctctgcacgccgccccgcctccaagttcgtcgccaccgacagcaacagcaactactgcaccctctcgtcgcccgcgacctcctcctcctggctctgctcgggtctgccgaggcccatcgcctcccgatccggcgacctgcgcccaggtcggccctccttcgcccggatcccgccggaccagcttcccgtgacctcctctgcctccgatccggtcgctcaccaccgcctttccacgctgctctaagacaccaggtcggccgcccgctcgcccgtcgttctgcttcgttggagcagagaaccagcgccgcccttcatgccc

SEQ ID NO: 71940 - DNA, 331 bp, Triticum aestivum
  Clone ID: PAT_TA_71940
ccacgcgtccgcaggccgccaatggaagacgcgacgaagcggaggcaccagccgggcgctctccccgcgcgccgcaaggtcgtggaggagcccttcgaccccccgccgcctccccccgccgccgctgccgcggcagcgacggtggcctcaccggcccacctcgtcggcgccatcgtcgagaagggcttctccgccgccgcgccctcctccgccccgcgccccaccgtcctccccttccccgtcgcccgccaccgctcccatggcccccactggaaaccggtggcgaaggctgccgacaagaagaaaggggagggggagggggaggaggatg

SEQ ID NO: 71941 - DNA, 472 bp, Triticum aestivum
  Clone ID: PAT_TA_71941
ccacgcgtccgtaaaaacggcagttaacgataacacacaaagaatattcaaaattgtgtccagaagtgatttttatatgcaaactgcccccttagagtatgcaatcaagcaaacagtgcattttgtctgttaaatgcttaactcatgtatggtgaattttacctattcacatccatgctggttttgtggtagatttctttgggagaaaaatacatttggtggcactcaaatatcactttggtgggggagtggatgtttaatcccaccacctgggttcaagtctccgtggactcagtttaagggtctctgcagtttccttaaaggaaaacattagtttagttcttggcactaaacttctccagtacactttttagcataaaattctaaccccccatgcattctgaactatgcatttagcgtgttttcaataatgtttcctagccaaaacatgtacgacatacgggtcctttat

SEQ ID NO: 71942 - DNA, 167 bp, Triticum aestivum
  Clone ID: PAT_TA_71942
ccacgcgtccgcccatgcgtcaataaatcggagaatgggaccgagcccagcgtcgcggagagcatcggcatgtcaatcggtatggctgtcgtttacactggcgagtacgtggactattacttcaagttttccatgcaacctgcacaggatcctgtacaggatgctct

SEQ ID NO: 71943 - DNA, 692 bp, Triticum aestivum
  Clone ID: PAT_TA_71943
ccacgcgtccgggaaagtaaggcagcaacacttcgagaccatcactggcttagtacgtgcctctaggactttctttcctgaaggtgcagctgctgagatttggttggaattcaggccgttgctggaaaatccatggcataactcagcatttgaaggtgttggatttgttaggctgtttctccctgcaaacccgaggaaccaggatcactttacgactgattggattgcacaatgtctacacatttgggactctgtcacaaattgtaacttctgggatatccaatgggctgccatcatagcacgttgcataaaaaattccagatccattgaatgggagaagtttctgccgctattgtttacaagatacttgaacatgtttgaggttcctatatccagtgggaatgggtcgtacccttttccagtggaggtgcctaggaacacaagatttttgttctccagtaagaccagatcaccttccaaggcaattgcaaagtctgttgtgtaccttttgaagcctaaaagtctggcactggaacaatttgagaagctcataaattttctagaacaattctatcatccatcaaatgggggtcgctggacctactcattggagcgttttctgcggtatctcgttttttactttgaaagacgtcttcaacatgaacaatttgacacaatggatgagaaaaatg

SEQ ID NO: 71944 - DNA, 259 bp, Triticum aestivum
  Clone ID: PAT_TA_71944
ccacgcgtccgggaaaccaacgcaacacatgggcgcactccacgcatcatcgctaagccggatccatcatccatggaggccctcacgctcacctccctcctcaaggccgccgccgccgccttccccgaccgccgcgccatcgccgtccacggcaagatcgacctcacgcacgccgcgctcgacgccctcgtcgacgccgccgccgcgcgcctcgccgccggcgcccacgggctccgccccggccagaccgtcgcgctct

SEQ ID NO: 71945 - DNA, 710 bp, Triticum aestivum
  Clone ID: PAT_TA_71945
ccacgcgtccgcacaactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgc

SEQ ID NO: 71946 - DNA, 386 bp, Triticum aestivum
  Clone ID: PAT_TA_71946
ccacgcgtccgcaacctcttccaatacctgacatggcttgagctcacataacaatggatttcatctctgcacttcccaactcgcaaggcaaagaggtgattctggtagtagtagacaggctgaccaaatacgctcacttcattccactggctcatccctactcagttatgaccgtctttgaggcactgatggacaatgtcattaaactgcatgggcttcctgtttgcgttgtatctgacagagatgctattttcaccagctctctgtaccaggaactattttcagcctttggagtgcaaatcatattcaggaccgcatcacaccctcagaccgatggacaaacagagcgagtgaatcagtgtcccgaatcatatttaagaggcatg

SEQ ID NO: 71947 - DNA, 274 bp, Triticum aestivum
  Clone ID: PAT_TA_71947
ccacgcgtccgggagtactctctgcctcttgagtgcaggaaaatgcctcaattaattagtttgtcgctccgttagtcgccatggtcagatgatgcttcaggtttgcacttcacattgaggtatagaagagcactggtagcaaccacatcatgaaagggtcgacgaacgacgatccgatatgcgttgccgagagtgaagctcatgggttggctccctcttccccatcggacctggcaggaggatgagcgcccttccccgcgacctgccgcacacc

SEQ ID NO: 71948 - DNA, 160 bp, Triticum aestivum
  Clone ID: PAT_TA_71948
aacccacccgtccgccccaccttccggtcatgaagggaatctaccgagctagctcgggatcatcgggccagcatcggccgcgccatggactcatctcgagtcatcctcatccccggcacgccgccgctgccggacgcctacgagcagctgccgccctcct

SEQ ID NO: 71949 - DNA, 238 bp, Triticum aestivum
  Clone ID: PAT_TA_71949
ccacgcgtccgcgacccacgcgtccgcttgccgttgtcgcgcgcgcgcgcatgcatcaagatccgcgacctcctcgatccaaatccgacccgtccgtcagacacacggccgcacgcggcacgcgcccgcccgggctccttccccctctcgatcgcctttccgcccaccctggcctctgcctcgtcgcctcccacctcttctccccaccaccccatggcccgccccaaaaaggccaagg

SEQ ID NO: 71950 - DNA, 191 bp, Triticum aestivum
  Clone ID: PAT_TA_71950
ccacgcgtccgagcaaacccaaatcggccgccgtcccctctcctcctccgcccacccacgccgccgtcgccgcctcctctccagatcccgaccatggagggcggcagcagcagcctcgacgcggcgatcgagtcgctcctgaacacggagaagcagtgccgcctcgccggggatgtggccggcacccggaa

SEQ ID NO: 71951 - DNA, 215 bp, Triticum aestivum
  Clone ID: PAT_TA_71951
ccacgcgtccggctgcagaatacgtactcctcgccccccccgccgccgtcgccgtcgccgcctcgctgttgacggcgagcagccgcgtctcagcggcgtgggagggagggagggctcgctccgggcatggcttgggcggcgctgaggccggtggtgaaggcctgcatcggtggctccctcatcggcattaccgtctacgaccgctacttttccgt

SEQ ID NO: 71952 - DNA, 461 bp, Triticum aestivum
  Clone ID: PAT_TA_71952
ccacgcgtccgacatggagttcgacacggagctgcaggcatacgacctctaccgcctctacgccttcaagctcggcttcaacgtccgccgccgctacaccaaccgcagcaagacctccggcgaggtcacctcctgcaagttcgcctgctcccgcgagggcttcaaggaccacaagcccgccgccgccatcgccagcaccgccaagctcccccgtgccgccgccaggctctcccgcgccgcggccatccccgcgccggacggcaggaccggctgcaacgcgcacctcaccctccgccgcaccaagcccggcggccacttccaagtctccgccttccagccgcgccacaaccacccgctcttcgccgctccccgaggcccgcccagccccttccactcgccgcccaatgccgctccgccgccggatttcattgacgacgatgctacagccggggcggcatgcg

SEQ ID NO: 71953 - DNA, 195 bp, Triticum aestivum
  Clone ID: PAT_TA_71953
ccacgcgtccgcccacgcgtccggctgccagcgactcgaacggatccacccggccggccggcggcgaccatggaggaggagctgcccgcgctgctctgggatcatcacccactctgtcgtgtccccgaccccgcctccatcgaccggatgcgagatcgcgtggtgaagatgatgggcccgtccggcgccgttgcc

SEQ ID NO: 71954 - DNA, 599 bp, Triticum aestivum
  Clone ID: PAT_TA_71954
ccacgcgtccgcccacgcgtccggagcaattgtggagcactaaataccatgtgtgtaaaaaccaagagcggctgaacttatgtgaaaatcacgttctggagcaagctactacttataatattccttggcatgagaaattgcaggggggcatgaagaccatgagcatgtcagcaaattggccacttttggttcagagggaatataagaggagtggccatcttgttaagaaatgcaatgctaaacaaatacctgggggttccagagctagaattcacctaactatactactgatcacttttaactgttgccccccatttggtgcaaaaatgcttggtggaaatgcttatcacttgcttatgatacagatcatcgcaacccttctgagcgatttaccagcgaaatctattggagctgagttgcagcaacatgttacactgcctgggaattattttgcattgtttcagccgaagtcccgaaggccacttcatatcattgttttcgctcaggtgtctttgttcagcaagcaggccatagctgaatctctgcatgacaagacgtccccttggccactgattaaatttgaggttcttgtgctacct

SEQ ID NO: 71955 - DNA, 146 bp, Triticum aestivum
  Clone ID: PAT_TA_71955
ccacgcgtccggatttgggccccattgtgcgggatgctttcgagtccggaaggcctgaggctctcttccacaacctcaggggtatctccaagaggaaggaggttgagatcgaggagctctgtaggcttcactacaaggaattcatc

SEQ ID NO: 71956 - DNA, 534 bp, Triticum aestivum
  Clone ID: PAT_TA_71956
cacccacgcctccgaggcaagtccgtgttcttcagggctacagggcacattgccttctcaaatttgtgaggacagaggtgcctcttaggtttgtcaaatggtactgtccaaatttgatcttgcttcagagattcagattaggaagaagtttattccgattcccaaatatgtcaaacatgacatcttagatcttcctgttgatggtgagcccattatgtccgatgctgacgctggacgtgagttcatcttgtgccatttcaatgtgaccagcatcccaccggtttctttcttctgcaatacactcaaatctgaagaattgcctgatgaagacagtttcatctgcttcatgtgtattgccttgtccactttcttgtgtccaaattcaagcctttctcctagtcccaaatatctccacattttcagagattgtagttctgtgatgaactatgatttatctagattggtatatgagagtctccttggcaatattaagaagtttaaggattctatgaaggttgcttctatgagatcaat

SEQ ID NO: 71957 - DNA, 416 bp, Triticum aestivum
  Clone ID: PAT_TA_71957
ccacgcgtccgaagcgcatttcttttccctggcccctctcgctctcgcttgcgtgtgtctccattaactccctcgccattacccgcctcacgccccccagcaatgccgccgtggacggtgcgcgcgcgcggccttcagcggtgctagctagatccaccgccaagcggacccgggtccggacagcggcggcggcgggacgaggagaaagaagagacgggtgtggccgtgagaggcgggcgcgcccaatgcacgagcacaccctggccagggcgtgggaggcgacggtgcgcaaggtgcagcagcatccgcagcccgggggcaggcgccgggtggcccccatgctgcccgccgacgactccgagacggcctcctcctccgcgggcgtcgacgatgccgaccaccacggtccggaggag

SEQ ID NO: 71958 - DNA, 595 bp, Triticum aestivum
  Clone ID: PAT_TA_71958
ccacgcgtccgattgaaaaatttaattttatggtttttatattgtaggatattcaatcttagtatctgatgacgtattttggagtttcgaatggaagacatcattttcaagtaattttattcgttatttccttgttattctaagcatttgacggctatgttttgtatttaattagtcttctattatgtcaggtataagttataaaacacacttttatttactattgtcgttacttgaaattttacaccatgttaaagtggtgcatcagggtaacatttgctccagctccgcccctgctcacctctacttccttgcccgagtagtgccatgtaggtcctttgcttcatcgccagagcagcaccacatcctctgcttcttaatcaaccgtgatttttatttgctattcccatgatattcctactactattttagtgtttgcatttcatgaaatgagatgtttcaattcactatttctactgtgctagattttattcctggtctgtattgtatatccctttacgtgtactagataagaacggtatgcattttgctactagatattcaccattaatagacgtacactttctttcgtatg

SEQ ID NO: 71959 - DNA, 692 bp, Triticum aestivum
  Clone ID: PAT_TA_71959
ccacgcgtccgcacgtatcctcatctgggggggccattccggagcttggaggaaactgaaaaggctatcaaaagccatcttgatggcctgcgctctccaataatgtgttttttctcaactttgccatggatttctgcatttcagaaattacaatctactaacatatagtgtgttctaacctcaaccaggtgcagagatgggctatcgtcggcggaggttgcagtgcgacatcgcctttactggcctgatggcacaaggaagaagtcgttcgaaggcaatcccgggcgtaggaatatgaacctattggttcaagctttactggataaatacaatgaagaccaccatcttttgggggtttgatctctctccctcctcccgccctcactctttgtcctattaccaggcttgtattggtcgtcttctgttcatgtactaattgctgatacaatccatgcctcctttttagaatcttgcatatgaacttgataatgttgtgtgctcccgacaaatttacgagaaggagggcggccttattaacaaattctatcatatcaatttgactgcaaaaaccaaaggagatgatggttttcacgtcgacaatctattctttggtgaaatcacacgaatagaaggcgaaaatgaagaatacatgctcaattgtttctgtatggttaaacctattgacaatggta

SEQ ID NO: 71960 - DNA, 580 bp, Triticum aestivum
  Clone ID: PAT_TA_71960
ccacgcgtccgcattccgccccgtcccccacggaccgccattccggtcgggatcgcccccctctccccctccccctccctccctctccaccctcccgccgccggcgcagatcccgccgcgcgccacccctccggtgccgccacctccaacagcctcccgcagcctcggcgaatcccgctctgctcctccgtccattcctcccggaaagatcgggttttgacgccaacctcccgcgcctcggccgccctccccgtctccggcggttccccctgtttaccccacaagatctcggcccgctcctcgatctgatctcgcctcggtccgcgggagggacagctgctccggtgcgacggttcgggagtcggtagaggagatctccgtggccgcgatccccgcctccattgcctgaagccgcgccgtcttcgtggcagccaggggcgtgttgctgggtgcggggggtggccgtgtgtgagctctgcctgtggctgccgcgcattccatgaatggatgggagggagtcgaccgcgacgtcggggcccaactactcgcccttctatgtgcagcaccggggcatgggccc

SEQ ID NO: 71961 - DNA, 197 bp, Triticum aestivum
  Clone ID: PAT_TA_71961
ccacgcgtccgaaaatgagcagaagtactgcgccatggttgaatcatccatgttagtcaacgaatcctactgtaacaacaattaatacagcgttgtgcgccatcatgtgtcactccgtgatggactaatgaggacctgtgattaaatgaccaacggcttcgttgctgaggcctgaggatatggagatgaaaaaaaag

SEQ ID NO: 71962 - DNA, 590 bp, Triticum aestivum
  Clone ID: PAT_TA_71962
ccacgcgtccgggagacctgacccggcctcagaggcagggccagggcgaatacgtatccccaacggccaagacacggccacggtggtgatttttgatggtgagacagagcagactcgagcgactttgcccaaccagtgcaaatgtgttctttgataaactaaacttggtgaatgtacaatcaggaacagccttcaagccttatcatgcaaaacatgcaggaaatgatcgttgcatttcagagggacttgaacatgaggaattaccaaagtaaactttgtttccgtggctaacggcaccaacctggttaacttataggctggagcacataaaagataataagcgtttattcgctagctggaattaaaggcaacggcgagagaggaagatcaaggacaccttcaataattaagaatacatgcaaggacgtgttttcgccggatcctggacgtgtccgcatatccagcgcgacggcgaagtgatggatggcgtcagcgacctaatccaggaccagcgcggatcagcgccggatcgtccacgtgttaaactcggcggcgaattgatggagggcagcggcgagtgatgcggggcg

SEQ ID NO: 71963 - DNA, 258 bp, Triticum aestivum
  Clone ID: PAT_TA_71963
ccacgcgtccgtatacttatccatttgaatcaggttaccatgtgcggttctaaaaacatgatacctcacaatgtatcactaaaaaaacatagagccatttatttgttctgttacgttacctccttcaattctttgtttaataaactatcaagctgcacacatatatatcttcttctgtttcatctacatcgggagccaatattttgctcagcggtatctttccccccctcttggtttcggtgttgttttaatgacccg

SEQ ID NO: 71964 - DNA, 450 bp, Triticum aestivum
  Clone ID: PAT_TA_71964
ccacgcgtccgcggacgcgtgggcgccccgccccgccacccagatccgcccccgcctaggcagaggcagcccgagatgctcgtccaggaccgcgtgctcccggagcacgccgggagcaccaagtcgcccaggtccccgcgcgccgcgccgggctccgaccggcgccacccgcggcccttcgccaagagcctcgacttcagcaactgggcatcggagcactcctccaagctcctcctcctcctcttcgccgtcgcctccgtcgccgccgtcttcctcctccgcggcgccggcccggacgccgctgcgctcctctgcctcgaccgctccagctcccgctccgcctgcggccccaccaagctcccctacccggacgtcgcctggtccaaaatcccgccgctcgccatcgcctgggccgtccacttcgcctccttccgcgccgagaggtggatc

SEQ ID NO: 71965 - DNA, 312 bp, Triticum aestivum
  Clone ID: PAT_TA_71965
ccacgcgtccggcgacctaccagcgccgcccggccaccgccgcgccctgtcacaccctctccgtcggcggcctccctccccatacccctgcctccccccgtcaacttacattcaccagcccctctacttcatggacattaccctgtaccccgttcgatcccaagcttgtatgaacatccgttcatacctcaactttgaaaacccctttaccaagactaatgttcaagcgacgcctgaaagacatgttgactgatgtgaaagtggaaactgccgaccagaataaaggaaatcggaaagatttcaattcgtatg

SEQ ID NO: 71966 - DNA, 174 bp, Triticum aestivum
  Clone ID: PAT_TA_71966
ccacgcgtccggtgactagctcggatgggatgtgcgtggtcggtggatgccggggcggcggccccggacttggtggacggcgtcggctttgcagcgagtggcgtcggtgggtgctgtactgtgtccttggccgcgcgggcggcgaggatgcggtgtccatgcgccgtggtgtgc

SEQ ID NO: 71967 - DNA, 323 bp, Triticum aestivum
  Clone ID: PAT_TA_71967
ccacgcgtccggcgaggtagatctagcgcggggatgtaataagatcgactgacggggacggccatggctcggcgaaccactagcgtcactgccgccgccggcctcctaatcctcggcgccagttgcgtcttcctgctctcggccgcggacggcgacggcgggacaatgcggtacaacgccatgttcaacttcggcgactcgctgtcggacacgggcaacctctgcgtgaacaagtcggcggcggaggagctcctgctcaccttctccaacccgccctacggcatgacctacttcggccaccccacctgccgctgatccgacgg

SEQ ID NO: 71968 - DNA, 593 bp, Triticum aestivum
  Clone ID: PAT_TA_71968
ccacgcgtccgagatggtggtttcagagatgcttgcatgaccttgcagcagcgtcctctttcagttcttgagggtgatctgcaaaacctcttggaactattgcaggtcttcaagaacaaagtagaggaacaatgttcaaaagctgaagatcttcgaaataagatgttccaagtttctgctaggcaagcttatatgaagggaattctcactcagtcttcagatactcagtactgggatatatggaaccgccagaatttgagtccagaatttgaggcaaagaggcaaaatattctcaaagctaatcaggatttgacaaatcagctggtagagctggagaggcacttcaataatctggagatgaacaaatttggtgaaactggaagagttgcttcaagtcgtagagctgtttattccaacaagtcacggtctagtcagacacagttatccagcgtgtacaatgcactgaattcgcaattagcagcagcagagcaactatctgaatgcctttcaaagcagatatctgcactaaatataagttctccttctaagaagcgaggggcagtgaccaaagagttgtttgaatcaattggtct

SEQ ID NO: 71969 - DNA, 231 bp, Triticum aestivum
  Clone ID: PAT_TA_71969
caagggccgtgactctggatatggtaagcgtaagggtaccagggacgctaagctccccaccaagatcctgaggatgcggatgatgcgcatcctgaggcgcctgctgcgcatgtaccgggacgccaagaacatcaacaagcacatgtaccatgacatgtacctgaaggtcaagggtaacatgttcaagaacaagagggtcctgatggagagtatccacaagtccaaggctga

SEQ ID NO: 71970 - DNA, 655 bp, Triticum aestivum
  Clone ID: PAT_TA_71970
ccacgcgtccggacggcaggtaagggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggccaagcgcgccaagagcaaggcaagcagggagaggaagcatgccaggagggaggagagattggctcagggccccagagatcatgcaccagcaccagcggctgcagctccagctccagcagcagcggc

SEQ ID NO: 71971 - DNA, 559 bp, Triticum aestivum
  Clone ID: PAT_TA_71971
ccacgcgtccgctaacaaactccccgcatttgctccgccgcccagcccctccctcccctcctccagttctgcccctcccactccctgctcgcgcccttcccctccctcgccggatcaatctcttctccggcagactggacggcggggtgccaccccccaaatctgctctgtttccaggggtttgtggaggttgtggattaagcacggatggggccctcagggctcaatccgcaggcgaatcctgccattaaccaagagaattggaccccgggcgtgtggcctgagagcggcgctccaggccttcctggcaacacgcccttgttcctgcagggcgatgcggcggccaccataggctggcaaaatcttgctggacccgggatcagccatgcctcggcgatggtgaatgctatgcgcgggggtgccactccgatgagtggcgctgcccaacaagatgccgggtcctccgtccggccgccctgtaacctgcctgcagggtgctgcacgcaggtgccgataagtatcgtggtgttccataggagggcatccaggcctgtgccgc

SEQ ID NO: 71972 - DNA, 630 bp, Triticum aestivum
  Clone ID: PAT_TA_71972
ccacgcgtccgctcatctctagcacaatgatccatccttcacacaactcgagcaccatcatccaccatgaagaccttactcagtcctgacatagtgattcgcggaggcacctaactacgcagcagccgggaatatacaggtcgatgggtagcggacaagtacaacggccacaacatacaacacccattctcccggcccaaacaacgatgctcccaacgacgagaagaaatttttcgccaaccgcaacaaactttcgcccatcacccacaacaagcatttcctaaaccccaacaaacgttcccccatcaaccacaacaacaatctaggcagccacagcaaccacaagaacaatttccccagccccaacaacaacaacaaccatttccccaccaaccacaacaacaatttccccggccccaacaaccacaacaaccatttccccagccccaacaaccccaactaccatttccgcaacaaccacaacaaccattcccccagcctcaacaaccccaacaaccattgtcccagttacagcaaccacaacaacctttaccccagccccaacaatcgcaacaaccattctcccagcaacaacaatcattgattcaaccatacctacaacaacagatg

SEQ ID NO: 71973 - DNA, 673 bp, Triticum aestivum
  unsure (1)..(673): unsure at all n locations
  Clone ID: PAT_TA_71973
ccacgcgtccggattacacacacagagatccacaaattaaccgagagagagggagggagagagagagtagccagacatgtcctccacaaagatatcgattgccactatcatggttctagtgctttctcttcaagccatcattgacgccgaattgtcttatcatggaggctatgaatatatgtgctttcctagttattgccagtgtgaaccgaaaaacaatcttcaacttgggggtggcgaagccatcgttgttaccaacaccctatcttgcaatgttggccttgcatatatgtgttatcctgcttactgccaatgtagaccgaaaaacaatctccaacatgaggattaccaggccatggtgccaaggcccaagaggagcaacaccatctttccccaatacaccactgttagtggcttcattcggcgttcaagctatgccaaatctaattaggtgaccatgatcgtggggaagaaagaggacaacgcgcctaatgacagagtctagtgatgtgttttcccaccagctacatgctatttagggaatgatcaaggagtagtactgaggccccccaatgctccaccttgtacaggtactaacggtgccatgtangtaaaaaatctgatgtggcaaggttataaagaggagagaggtgagtttggtgaccacatgaag

SEQ ID NO: 71974 - DNA, 659 bp, Triticum aestivum
  Clone ID: PAT_TA_71974
ccacgcgtccgtccaaaatgtgatatcctattgaacaatatgtcggaagtgtacaacagctacatattggaagcaagggaatttcctgccatttcaatgatggaatgcatcaagggtaagatcacggcaagacatgacaacaaacaaagggaagcaataaagtggactggaaggatatgcccaaaaatcaggaaaaaattggagaaggaaatagaactatctgctagttgttttcctagtcattctgggttgggagtgttctctgtgttatcagggaacaacacatacacggtggatattgtggcattgacctgtgattgcaagagatggcaactaagtgggataccttgcagccactcaattgcatgctttagggaagaaaggatagatctagaagagatggtccataagtgctacacaatagatacatatctggaagcatatgggcacaatataatgccaacaagagtcagggctctttgggagcaagtggaaggtcctatcattcatccaccagtatacaagaagaggatgggaaggccaccaaagaacaggaagaaaacacctgaagaaaaacttcagaaggatggcagcattgctctgaacaagaaaggtgtgagtatgcactgctcaatttgtggaaaagcagatcacaacaa

SEQ ID NO: 71975 - DNA, 421 bp, Triticum aestivum
  Clone ID: PAT_TA_71975
ccacgcgtccgaacaggagcccttcccccaagcctcgccgccgcggcgccccctacacctccacctccagtccaggcatccacacggcgcactcaatcggaacaagaagaggagaaggaggacacatcggcggaacgcatctcgtgctcgtcccgcccggatccccccgcccaatgcgcgcggcgccgtcgtggtcatagcagcagccatgagcctcgcctccctcgcccgcgccgccgcccggtccgcgcgctcctccagcccgaacaagggtttatccctgggcgggctccgggcgccgccctaaccgccgatccagccggcccacggtggggacaccggggcgctggggctcgtacgagggtacctgacggcgtagctggggagcactgccgcggtcaagacctcggagtggaggtac

SEQ ID NO: 71976 - DNA, 381 bp, Triticum aestivum
  Clone ID: PAT_TA_71976
ccacgcgtccgcccacgcgtccgcgagcgtaccgtctccgagcgccgcaccgagctgcgcaagctcggcagcctgcaaggccgctgcgacctcctgtcccgcctcatgtcctcctcgacgggccactcggacgagttcctccgcgacttctgcatcagcttcatcctcgccgtgcgcgacacgagctccgtcgcgctcgtctggttcttctggctcctggcgtcccaccccgacgccgaggcacgcgtccttgacgacgtgcgggccgcccacggagacgtcgggaagatggactacctccacgcggcgctgacggagtcgatgcgcctctacccgccggtgcccgtggacttcaaggaggcgctccaggactacatgctc

SEQ ID NO: 71977 - DNA, 477 bp, Triticum aestivum
  Clone ID: PAT_TA_71977
ccacgcgtccgcacataccatgcgtttctcatgtctcagaacatgaggaggaactcgctgaaactatggaaggccatggccttttgtctggtaggcagctgtgagggaggccgtctagaggacatcactgtgtagatgcgtcttcgtcaagaacaaggacggtcaccggcggggtcatcaagcagaagcgcgcccacacccaattattacacttactggctgagttcaggccacactacatgtagaatcactccgaggcaaacggcgtggcggccgtcaccaaggcggctggggagaagtggagcagcatgtcagatgaggagaaggcaaagtatggcggctagaatgcagatgccaccagcaagcaaggcggtgaacaagaaggagagcaccagctccaagaataccaagactaacgctgacgaagaatgttctgacgttgaggatgatgaagaggatgaggactaaatagtacat

SEQ ID NO: 71978 - DNA, 317 bp, Triticum aestivum
  Clone ID: PAT_TA_71978
caacaccaagagcaccgtcaccggctactagcctgactcctccaacggcggcatcaaggctgtcctcaccggcgctgagatagtactgattcccgctggtgttccccgcaagcctggcatgacccgtgatgacctgttcaacaccaacgcctccatcgtccgtgacctcgccaagtcagtcgccgagtactgccccaacgccaacatcctggtcatctccaacccggtcaacagcaccgttcccatcaccgccgaggtcctgaacaaggccggcgtctacaacccccgccgcctcttcggtgtcaccacccttgacg

SEQ ID NO: 71979 - DNA, 463 bp, Triticum aestivum
  Clone ID: PAT_TA_71979
aaaaaaaattaaaaaaaaaaattaaaaaaccccgaggtttaaacccatattaaaccttggaaaaatgcaaataaataaggccgttgttaaaaatataatccataaaatagggggaaaaaggaaaaaaaaaaaatttgggggggtaaaaggttacatttttttaccatggaaaaaaaaacacagccttttcagggaaaaacattcttttatttttgaaaccctaaatgggagccgaaaaaggtttacttttaaaaatgggggcgcttgggtttcctattgcaattgtttccgttaccattaaaagggaattttttttgttttttaatgcaaaaggtttttaataaaaacctgtacataataaacacaggtaaagcccacaaaccaaaacccaggaaccaaaccatttctttaataaaaaagaattttgttatttaatgtgggggcaaataatataaaaaggttt

SEQ ID NO: 71980 - DNA, 612 bp, Triticum aestivum
  Clone ID: PAT_TA_71980
ccacgcgtccgcagggaactcgaactcctccggccccagtccacctccacctccacctccacctccacccccgatggagctcctgagcggcccggcgctggcgtggcagcagtaccgctcgctgctccgcaagaacgcggcgctcgcctggcgccaccggcgctcgtcggcgctgcagctgctctcctccctcctcttcatcttcctcatcttctgcatcgaccgcgccgtccgctcccgcttctcctacaccaccgcctaccagaacgtgcgcgaccccaaggcgctcgtcgcgccgcccatcccgccctgcgaggacaagttcttcgtcaagaccccctgctacgacttcctctggagcggcggcacaagcgcccgcgtgcccgcgctcgtcgacgccatccgcaggaacaaccccggccgcccgatccccgccgagaaggtcttaggttttacgactccggatgaagttgatgcttggctatttgcaaacccgatgcgctgccctggcgctttgcattttcaagatataaatgccacccagatgtcgtatggtattcagacaaactccactccagtagctcgaagaggaacgtatgaggaccccacctt

SEQ ID NO: 71981 - DNA, 201 bp, Triticum aestivum
  Clone ID: PAT_TA_71981
ccacgcgtccggttgttcccatcgcatctcgggggcttcctaccccctcctcgccccgatctaactcgccggcggccatgtcacagccggctgccgccgccgctgcggcgcagccgctaggggcaggccgccggatgggcggcacggaggcggcctgggccagagcctcgccggcatcgcgcggatggcggtgttctgtta

SEQ ID NO: 71982 - DNA, 204 bp, Triticum aestivum
  Clone ID: PAT_TA_71982
ccacgcgtccggccgaggcccggcgcctggcgtcgtcgcatcacggccaacgccgtagccgacgaccgtcgagctgaacacaaagatggggcgtaagcacgcggtgctggtgggtataaactaccccgccacaaaggcggatctaaagggctgccacaacgacgtggtccgtatgcgccgctgcctggtagaacgtttaggttt

SEQ ID NO: 71983 - DNA, 553 bp, Triticum aestivum
  Clone ID: PAT_TA_71983
atgatgccaatgcattgccagccttttcaataccaaggtctccaagtagattgctatggatgtagtactacgtttgttacgcaatgcctagagctattacaagtgctatccaaacacacaaactgcaggaagcaacttgtcagcactggcattttatctgagttatttgaaaacaacattcatcaaggccctagaacttcacgcactcttgccagggctgtgctatcttcattctctgaaggtgatgcagatgcaatccgggaactggacaagttgattcacaagaaggtaatgtattgtcttgagcaccatcgctccatggatattgcacaatcgacacgagaagagttacagctactttcagagacatgtgcccttgtagatgagttttgggaagcgaggttacgtgttgcctttcagcttttgttctcttctattaaagttggagcaaagcaccctgcaatttcagagcatattattcttccttgtctgagaataatttctcaggcttgcacacctccaaaatctgatgctggggacaaggagtcaggtg

SEQ ID NO: 71984 - DNA, 291 bp, Triticum aestivum
  Clone ID: PAT_TA_71984
ttccacgcgtccgagataacaaaaatcttcacaggatcatagatcacaaaaccaaagtattaagtaattaaacctgacgtataagtctgacacgaacagaaagagaactgagaaagattaatagacagggtagtgtgtttaccatggtccatggctagttcagtagatcgttagctgaagcttgaagaatcgaggagtgaagcacctgcgtcgctattgatcatactgtagcaccgagcagggagggcgacggcggcggcgcaagggctaatcccacgcacatgctaatca

SEQ ID NO: 71985 - DNA, 282 bp, Triticum aestivum
  Clone ID: PAT_TA_71985
ctttccacgcgtccggcgagcgagcagggcggaagggcgaccgccgcagccagccgggggagaccacggtgggggcgggggccagttggcctactccctgccttagtagtactcctagatgggacgggcggagcgacatggctagagcgcgacgcgttcgccttcgcggggtgcgcattcattgtttgcttctgccgctgccgctgccgccgctagcaccataaactcgctcctctgcgccgccatccactgcgctgcgacagcattaacgcggcggaggtt

SEQ ID NO: 71986 - DNA, 496 bp, Triticum aestivum
  Clone ID: PAT_TA_71986
ccacgcgtccgccacttctccagatctactccgctgccgcctccaatggcgtctccagcaggaaaccctaatccgaaccccgggaacaccaatccccccttcgagatggccatgctcttcaggccgcctcccaaccccgcgccgaccgccgcgcccatgttccccggcgccgccggcccgccgccgcactccggcccctactcctacccccccgccacccctcccttccacctccgcccctacctccactacccgcaggatccccagccccccatgccccgaccggtcatccccttccccatgcccaacccgaacgcgaaccccaacccgggcgctaaccccatggccgccgcgggccccaaccccggcgcccgcctcatgcagctgctcggcagctccggctcgggccacctcgagtccgcggtatctatgcccccaccgtcgtcggagttcgccgccgcgcagccgtcgccgctcccggcgatgccatccgcgc

SEQ ID NO: 71987 - DNA, 658 bp, Triticum aestivum
  Clone ID: PAT_TA_71987
tacccacgcgtccgcccacgcgtccgcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatcaatctttgccgaccctcatggtcgtggcctgcgcgccctct

SEQ ID NO: 71988 - DNA, 207 bp, Triticum aestivum
  Clone ID: PAT_TA_71988
tccacgcgtccgcccacgcgtccgccaagccgggacagccagccagcgcctccatctagcaccactcctccagcaatgacgtcgtccaggagagccctcatcctgctggcggtgctgctggcggcggtgccagcggcgctgagccagaagtggacggccccggcgcccgaggcgcccgagacgccggacgcgcctgcggcggggacg

SEQ ID NO: 71989 - DNA, 466 bp, Triticum aestivum
  Clone ID: PAT_TA_71989
gcgtccgatttgagcagcttaacataatggctccatcaccaaagggcaaacagtctggcaaacaatctgttgcttgggaaccaaggcaatccatgtccaatgggccaaagggtgtaagtgaccccagtagttcccgacaatttcaagattcggatggagttaatcatccccatgattctgatctgaatggttctacattgaataaagacaagctgatgaaagatagatcatcaaaagttcattccaatacgtttcatcaggatttaggcaacagagacatgaagtctgatcatgttgctattcttaataagcctgccatttcggggaattcagtttctgctactacatcacggaaaccaggtttcaaaatggctgtttttgaggatttaactgagtttgacgatgatctggaagcccccgtcccatcaaagaattcaaaatttgagacagatgtgaaggcaactga

SEQ ID NO: 71990 - DNA, 431 bp, Triticum aestivum
  Clone ID: PAT_TA_71990
ccacgcgtccgctcctgcccctcctgcctcttgtcttccccagctcctcctcctgtcgccgccgccgcctcccgtcccactcgccttcgcctcctcctcctctcacctcctccatccacggtcggccgtgagagagccggcggacgcaggatccgctccgcccggagccctcccctccgtctcggacgcctcatgctgctacgcctccgcctgcaccacccctcctcccctgcgtccacaccaggctagcacggcccgaccacgcgctatggacgaggaggcccttgcccagccaaccgtcgcttgcctcttcctctcatctggcttcttctcagattaggcgcaggtggtcgccatgggagagtagggcgtcagggtgggtggaggagtaacggaggatgccgatggggggaggagcagcgaggctggag

SEQ ID NO: 71991 - DNA, 551 bp, Triticum aestivum
  Clone ID: PAT_TA_71991
ccacgcgtccgcccacgcgtccggtctggtcagggcagaattattagagtaatgccaaacaccccctctgctgtcggacaagcagcatcaggtaaacatatgcagatctgtctcctgtaaacttacttcttgtcttttaatctatcaactacacacataatgctgatattgtgaagctatcagttgaccgaattgtgtggtgatctccctttagtgataccttgagaaaaaagtcaactctaatttcttttctatttctagtgtctctaatgaaataacaaggtttacctaattgaaatgtcaaggattcgacttttaaaatcttcaaaatccggtctgctttattgattcattattacctacatatgtaaatttgaatttgaaacgtgcaacacattatctactttggtttttccagtaaaatgactaccattctgtgatgttatgaatctctattataagtagaaattttgttgctggtggaattactaaatggaggttgtatcactagaaatatgccatttttcacacatatgtttcttgctgatgtt

SEQ ID NO: 71992 - DNA, 642 bp, Triticum aestivum
  Clone ID: PAT_TA_71992
ccacgcgtccggaagagttttgcaaccccgaagctgacccgttaagagctggactacttgtgaaccagaccttttctgaccatacataatgccttcagtaaagcgcatttgtgtcgaggatggtgctggagctgaagacgccaacatcattggtggtaaccccaatgctagatcgagactgctaaatcccttggtttattctgggtcattggacggcttcaaacatcaggacttgaccccagtcattgggagagagtttgaaggactccaggtgaccgacctgctccgatggggtgatgagatgataagagatttggcaatcactgtctcacaacgcggcgttgtttttcttcgggatcaggatgtcacaccaaaccagatgaaagacctgatgttgcgcataactgagctatcaggttgcccctcaacatctggcctccacgtacaccccctcacagaagaaggctccgaactaggcgaccagatatccgtcataagcagcgaaaagcaaaagaaaggtggtggcctcacccaccagctctccgacgttagtcgacttgcatcggcgggatggcacagcgacatcaccttcgagcccgtaccatcagactatgccatgctgaaaatccatacccctacccg

SEQ ID NO: 71993 - DNA, 305 bp, Triticum aestivum
  Clone ID: PAT_TA_71993
ccacgcgtccgcccctcgctcctagggttagcaaccgcccccgccgccgccgccgccgccgcccccgccccggcgccgcagatacacactcctctcttccctactcgaccacatccattcgacgtcgcccagccccagccatcgacgacgcgaccctgacgccctcgtctgctcccaccgccgccggactgcatccacccgactccctcctctgcccccgacgacgcaaccccaccggtatccaaggtctcaccagcgcggctagtcggaggtgtggcggcgagcgcgcggggatgatggaggac

SEQ ID NO: 71994 - DNA, 466 bp, Triticum aestivum
  Clone ID: PAT_TA_71994
ccacgcgtccgcagccctaagaacctcaagcggggaaagagttactccagatctccatctccccgccccagcgccgcccagccccaccacccgcggcccggcgaccccggccagcccccgccccacgccctccccatgcaccagcagcagatgagccccgccgccttccccggcttcggcgccgccaaccccttcctcgcgatgcaactcttcggccaggcgcagcagctccagaacctcggctacctcgccgccgccgcgctccagcagcagcagcaccaacaacaccaccaccaccaaccgcaacagcagcaaaatcccttcttgccgggaggcttcccgccgaaccccaatcagttcggggccttctctggccctcaggccggcttcaacggcggcggcgtgttccggcctggtggtgctgggttggccgggcctcggccgcccctgccgatgatgggcgctg

SEQ ID NO: 71995 - DNA, 540 bp, Triticum aestivum
  Clone ID: PAT_TA_71995
ccacgcgtccggcctcctcgcgtcctccgccgggccgtccttgccgttgcggtcgccgtcacctccatctctccctctccgcctgttccctcctactactccccgccacccgcattgcaacatttgctcccttcctcaacctccccagagccctcccctgcttcccggccggccgagcctcaccccagcccccaggtttatcctttcaaggcctctctgattcgacgcgccttgagctaaaaaaatattataagcctgtatttcaagaaacatgaatccttatttcatcggttttgtcatcccgtttgtggcatctctgatgctcaccaagaggaaggctgagaaggctgagaagaaaaggggtctgcccgtcgatgtgggtggtgagcctggctatgccatccgtaactacaggtccgaacagcccgtcgagacgcactgggaagggattttcacgctcgccgagctattcgaacagtcctgcaagcagtatgcctacatgcccctgcacggcaccaggaagctcatttcaagggaaac

SEQ ID NO: 71996 - DNA, 600 bp, Triticum aestivum
  Clone ID: PAT_TA_71996
ccacgcgtccgcggacgcgtgggtttcttgttcttgattgataggggaaaccaaaccggtagtatatatcatccataaatgaacttagttgatgttggaaagccattctcctaggtactagtagaaagtaagctttttgcctagggttgcagcaaatagtaagagtagtattctctagttgaacagatattagattggctctgtgaactcaactcgtcggctgtggctgttaaatgattgattgatttccctactttctttcttgcccaaccaagacctacaagtacactactaactaattggcatatatgctctgcttttcatgttcagattcagcaaatagtggtaattctgcttgcaaaattgtttgcgtcaattctagctcattattcaggctcttctacttaatcatggtggtcgctagtttacctttatgatgtggcccacctgcagtgtcattttttcttcctaacataataatctagagacagataaggtgctagctagctactttaataaatctccatgcttatgaacaaccacacagttaagttttggacagatacagcagagtgctcaaagttcattaatgttgtaaag

SEQ ID NO: 71997 - DNA, 493 bp, Triticum aestivum
  Clone ID: PAT_TA_71997
ccacgcgtccgcccacgcgtccggagtttctttcgagaggaaacaaaaacaatagagtccaattgttcagaaatgaaaattctcggggcacaaagaaagactttgtttctgctatgtttcattgcagtttgtggcgtagtagctaaggaaaatagaaaaggaggaaggcctaatggaggaaagcaccatcgggcaatatctaagacaatccagacagaagacggtgacatttttgattgcatagatatcaaatctcagccggcattcgaccacccacttcttagaaaccattcaatacagatggaaccgagctcacatcctattggactcgaaggcaactccataccagatacaacattagagtctagtacccatttggtttcgtgtcccttgggaacaattccaatatggagaagtgagcagcactatcctatagttgacattaaggaactaactcatcatatatacacaaggaatattactcgggataata

SEQ ID NO: 71998 - DNA, 260 bp, Triticum aestivum
  Clone ID: PAT_TA_71998
ccacgcgtccgctcctgacccgacccgctcgggctctccccgctcgcgacctatccaggcgccgtcgccgccgccgccgccgctgtcgccgccgacgagccccgggacgagcgccccgccgcagatccctgcacacccgctcccccgcatccggccgccggccggcgactcccccctccacccggggcttgcccccgcgagatccgagcggggctagctagggtttacggggagccgggggagcgaggaggaggaggagg

SEQ ID NO: 71999 - DNA, 313 bp, Triticum aestivum
  Clone ID: PAT_TA_71999
agtcacacaaccactaccttgatctatgaaccctcaaacactcgacgcgtgctgatgcatccacgacggcaatggccaccgatgatgtccaaaacgcgaaaggcatgctcacggatgaagcgcccgcggtggagacgccggtggccgccgaggaggccccaaagactgaggaggtccccgcgccggcagatgccgatgtcgaggcgtctgcccccgtcgaggttgaggcgaccaaggaggaggcgccgggcgccgctgagacggaggaggccaaggagaccgagccagcagctgcggccgagccggaggccga

SEQ ID NO: 72000 - DNA, 532 bp, Triticum aestivum
  Clone ID: PAT_TA_72000
ccacgcgtccgcccacgcgtccgcccacgcgtgcgcactctctcatcagatcagccacagagtcacacaagcactagcttcagctagccagcctcagccactccgggcattttcttgcatccacgacggcaatggccaccgctgatgtccagaacccgacggccgcgctgacggaggaggcgcccgcggtggagacgccggtggccgccgaggaggccccgaagacggaggaggtccccgcgccggcggaggccgaggtcgaggcgtctgcccccgtcgaggttgaggcgaccaaggaggaggcgccgggcgccgctgagacggaggaggccaaggagaccgagccagcagctgcggccgagccggaggccgaggcgcccaaagagccagaggcgccagccgtggtcgagacagagaccaaggaggccgtggcagaggccgagccggcggtggtcgaggaggtgaaggaggaggccgcgcctgctgccgagccagaagcaccggccgtcgccgaggaagcaccggctgcagc

SEQ ID NO: 72001 - DNA, 543 bp, Triticum aestivum
  Clone ID: PAT_TA_72001
accccccactcctcctcctcctcctcccccgcacccgcctccgctaaccctagccggcaccggccgtcgccccggcgtcgaacgaagtcagcggccggcgcagatcccgccgcccccgcccccgccccccgccccccgccgcggcgcggggaggacgacggatgacatcagcatttcctcatgtggccacagaaacatttatgcttctgtttagctgtgcaattgccaattggacaggtctttgtgaattgaagtaacatcgttatgtcttctagcgggagctcgcgttctagaactagaagtggccttgtcaggggaaacaatatcagggatcccaccgacaattcatctgctagaacaagaagtcagattgccaggggaaacagcaacatggatcccaacaagctgtcatgttctaaaacacgaagtgggcttgttagggtaaacaatattgtggattctagtgagggttcatcttctaaagcacaaagtgggcttgttaaggtaaacaacaccgtggattgcaataatggtccttcttct

SEQ ID NO: 72002 - DNA, 696 bp, Triticum aestivum
  Clone ID: PAT_TA_72002
ccacgcgtccggtcgtcccgatctccagccgagacctcgaacagtcgcggcttcgcctctctcctgcgcgctcgtccccgtcgaggcggggcacgaacggcgtccacctcgtcggctactgcaatactgccgtccacttcgtctccgtggtcggccactgcatccagcgcaagttccaggggggagggggcatcaaggtgcgttcgtaggtgcgctaagcgacagtgcgcagtcgccgggagctcgagagcggcttctgtccttcaactccagccgccactcccctcgctgctctgcccctccccaccgccctaatcccctcccaatccgcggcgagcaccgttcagcgacgatgagcagtgtgcctatagattcagacgtcctttccttgacctccaccaacgtcccgctcctggtccctagaaaacttgtggtggctcacacgcctggcattcctaaacggtatgagcttctcttgaagcatttgacttatcttttgtgctgtgacaatgaagggaagtcttatgtctgttgctcgaatcaaaggatcatgtttctaaggtggagtaaggcagacatgtgcctgttttttgagtgggaagaagaggaggagcagatgatttgctggatgcatgatattgccaacaatgtctgcatgaagttccttcttaatccagcataatacatggaaaaaat

SEQ ID NO: 72003 - DNA, 582 bp, Triticum aestivum
  Clone ID: PAT_TA_72003
ccacgcgtccggcggcgctgtcgggtaccccggcgcttccgctcgccggagatggaggcctctgggagctgggacgccatcgactggaaccaaatcgaggatccgaggtcgcggaggtcttcgcagggaatggaggagttcctgctcgaggacgaggaggtttatgcccagggccatggtgttgttctactaaacacagatgaggccggcattgtttcagtgacaaatttccgtcttctctttgtgagccaggtaacaaaaagcataatagagttaggtaccataccccttagtacaattgagaagttaaatgatgatgtaaagcttcaatccgtaccacgccagtatgataagaagcagcctcgtgaacttcttcaagtcattggtaaagacatgagagttattgtgttcgcttttcgtcctagaaccaagcagaaaaatgaagtgtttgacgctttgagaagatatgctaaaccttctcagctgtgggagctatatgcattttcttgtgacccatccactgttgataagaaatccgatccaaagatgcgtctcatgaaggaataccatcgtcttcttagc

SEQ ID NO: 72004 - DNA, 423 bp, Triticum aestivum
  Clone ID: PAT_TA_72004
ggtgggctctcggtgaccaagggggctccctgaatgaccaccgtacgcgccgggtccatggaccgcgccttcccggccaacgtgcgcctcggcaacggccaagtgctcgacggggtgagcgtgtacggcgggccggtgctccagtccggcaaaatgtacgagctggtgtacgcgggggcaaccagttactctgcgtcgacgtgcctcgacgggtcgctggaccaggcggccgtgcgcgggaagatcgtggtgtgcgaccgcggcgtgaactcgcgcgccgccaagggcgacgtggttcaccgcgcgggcgccgccgggatggtgctcgccaacggggcgttcgacggggagggcctggtggccgactgccacgtcctgccagccaccgccgtcggtgcagccgccggtgagaagctccgtaag

SEQ ID NO: 72005 - DNA, 378 bp, Triticum aestivum
  Clone ID: PAT_TA_72005
tcaacaaccaccaccattttcgcaaaaacaacattgggcgttgaacatacatgcacaggtaggtttcagttttctgtgtaaactgaatctgcgatcaacaactatacataccatttgttccacatcaaaaaccaccatattaacaacaaccactattttcacagcaacaacaactaccattttcacagcaacaacaaccacaattttcacagcaacagcagccaccatattcgcaacaacaacagccaccatattcgcagcaacaacaaccaccattttcgcagcaacagcaaccaccattttcgcagcaacaacaaccatcattttcgcagcaacaacaacaaccaccatttacacagcaacaacaaccaccgtttt

SEQ ID NO: 72006 - DNA, 409 bp, Triticum aestivum
  Clone ID: PAT_TA_72006
ccacgcgtccgcccacgcgtccggccacaccggcgctccgtttgcgtctgcgtgtgtgcttgtttggggagtggttgtggagtggagtggtggtcgctgagccaggggggtgccttatcctggcaatggccccggcgccgccgctggtgatggcgacggcgacggcggtggcattggtgctgctgttgtcgtgcgtggcggtggtggccaaggagtgcacgaacgtgccgacgcagctgtcgtcgcacacggtgcgggcgcggctgcagagcacgccgggggcggaggagtggcggtggcgggagctgttccacgaccacctcaaccccaccgacgagtccgcgtggatggacctcctccccctcgccgccgctgccgccggctccgtggaggcgaccgaggagttcta

SEQ ID NO: 72007 - DNA, 426 bp, Triticum aestivum
  Clone ID: PAT_TA_72007
ctggccatgtgttatgaattctttttgttaattgctaatgctgtatttcagagaaccaaatctgcaccatgcctcctcaccctgtcatgttattgattcaccccttttgatagttttttaggtttgtccttgtccttcttccctaaccgctgcaattttctaccctatttgtttactgcttattatcgcgttaattgctttgtattcctggtatttccgggtgtagggtttgtttttgtggtgctgcttatacgtgtgactaccgtatgatcgtatatatatgctcgaaagtaaaatgatttttccttggcacaatacataatttgcaatgagatggtagtacatcagtgtatttacaggaaaaatcaatggttatatatatgctgaaaagaattaaggctgaaaagaatattcatctactatttc

SEQ ID NO: 72008 - DNA, 161 bp, Triticum aestivum
  Clone ID: PAT_TA_72008
ccacgcgtccggtaccattcttaaatatttggggaaccacactgcaagcgccactcgaagcagggactatgaagccgtatacgcagttctggcttgttcatgcctacatcgccgcggcgatgcggtcgaccctagcgtcctcgccggcgccggcacccatg

SEQ ID NO: 72009 - DNA, 372 bp, Triticum aestivum
  Clone ID: PAT_TA_72009
ccacgcgtccgctcactatagctatcagaactatagcgagagtgagctggttgaggggggcaatgtctaccagcatggtggtacaaagctcccgcccaccccggcgacccctaaccagaggttttggaaacacggtcgtggtctccgcagacccaacacagtccttggtgtgatttgtcgccagagcttcccggggtgggtcacgttgcccggtgaaggccaggttccagagctaggaatgacctgggagcactacttggctgccccggccctgccgggggagaggatcggcagtgtcgagtgccacatggtggccgacgttgtgatccagacgttttggaccttttacaggtgtgctgagggacagaagga

SEQ ID NO: 72010 - DNA, 459 bp, Triticum aestivum
  Clone ID: PAT_TA_72010
ccacgcgtccgagctggcctacagcgaggccgagggccgcatcgggcggcgcgacagggtctggcagatcgccttcggctccgggttcaagtgcaacagcgccgtctggagggctctgcgcacggtggcgccggaggccgaggagaagaacccgtgggcggacgagatcgaccgcttccccgtcgaggttcccagggtctccagggttgggagcgcctgatcgactgctgctcgtccaagctggcaaccttgattgattcatttgattgggtgattgccattgccatctcctggttcatttttaactttttttgaaacaatctcctggttcaatcaatccttgagaacatgcatgcatgatttgggctgttgttttaggttgtactccctgcgtccggtaatactcgtcatcaaaatggattttttttcgagagtacgctaatagcgtaccatattttt

SEQ ID NO: 72011 - DNA, 140 bp, Triticum aestivum
  Clone ID: PAT_TA_72011
ccacgcgtccgccttcaggccagccagccaggtcgcaattcccgcaactcgcgccgccgcgagggcaatggagtccaccggcgccgacatctcggcgccgttcggctgccgcgcgttgcgctgggccgggcagcggcctc

SEQ ID NO: 72012 - DNA, 413 bp, Triticum aestivum
  Clone ID: PAT_TA_72012
ccacgcgtccggcctgatctgcgcatgggaactccagctaacatcattgttggttctcatgtttgggtggaggatccaactctagcatggatagatggcgaggttgtcagcataaaaaacaatgaagttcatgtgcagacatcaaatgggaaaaaggttactacagacagatcaaaagtttttcccaaggatatggaagctccaccaggaggagtggatgatatgacaagattatcatacttacacgagcctggggttctacagaatcttgctacgcgttatgaactgaatgaaatatatacttacactggtagcattttgattgcggtaaatccgtttcaaagattaccgtatctttatgatacccacatgatggaccaatacaagggtgcagattttggggagctgagtcc

SEQ ID NO: 72013 - DNA, 485 bp, Triticum aestivum
  Clone ID: PAT_TA_72013
ccacgcgtccggcgaggtagatagaggaacatgcgctcgggcagtggatgtgattccttcatgttcatgtcgattccgtgaccccccacctgtggagcttgatttgtctctcatttctcttcaattctcgcctcctgttgttggttgttttctcaatttttctctcgagtgcgtgatttttgttcatttctcggtgtgtagcttccagatctggggtcagttgctgatgtgatttagtaagggttcgtgttagatgtgtgttgtgatcctaggccgtgctgttgtagattcatggtaggtgcttgtagttttatggttcgttctgcttcgcgatgttcgccatcgttccttgtcttcttagtggtgtccgccatttttgttcctcgtctgctcgtggtaggatcatgcgtgggtagttttgtgattcacataaatgtttggatcagccataggtttctagatgtgagtttttgtggtttggggtt

SEQ ID NO: 72014 - DNA, 548 bp, Triticum aestivum
  Clone ID: PAT_TA_72014
ccacgcgtccgcccacgcgtccgcccacgcggagggccgccatctaattaagtttcatatcatctaacgctaatgcatcatagagcaccttactaaggctaacactacttgcgatggcaacaacaatgggcactgccaatatgcaggtcgaccctagcagccgagtacaatggccacaagaacaaccatccccccagtcccaacaaccattctcccagcaaccacaacaaatatttccccaaccccaacaaacattcccccatcaaccacaacaagcatttccccaacctcaacaaacattcccccatcgaccacaacaacaatttccccagccccagcaaccacaacaaccatttcctcagccccaacaaccccaactaccatttccccaacaaccacaacaaccattcccccagcctcaacaaccccaacaaccatttccccagtcacagcaaccacaacaagcttttccccagccccaacaacaatttccgcagccccaacaaccacaacaatcattcccccaacaacaacaatggatgattcag

SEQ ID NO: 72015 - DNA, 260 bp, Triticum aestivum
  Clone ID: PAT_TA_72015
ccacgcgtccgctcaatctcctccgtccgccgggtgcatctctctcctctgtcatctatcctctattattcttcttattcctcgtccgcctccgcataccaatctccaacgaactccccgaatcccgccccgccccgacacaaatccgctccccccttgtcaatcccgcccccaccccctcgccgaaatccgtaccatcacgcccgattccagcctcgcccgcccgccggcgcaatccgctcccaaggcgccgttcttgg

SEQ ID NO: 72016 - DNA, 674 bp, Triticum aestivum
  Clone ID: PAT_TA_72016
ccacgcgtccggatggccatttattttgtcatattacagggcagataaagagtggatacccaactgctccgatgtaggccgctccgaatcaatcatccgatatatggcgtcacttgaaggtaactaagaaaccggcgacccagtttttgttgtgcctgcattatttgctatgccagaatacttcccattacccagttctactttggtatttccttctgcatcggcttattagatttcaagcttacatgttcatcttggaaaagatcttacatcacaatttggtgtctccgattggtgctaatcaataaaaaaattgttgtttcttgtcatgatgaacattttatagttgtagcataattagatgatgatatttttaaggttaactgatttatgaaaatacttccattattattctgcatatcgccatttcttttactgtatacacgctttcaaaagttagctaagtaattggttcacacgtaatgtgcagtgacatacctcatctcttcatgcaaatataatccacgacattgtctatttctattgtgtgctccatcgagatgttaaatgaacttcgaaatacatatagcacgtgacggagacacatgaccaccggaagagttcactaatttatatgcttaggcaggttcactggatgatatgcatcatggatc

SEQ ID NO: 72017 - DNA, 326 bp, Triticum aestivum
  Clone ID: PAT_TA_72017
ccacgcgtccgctcgcctcctctgcctgcctggctgccactgggcggacgcaggcacgcgcacgcgcaatcggccccgcagcttcaacactcggcgcccggcgaggggggcgcggtgaggccgacgtggagggcggggatggggtgcctgttcgactgcttccgcgcggccggcggcgagccgcgcgccgcccgcgcccgcgcccagctcgtgtcctcctccgtcgtccccagccccaaggttggcgagaggagggcgccgccgtccaggaacgcgctgaccgccgcgttcctgctcgaagactagggatcgctggccacgagctc

SEQ ID NO: 72018 - DNA, 630 bp, Triticum aestivum
  Clone ID: PAT_TA_72018
ccacgcgtccgcccacgcgtccggtacaatggcatcgttagccaacctcttagtgtcgcttctcttgattgcaatcttctctcctacacccatactatgctatcttaatcaagcttctgtaagggtacaacagggtgctaccaacacctctgcctaccacacttacatcgtgctcgttgagccaccaccctttaatgccgatgaagacatgtaccatcattgttatgagtcctttttgcccagttcgcgtgatggcgactcgggcaaggcacgtcttgtgcactcttacaccaaggtgtttagcggcttcgccacaatgctcactgatggggagcttgatgcagttgccaagaaaccggggttcgtgcgggcattcaaggagaagacacggtacctcatgaccacgcgcacaccaaagttccttgggttgaggaacaacaccggggttttggagggacgctagctacggtaagggggtcattgttggcttgctcgataccggcatctatgcaaaacacggttcattcgatgatcgcgacatcccgtcgcccccggcaaggtggaagggctcgtgcaaggcgacccggtgcaacaacaagctcatcggtgccaagtcattcgttaaacacg

SEQ ID NO: 72019 - DNA, 304 bp, Triticum aestivum
  Clone ID: PAT_TA_72019
ccacgcgtccgatggcaggtgaggcgaggtgaggtgaggtgggagggaggaagaaggggaagtgaactgaactgagtcgagcggggtcgagggagcacacatagccctgcacctgcagcagtccacagcaccacaaaccagtgacaagaatcaggattggcggcggggacacggaggccggggatgccggcgaggagctgcggggagagggcgtgatggcggcggtgatggactacttcaggtcgtgctggggcgcgcggtcccgggccgggcggcggggcaagaagggctcggacgccgccgg

SEQ ID NO: 72020 - DNA, 546 bp, Triticum aestivum
  Clone ID: PAT_TA_72020
tacccacgcgtccgggaaagaggggaaaggggggcggatcggccggagatgaggaagacggcggtgggctccgcctccgcgggtgcaggctggccgtgcggtctgaacctcaacgtggtgttcctgctctccatggtggccaccaacctgctctccctctaccacctgtgcatccgcgcctcccccaccacgccggcgctccaatccggctccgacttcgagcagcagcaggtgctccagcagctcagcgccatccgcgccaccgtctcccacctccggtccgccacccctcccccgccccccgagctcgtcctctactcccgcctcgcccccgtcgcctccgcctgctccgcgcaccccgacctcctccaccgcttcatgtcctacgtccccttcgccgcctgccccgacgacgtccacaccctcgccgagcctctcatcctccgcggctgccacccgctccccaggcgccgctgcttctccccgacgcccgacgccggatccgtccagcttcccaccgaccccttcgcgccgatccccgactcc

SEQ ID NO: 72021 - DNA, 321 bp, Triticum aestivum
  Clone ID: PAT_TA_72021
ccacgcgtccgcggtgggggatggccctgctgagggcgcggtgtgctcgcggttgtactgcagcagaggagaagggtcaggcaggagcgggttcgacggcgcggaggctgtatgcggctctgtgcgccggcggctgtgggctcgaaggggccgatgagtggcagatcgggccccggcgtccagttctgcgggtggttgtgatgaccgtcgggcgcatggggctggcggttatccggcgtggaccggtggcaacgatggagttctgggccccggcgtacatatctgaaggtggtcgcgacggacgttgggcgcgcggggcca

SEQ ID NO: 72022 - DNA, 604 bp, Triticum aestivum
  Clone ID: PAT_TA_72022
tacccacgccttcgctttgatgtgaatggcgtgcagccggatctttgggtccgtgttgctactctgtatttttctggcagccggatctttgggtccgtgttgctacgctgtatttttctggcaccgaagctcgttggcttcaagttcacgaagcacacaacaccccgtttacatgggcgacacttttgcgccacacaacacccccgtttagatgggcgacacttttgcgctgctccgtgcgccaaattcggccgcaagcagtatcacacacaacggcacctgagccgccatgcctcgcaaaggggggcgaaacggcccgccaccccctttccaatagccggcgggtttcgccggccgctcctccaatggcgacgagacgaggggaaggaagaagggatgtcggccctctcgatctagggtttcgcagtgtcgccaggaggagggagacttcggcgtgttttcgaatcccagagttccactctaggaaggaaatctatggcatccatgctccactccacgtgctggaattaaacgcagacttgcacgcaaatataccgatgaaattccgaaaccagaatgaagcaccacacggcaaaaactactt

SEQ ID NO: 72023 - DNA, 654 bp, Triticum aestivum
  Clone ID: PAT_TA_72023
ccacgcgtccgctcctcctaacagctcgctcccctgccgtcgccgccaccccctctccgtcgcgcctcccttcctccagcaccctcgccccctgcaagcctccccataccccacctacttcccgccgtcgacgaccaggcgcgcgcgcgcgctcgagggcatggccgccaagggcggaggcggaggcggggtgggcacgctcaagtccacctccatcaacggcgtcaagctctactccgtcaccggcaagaactacgtcgccccctgggtcctcgccaagaagaagcgctccctccgcaaggacgcagagtaccagcgccggctggagctgatccatgacctcaggttcgagaccgccaccaccaggatcaaggtcacccccgacggccagtatgtcatcgcctcaggtatttaccccccacaaatgaaagtctttgagttgaaggaattgtcgatgaagtttgagaggcacatgatctcagaaattattgatttcgaggtccttggtgatgactactcaaaactcgccttcttgtgtgctgatcgttctgtatgcttgcatgcgaagtacggtagccattatagcgtgagaattccaagaatgggaagggacttggcctatgattgctggtcttgcgacttgctatgtgctgc

SEQ ID NO: 72024 - DNA, 490 bp, Triticum aestivum
  Clone ID: PAT_TA_72024
ccacgcgtccgcccacgcgtccgctccacaggcacgaaaacctcctccgagggttcgcgccgccgccgccgctcacgccctcctgccggcgctgtccgccctgctcccccaacctacaagcttcggaaagccccatcctcccgcgagcagcccagcccgtaccgacctccccgcgccacgccatggcgagctccggcgaggaacggggcgtggtggtggacatccgctccgcggcggagtcggcgggcgacgacggcgcgcgcgacgcgccgctccacgtcgtcgagtccctctgcatgcgctgcggcgagaacggcacgacgaggatactgctgactctgatcccgcacttccgggaggttgttctgatggctttcgagtgcccgcattgcagcgaaaggaacaacgagattcagtttgcagggcagctccagcccaagggatgctgctacaccttgaaagtccccaaggggcagcctgagatactgaa

SEQ ID NO: 72025 - DNA, 665 bp, Triticum aestivum
  Clone ID: PAT_TA_72025
ccacgcgtccggtagagtcgactagtgaggcgatgtagagcgaccaccgtcatccgtggaagccgcgagaggagtcggcatagagcgaccaccatgtgcgcggaggccgcgagaggagtcgacgtagagcgaccaccgtggcgcgcggaagccgcgagaggagtcgacgtagagcgaccaccgccacgcgcggaggccgcgagaggagtcgacgtcgagcgaccaccgccgcgcgcggaaaccgcgagagaagtcgatatagagcgatcaccaccgtgcgcggaagctgcaagagtcgacgaagagcagccaccacgacgtgtaaaagacgcaaagggagtcgacgaagagcgaccaccaccgcccacggaagtgtcgagaggagtcgacacgaagcggccattgccatccgaaaatatcggagtaacagactgcaagacctgaggaggagcaccgagtaaagatggaaggtgcatgtgtgagctgacattggatagacagccagcgcctgaagacaacggcatagtaccctcttttttttcttttcttttctttgcaaagggacgggccaactctaatcaggcaagggccaagccagttcgcggaagcccagatgacacgaacgcagcgcaatacgagcgggccacgcgctggctcgatcaaac

SEQ ID NO: 72026 - DNA, 515 bp, Triticum aestivum
  Clone ID: PAT_TA_72026
ccacgcgtccgggatgttgtgatgagatgtttggtgtgattgctgggtcgcaaaggctagttgatgccatcgggagtggggagggacttggctcggcgcaaaggctcattcgtgagaaactagatgacagagcaggactggaagggagtttggagcagtggctgaagagtgtgtttggatcagagattgaatccccatgggatcaaatccgtgggttaatcctgaaagaagggaaggatatttttgaggactggatggaggaagcatttgtgcaacggatgaaggacattgtgcattcagagtttgatagcttggttggtagtgttaatgtgatggaatcgattcaggctattggtgcgaatgctggtcctaaggatgctgctgatttcctggtgcatgtgcaaaaagcttcgactgggggcagcgtatggttctcagaatctaagatcaagaaaggtggaattttggcacatttgaaaccaattgctgacgagaacgacttccacagctgccta

SEQ ID NO: 72027 - DNA, 660 bp, Triticum aestivum
  Clone ID: PAT_TA_72027
ccacgcgtccggacagtagttcaggttcaagatttcagtgccggtcattgaatatcaatgaagacctaggccaaatacggtatatattttctgacaaaacaggtaccttgactcaaaataagatggaatttcagcaagcgagcatctatgggaggaattatgggagctccttgcaggtcactagtgactcatcacatgaaataaccattgcagagtcatcgagccaacatgacaggaagcccaagtcagaaatcaatgttgatgcactactcttggcacttctgaaacaaccattgtttggggaggaaagactcgcagcccatgattttttccttactttggctgcatgcaatactgtcattccagttagcacaggaggttctcccgatttgaccaatgaagtaagtgaggttggtgcaattgattaccagggcgaatcacctgatgagcaggccttagtaattgcagcttctgcttacggatacaagcttgttgaaagaacaactggccacattgttatagatgttcagggcgagaggataaggttggatgttcttggtctgcatgaatttgatagtgtgagaaaaagaatgtctgttgttgtaagatttccagacgacactgtgaaagttcttgtcaagggtgctgatacttcaatgc

SEQ ID NO: 72028 - DNA, 509 bp, Triticum aestivum
  Clone ID: PAT_TA_72028
ccacgcgtccgattatcctcctcgagccccgagacgcaggcgacagcgcagcaggcagaggcagcagcggacgggaggaaccgggccaggctccccccccgctcctcctccctccctcccacgccgccgatcggccgatcgggaggaaggaaggaagggggccgatcgggaggcgctgcgccgggcgggcggacggtgcttgctctgggtccgctgaagccagggagacagtttcgcggcattagccaattggctgccggaggcttcaagggcttccatcattcgtctccgtgattcattcgtcgctgctcttatacttgaggattatctacttcaagtttcaaccgttgcttattagcgagtgattgtttattctactgaaatcatttgagctcctcatcaagtcaccaaggaacacacgttttgatgcaacataatagggtcactatgctgtcttcctccgaaacatgccaccttggttccagttccaacaaccaggctatcgatca

SEQ ID NO: 72029 - DNA, 684 bp, Triticum aestivum
  Clone ID: PAT_TA_72029
ccacgcgtccgccaccaccaacccgtcgcaacccaccggaaaccctaaccctagctagagccaggccgcgccggcgagtcgacggagccgccgctgagcggaccagccgagtcggaggagtcgaggtagtcgctgcgacgcagcgcgggcgcggcggcggcggcggcaggtcctcccggcgacctccggcggcctcttcctcccccatgatttaggaggatgatggcgcaggccctgcaagggatccagcagcagtatgcgccgagtggcttgcctgtccagaaacgttatacaaaggagactgcagcgcaaattcttcagctggataatatggattcagatacttccccagtccgactcattatcaagcgtaaaattgtaacctacctgaaaggaagggagcaattctataacctgcacccacgatatcttctggcagtttcaaaaagcattgatgagcagctttataaggatgcagaatcaaagatccactacatggattttgagactttagaagttaggctgaatgctcttctcagtcgtggatcatttggcaacagtagatatgctttggcttcttcagcatctttaccgacatcacactcagaacagcttgggataaaagtaacagattcaagtatacagaatggtagagctgtacctggttctgttaatcctcccccg

SEQ ID NO: 72030 - DNA, 440 bp, Triticum aestivum
  Clone ID: PAT_TA_72030
ccacgcgtccgccccacttattccatcccgggctccgtccaggatccgcaggcgccgccacccccgtcggtcatcgccgacgcctactcccgccgctacaccgacacacgctggctccctcccccgtttctatatcctccggtcgcacccgactatgtacaccgtctgtgctgaactccccgacttcctgcactgtcctgcggctcacggctaatcgagttcgggagaagacctgctaacatcaaccggagcagcatcagggagatctgaaaacattctcatcgagccgaaatcgtctcaaaaaaaccaaagacaaggctgacacaagctaatgatggcatcttcatcaggtcaacctgcgaagcctgggaagagtgttggtgaggagtacgttgatcatcgactgctcagtccaaatgttcgtaatgctgattcaaaaa

SEQ ID NO: 72031 - DNA, 647 bp, Triticum aestivum
  Clone ID: PAT_TA_72031
ccacgcgtccgggaaaaaaaggagaaagaaggtaccagatgaagaggtgctggctgaagaacaaatcagttctggtaatacttcagttataccacaagcatgtcagcttgataccacggagcagccctccttgaattctgactttgagaaagaagcaatagatatacctgaatcaactgcaaatatttgtgctgaagtatcccctgatgcaccgatggaaattgaccctcaaataagtatgtcaaggaagagcaaaagaaaatccaaagtacaatgcaaaagaaactatgtgttttgcaatgaaggtgccgataatttacaggcaaagaaattgctgcattgcttgtcatctgaatcacttcgtagatggtgtacatacgagtggttctacagcgcagttgattatccatggtttatgaataatgaatttgtgaactacttaaattttgcaaaattgagccatctttcaaggctcactcgatctgagtggagcacaatccgaagttctctcggcaagccccgtcgcttttccaatcatttcctggcagtagaaaaggaaaaacttgaggattatcgacaaaacgttaggaaatactatgccgaactaagtgatggtttgcgggattctctaccaacagacctagctc

SEQ ID NO: 72032 - DNA, 610 bp, Triticum aestivum
  Clone ID: PAT_TA_72032
ccacgcgtccgccctccctcgcgcctccctgatctccaagcgctggctcggaatcgtctccgaccccggcttctcccgccgcttccgcctccaccaccgccacaacccacctctcctcgggttcttctaccacgtctcggacttcgaacctgcaatggatccccccaatcgtgtcccggattcccacctctcttcgtgcctcgagaccctcgacgacgaccgcatctggtacttgatgcccttgggatcccgccatggcctcctactcaccttctgcgaattgtggaacaagctcctggtgtgggacaccttcaacgtcgagcagcaccacctagctgttcccccggggttcgatttggagaaggcctgggccagcggggcggtgtttcgcgccgccggagacaaccaatacttccaggtggtcttggtaagcacagagacagctgaccaacaacatacacgggcaatcgcccgtgtttactcatcggagactggcggatggggtgatattgtctcgacaccgcttacacccaaggcttctagttctactatgggcgagggcgaatttcccaccaagattacaatgttcttaactatcagtgtgctagtt

SEQ ID NO: 72033 - DNA, 524 bp, Triticum aestivum
  Clone ID: PAT_TA_72033
ccacgcgtccgctactgcgtatcccgtcggggtgtgcgcctcgaacagaatcctgctcgtccccccgccgccgccgggtaccatagggctttttcccaccgccaccggccaccatgacgccatgccccatccactctcgctagccccgactacacaacaacctattcagctccaccgtgtgtgccgaacccgttgctcagatgagatccacgctcgacagtacgatgggaggcgagacaaatctctccccactgctgctggaaccggagactctacgcggcgaggagcacgattgggtgtcggcgctgggggagtcagtttacttcggacgattcctctctgatccggtggagtgggtgccatggcgcacatcctatttgtgccgccggctaccatgggtcatgtccaatcatcaccaacagctgagctcgatctatcggtagaaggcaatttgtcagtgccagttgcagcggtcggagctcgacctgcctcctccaactgtggtgatatgtgcattgggggtt

SEQ ID NO: 72034 - DNA, 658 bp, Triticum aestivum
  Clone ID: PAT_TA_72034
ccacgcgtccgctggccgctacggcgaccggcctgagaagttccgcgacttcgtgcaccggctcttcctcctccgggacgaatcggcgcccgtggtcatgctccgcctgcggtcgagtgacgaagaagcgggcttcaccgatgacgacgccagcgcgtggatgatggccgtcatcaagcgcaacgcgcgggttatccatctcaccgggcgttgctcagagatcgcgtcattggaccgcgtgtcgttcatctcttgccacctcaaggtcttgaagctgtcgtatgccatgctcgactacaggatcctcgggcagctttcttctagttgcacgtctttggaagtactaggtctgaaggattgcttggtggcgggccctaggattgtgtccgcctctttgaagactttaatcatgctcgaatgcgagattagttgcgccttctccattgctgctccgaacctcctacttctgcacctcatcacaccttacgtccgagtcccatcattcaagaatttgggatcacttgtcacagctactatcatacttgatgactctttcttgggtgatgacaatgaatgcatcagtgatgaagattattgtgatggaactactgatgacgatggggatgatagcgacaataatgattggacagagagctcg

SEQ ID NO: 72035 - DNA, 516 bp, Triticum aestivum
  Clone ID: PAT_TA_72035
ccacgcgtccgcccacgcgttcggaaaagggggcacatgaaactttcttgaggaatgctcgaaatagtgaggagacgttgagaaaagaggctatagaaagaactgatctcagtcatcttgatggtactctgctaaattccattgatacatcacctgattcgatgtatcaggtcgaatcaacaggtgctgttgtcagcttgaattctgcagttgggctcgtacatttttactgttcacagctaccaagtgacaggtactcaattcttcgtccagaatttattatgcaaaaacatgagaagccagggggttccatggagtattcctgcaaacttcaacttccctgtaatgctccatttgagaaacttgagggtcctatatgcggctcaattcgtctggcacaacaagctgtttgtttggctgcctgtaagaagctgcatgagatgaatgccttcacagatatgcttttacctgatagaggaagtggacaaggagagaagaccgaacagaatgaaggtg

SEQ ID NO: 72036 - DNA, 117 bp, Triticum aestivum
  Clone ID: PAT_TA_72036
ccacgcgtccggagaaaaccaagtatcccaatttcttccagtaaaggtcggagttgggattcttggttgtctaaggagcatgagcaatggtgtattgggttggttccagctgggagc

SEQ ID NO: 72037 - DNA, 518 bp, Triticum aestivum
  Clone ID: PAT_TA_72037
ccacgcgtccgcccacgcgtccgaggacatgggggccagagcaaaggtcggctttggggattttccatggagatggaagaagtagtacgccgtatcaagctgggtccaggcggcggcggcggaggaggaggaggagcacgccgtcgcaagctgggtccaggcggtggaggtggaggagccgacatcatcagcgccctcccggaggatctgcttctccaggtcctcgtccgcctccgctgcgccggcgccgccgcgcgcaccaacgtcctctcccgccggtggcgcggcctctggaccagcctccccgacctcgtcttccgcggcgtcgcgctcggctccctccaagcggcgctggcctcggtccaagccgcggccgggcccggggtgaccctcctcgacatgtgcgttcccgacgcgctcctacactccgtccgcgagtccgacatgcccccgctgctccacgccgccgcggcgctctcgccggtggagctccgcctagccgtggggaagggcacgca

SEQ ID NO: 72038 - DNA, 630 bp, Triticum aestivum
  Clone ID: PAT_TA_72038
tacccacgcgtccgccctgctgccgacccacgggcatgcccaaaccctaggcccccctctcctcccccggccacctccgcgaccgccggtagccggccatggagggcctcttcatgcaggtcttcgagcgccgggactgggtcaccgggcagatgcgccagcaggtcgactcccacgccgagtccctcgcctgcgccttcctcgctgccggcccccgccccccgccgtggctcctcccctcctgcgccgctggtctgcaagccatggatgctccagatctcaggcttacttcacgtacctcctgcttaaccatgcaattgcagcgccggccaggcagcatgacactgccaacgagcgctggtgatcagcatcagggtgaactcgccgtcaacgaaatgatctttcccttgttctttcagcgggagagctaaatggcaaacctattgttccgggtttacttttcgctggaagccagattactacaccagcaaccaacagaaccttctttcagccgcgagctgttcctagcatttcactcagaaatgtgggggttccaaatggatatgctggtcgagactctatttgtgacaccgtggatactaaccaacatgaagtgcctcagcaaaagca

SEQ ID NO: 72039 - DNA, 621 bp, Triticum aestivum
  Clone ID: PAT_TA_72039
ccacgcgtccgcgatcctccatcgccgccgagaagcgccgccgccgtcgcgtcctcatggataatggcggcccacgccgtcgcggcctcaaaccaagcggcgccatggaggggaagagttccgcgaagaagaaggcaaggacggcagtgccggcgacggccagcctcctgacggacgacctcatcttggagatcctctcccgcctccccgccaggtccgtccaccgcttcaagtgcgtctccccggcctggcgcgacctcatcgccgaccccgcccaccgcaagaagctgccccaacccctcgccggtttcctatacaacacctaccacaggccggacccccgcttctacaactttcacttcgccaaagtctccggcgccgcagccccgccggtcgacccgtccctctctttcctgccttccgacgagtactggtacgtagaccagctggacacctgcaacggcctcctcctctgccgcgcccacatgttgccttcttctccttccggggacaagaatacgcgggttgaatcccattacatcgtgtgcaatccggccaccgggaggtgggtcgacctcccccctcaccccgaggtgccacccggcggtcgcatcttcgctc

SEQ ID NO: 72040 - DNA, 599 bp, Triticum aestivum
  Clone ID: PAT_TA_72040
ccacgcgtccggggctagctcctcgttctcgggcggcgggatgggtggcgccgcgacggccagccccgagcaccggcgcgagctccgtgctcgtctgcttccgccgcgccacggcctccaggggacggcaccgctgccgatccacgacgagctcgtggaagagatctttctcctgctgcccacgccaaccgatctgatccgcgcctccgccgcctgcgtctccttctaccgtctcgtcgccactcgctccttccgccggcgcttccgcaagctccatgccccgcccctcctcggcttcctcgatcacgagcgagaatttctccccgcaatcccgccgcatccttccgcgcccgcagccgacgccgtcgccctcgccgccgacttctacttgtccttcctcaccagagatccctacttcacccccgcccactactgggacatcgaggacgtccgcaacggccgcgtcctcatcagcagacatcccttccatgatctttccctggcagtgtgcgaccccttgcaccggcagtacctcctgcttcccccaatccctgaattcgagggctgggcttcactgtacaacctaaggacaggatggc

SEQ ID NO: 72041 - DNA, 603 bp, Triticum aestivum
  Clone ID: PAT_TA_72041
ccacgcgtccgcaaacccctccacagccggggtccctcacattcgcacccgtgaacgctctcctctccctgaaccttcttccagaagccagggccactctctctcgggctccgctccaccgccgcggcgacatggggggaggcgctatggaggtggacctgacccacggcgcggtggcggcgatgtcgcggctggcgcgaggcctgcgcccggtgctgcaggtggtgggcgcccccgcctcggcgggcggcacggatcggtaccgcttcctgctctccgacggcgtgcactcccaggaggggatcctcgtcccctcccttgacagcctcgtcaggaccggccgcctccgcgacggcaccgtcatacgcgtcctcgactacgtatgcaactccgtctgcggccgaagggtcatcattgttatccaacttgaagtggtgcaaactgagtgcacactgatcgggagtccttcaagttatcaggtcaatgctgctcaaccaaatatcagatctggtagtctaggcatccatgggtcaagggctgagcaaggtgttactgacatggcattttctcctgctcaaggcctcttgcgctcttctattgccg

SEQ ID NO: 72042 - DNA, 175 bp, Triticum aestivum
  Clone ID: PAT_TA_72042
ccacgcgtccgacctatgttgcaattaccgggagatacataatgacgatcttttttgcggctttctgacgttaaatcttgattattatgttgatacaacatccactaataatcactgaagtgtttactgtcctctgtcggctggaatctatgatcgcacctgatttcattcagct

SEQ ID NO: 72043 - DNA, 427 bp, Triticum aestivum
  Clone ID: PAT_TA_72043
cggtacgccaggccggaggaggagaagggatacgcagacacgcagattgagagagagggggcggggcgcggggcgcgatgatggataccaagccgccgttgccggggagcggggggccatcgccgggggtgcaccaccacaggcggtgggcggcgccactgctggcgtccgtgctgctctcctacattctcatctcggcctgcctcttcttctcctcctcgcgggcgctgttcctctccttctccccgctcccgtgcgcggtctccgaggagacgatcttggtggaggccaatctgtggcagtatcatcaggaggcgcacgcccgcccgcaccgagccgtgcccaggatcgtatacctagtgttcggctccgccggggacagtgctttagttccttgtaccggctgttttagacgtgcacacaataa

SEQ ID NO: 72044 - DNA, 657 bp, Triticum aestivum
  Clone ID: PAT_TA_72044
ccacgcgtccggagtttgtataccttacaggccctaaaacatttatccaagaaacagaaaaagaaagtggaaaatcctagatcttgcaactgcggcggcgggggcggcgtcgaggaaagaagaggagggagcgcgctgcttttggagatggaggtggcaggagaagccaaagagagggccggcggagaatccgcggagcgccgccgcaaggaggccaaatcctcttctgggatctacgacgattcagccacgtcggagcagatcgcggggaacgaagacgacaactcaatggatcattacggggagctgttcctgcccgagtacttgacggacgaggagattattcaagagtaccgtataggctgggaatgccggtgctatggcatgttcggcggcttcgaagatgagacgacgatcaagagcatgctgaccacatacaaaaccatcccacatgctttggtctcccacaccttgcaagtctactccatcaaagtcgagaagccgaaactcgggtggccacttcgtgtctatggcatggttgctgcccgagaccatgtggattataatcgcaactttctcttcaatcgcacaagcgataactgccaaatcattactgcagatgagccctacttgacgctgactggcccctctggcgca

SEQ ID NO: 72045 - DNA, 638 bp, Triticum aestivum
  Clone ID: PAT_TA_72045
ccacgcgtgcggcaagatagcctgccagcgcatggcgaagcaagggctctgaagggtgtgatggtgtgtttacttatactgatgtcggttatcaagaaaggccaaccggaaggaaaaactccttcccggaacgacatgagatgaggctgatataaactttgctgttcacccgcctgttagacaagatggacatgcggatcctgatggtgggtctcgactccgccggaaagaccaccatcctctacaagctcaagcttggcgagatcgtcaccacaatccccaccattgggttcaatgttgaaactgtggagtacaagaacatcagcttcactgtctgggatgtcgggggtcaagacaagatcaggccactgtggaggcattacttgcagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataaacttggcctgcactcccttcgccagcgacactggtacatccagagcacttgtgctacaacaggggagggactg

SEQ ID NO: 72046 - DNA, 681 bp, Triticum aestivum
  Clone ID: PAT_TA_72046
ccacgcgtccgattgcacctgatttgttaatcaatatatcgaaagtcccagctcagcatcaaggaattatcttgagacttgtatcaaaggctattggtgaatgcaacacacgtaaggtggatgataacattgccttaaaatatcgatccataagtggatctgatgatggcttagtttttgctgacttctgctttcacacaatattgtatcaaacaccatctcaaggcattggatgcccagcaggactttcagttgcccaagcagatcgtgttactggaaagctaccactgaaaggtgacacacttgcatcaagaaagctaggtatcttgaatgttcttgaagctatgcagctgacatctgagattgtctaccctatttatttagctggtgcttcagatagtcaagaatcagttgctaagagaggcgacgagttgttaaagcgcaaagcttcaactgcgaacttagaagatgccaagcttatcaatagattgttcacactattcaatggtaccgcaagtgcagaaaatatagctgcagaactgaaagtcgccccagcacctagttcattgcgtgttcgcctaatgagtgttttctgccggtcaattgctgcagcaaacgcatttccatacacacttcaatgcatttttggctgcatctatggaagtggaaccacttcaaggc

SEQ ID NO: 72047 - DNA, 644 bp, Triticum aestivum
  Clone ID: PAT_TA_72047
ccacgcgcccggaacataattgctcttaatccgtaatctcctcaccatctcctcactgacggccttccctgcaagagctgttgtctcccccctcaccacctacacttgcagcaataacagaatctgctctcaatccctaaccccatccccatttgctcactgttgaccttcactgaaagagaaactcaagaagaatgacaacaatcaaattacttcggctgctccccttccaaaataggagcaaccattggccattcgggcagtgtatagagtcttaaactgctgccagaacacacacacacacgtgtgcacggatactttgaacctcacaatataatggcggatcaagataatcccccctgtgagggctttgagtacatttctgacctaggggagcgttcatatgggtctatttctggaaaaataatgaatctctccaacggacatcatcttgttggacaatatgtccaagaagttatgatcaagaagggtgtgcatttgaagatgaaacactttgatatcctgaagcagtttcaacattcctgcgctatacctcttctcaacttttacccagaatctatgaatatgggcagattaataatacccaaagtcgatgatgcatttgacaattgttttcttgggat

SEQ ID NO: 72048 - DNA, 587 bp, Triticum aestivum
  Clone ID: PAT_TA_72048
ccacgcgtccgcttccactttcttcctccttcgagagctcctctaccctaacagcgccgccatggagaaacctggatatgatccaattgaaggcatcaaaagattaagaaagaagaggaagaaaggtggatccggtgaccctacctgtctgcctctggtgacacgctgtcttctcgaaggtcagcacctacacatatctgcacaagtagaaaaatcaggacatatcatggtgcctaaaatttcagaagaaccatcaaagcaaatacaaagccatatgaatgcagtgaaccaatttactcagtttcacaagaagggtcaatatattgcacatgaggatgctgagcaagtatggtgggatattggagcaaataatcgtgggcagaatgaagagggtcaatatcttgcacaaaagcatgctgataaagaggatcaacatatcagagcaattagcaactttcagaataaagagggattgagtcaacttcatcacgggggaaacaacaatgagatactgcatgagcaagcatcatatgggcatcaatcttacacaaccctaatgcagcaaatgactctcatgagtcatcttc

SEQ ID NO: 72049 - DNA, 490 bp, Triticum aestivum
  Clone ID: PAT_TA_72049
ccacgcgtccgctgaaatatgatatggatggggcaaatttggtgcgtacgaggaccatacgctctgagaatggactcaaaccagctgagcattcaagtgacaatctacaagatatgtcgtctccctgcgaaagcccacatgctggaaaagtcaagttcatgtgtagctttggtgggaaaatcctgcctaggcctagtgatggggtgctcagatatgtaggtggggaaacacgtctcatatcgatacccagaaacttctcatggaaggaacttgtgcataaaaccctctcgctctacaaccagcctcataccatcaagtatcagcttcctgatgaggaccttgatgctctgatttctctttcatgtgaagaggatcttcagaatatgatggaagaatactacagtcttgaaaaggccaatggctcaccgagacttcggatatttcttgtctccccaaatgattgtgaggagacatcgttaagtgcaagaag

SEQ ID NO: 72050 - DNA, 622 bp, Triticum aestivum
  Clone ID: PAT_TA_72050
ccacgcgtccgattttagatgttccattagtcttggctgcttttctcatccgttttgggctttaaccttggatctagaaggttgcagcttctttgttctcctactcaagattttctcattgttcagttcaagccatgttcctctggtatcttcctttacattttctttaagagatggtcagttgatctagccaagggcttctctattgttcatggtttattggaatatgttttgcttggctaacaaaatagtatgcatgtgtgtgagattacttctcggtaaatctaacataagattctacctttaattccaattttttttaactctcacaagctccctttgatgttatgtgttgctggaagtttgtacttgcaaagagaacaattgaaaacttgaccactacaattatatttaccggctataatggtaactgggggataagcatcctagacatttgtaccaaaatccttgggcgttcctatatggtctctctattttagagtatgatgccctcaacaattggaagaatcaacatgtaaatcaatttataattataaaaccttgtgagctggatctccattttcaattggtggcttttcttaaacattcataattttgaaag

SEQ ID NO: 72051 - DNA, 216 bp, Triticum aestivum
  Clone ID: PAT_TA_72051
ccacgcgtccgcagcgaggaacgatactggcttttccaacgtgaaaccaacctgaatttcagcggcgagaacgtcggggtcgctggaaaggtaacccccggggcgggagggcaggaggaggaacagcgccgggacgaggaccccgacagcgagcgcgagcacgaagactcaccggaacgagacggagcggtcgaccgcgccgcacccccaccctcc

SEQ ID NO: 72052 - DNA, 604 bp, Triticum aestivum
  Clone ID: PAT_TA_72052
ccacgcgtccgctgaagccggcgcccatacctcatctccatggcgggcatgctctgcgtcgccctcctcctggcgtccctggtctggccagccgcgctcacggccggctccgcgggagatggccgccggcagcagcagcagctcaccgcgctgccgccgaggggatggaactcgtacgactccttctcgtggatcatcggcgaggccgcgttcctcgacaacgcgcggatcatggccaacaggctgctcccgcatggataccagtacgcggtgatagacttcctgtggtaccggaggatcgccgccggctcgggggtgggcgcgtacggcttcgacagcatggaccagtgggggcgcccgtaccctgacccccagaggttcccgtcgggccgaggcggcggaggattcaggcccatcgccgataaggtccatgccatgggcttgaagttcggcatccacctcatgaatgggatcagcacccaggccgtcaacgccaacacgcccatcctcgacgtccgcacgggaaaagcctatgtagagaatggccgacaatggagggcgcgtgacataggcctcacccacaggacatgtgcgtggatgccaa

SEQ ID NO: 72053 - DNA, 576 bp, Triticum aestivum
  Clone ID: PAT_TA_72053
ccacgcgtccggcagagtattgatctaatactcatctgtatatatctttttaaatctaataagtgaacggatggtcatgaagtgatgtttaattatcaagatgtgaacttgttctttcgacaggtgattatgtggagcttgtgaaggaaaaaggcaaaccaacaagcttgggcaatcgtctattggcgacaacctggtatagatgacctacctattgttaattttccaactctcactttgtaggtctgcaattgtatctcctgtactaaacaagagagcatttaaatttgacgcctacaaatttgtggcttgctgcataggggttttccatatctacattctaatattctccatatttttttattaacgttcatatcaaatgtttgtggtatgtaggttcaatagttgacaaaattgaatctctcttaccagctatgacttcatggtcaatatatatacatgtgcaacatccaaaaagagagatgtcatcaaacttctcattaactttttccggttctactttctcctttactgttgaaagcatatggagtgctatcaatcaatatgaacaacttc

SEQ ID NO: 72054 - DNA, 213 bp, Triticum aestivum
  Clone ID: PAT_TA_72054
ccacgcgtccgggttccgatcggatcggggtgagaggacgaccaaccttcgtctcgactgccgccgaccgcccgagatggcgatccgccgtgggtcctcctgcgccgtcctcgccctgctcgcgctcgcctccgtcgccgccgtcagcgccgacgtcttcttccacgagaagttcgaagatgggtggcaaagccggtggctcaagtctgagtg

SEQ ID NO: 72055 - DNA, 546 bp, Triticum aestivum
  Clone ID: PAT_TA_72055
ccacgcgtccggagaggcgtatccctgcccggccacccaagccaagcccctcccgaatctctctctcctcccctcccctaccattgccccccgctccccctcccccacgacacgcacagatccaccgtccgtccatggcccccgcaatgaggccggagcaggaggcgagctgcaaggccaccgaggaccaccgctccgagttcgacgccgccaagccgccgcccttccgcatcggcgacgtccgcgccgccgtgccggcccactgctggcgcaagagccccctgcgctccctctcctacgtcgcccgcgacgtcgttgtcgtggcggcgctggccgccgccgcgtggcgggccgacagctgggccctctggccgctctactgggccgtccagggcaccatgttctgggcgctcttcgtcctcggacacgactgtggtcacgggagcttctcggacagcggcacgctcaacagcgtcgtcggccacctgctgcacacatttattctcgtcccgtacaatggctggaggatcagccacagaacgcacc

SEQ ID NO: 72056 - DNA, 571 bp, Triticum aestivum
  Clone ID: PAT_TA_72056
ccacgcgtccgcttatgttactatccattataaacgtagtaacatatatatgttactactctaagttacttcccactatgactagccttaggtcattggggcttgggtaattaaagaggagagagataatgacttgtacctttttgatgcattttttactcaagtccataatttgtcctaaaatttctagatgcacactcttcaccgacgaagggagtagtgtatagtataaaagaattgaatgagagctttgataaattgttgacttggtaaaaatcgggtgacaagtattcctgaagagatatactactactagaaacaccaggaataaaagcccggcccagcacttccgcaaccagcccaccaccagcctgacccgacctgactctgcatccacggcctagaaccctagatcgggtcgccgctctctcgtctcgtctccccctcgtgtcgccgctgcccaccggagatcgagcgatggctgatggggacctgccccccggcgggcgacgcgcacgctttcttcgggactaacccggcgcctgcccaggtgcctctccattctattctc

SEQ ID NO: 72057 - DNA, 581 bp, Triticum aestivum
  Clone ID: PAT_TA_72057
ccacgcgtccgagaattttaaagtgggtgggttcaatcttctcatggcttccaacctcaaggttttggcggtccacaacataattgaatattaccctcgctctgtagccgcggatcttctctcggaattggcggtggaaataacaaggagtaaaaagttattaccacctacagctggctctttactccagttggaaagacttaatgtggatagcatctcggctgtgcttgttgctccagtttgtcgactagtcgctgctactctcaaggagttagtgatcacgtgtgatcgagaggtggagaacttgacggaaggggaagagaaagcgcttcagctcctcacctccctccaagatctaattttttggaggtgcccaaatctgctgtccctccctcgagggttacacagccttccatctctcacgaaacttgaggtcattacttgtccacgaatcaaatcgctgcccgaggaggggatccccacttctctgcaagagctgacagtaatcggttgcagtgacgggctacacgaccaagcaaaggaactaataggatcaaagccggatttatccgtcagcacct

SEQ ID NO: 72058 - DNA, 438 bp, Triticum aestivum
  Clone ID: PAT_TA_72058
cgccgccgcccgaatccggccggttcccgcggccccggacccccgccgctcctgtccccgagggagcaatgggcagcatcagctgcagctacagtgcttgaggaggagggagttatggcgggaatggccgggaagggggacgagtctgttgctccggtgaggtccagcgaccggctgcggcagcggcccaagcactacgggcggggatacctgttctactcgcccaacatgcgcaacaagatgaactccatcatgaagcggacggctgcatcgcatatcgccaagaagctgcttcgcaagccagccgtacgggaacctcctgccgattctattgcaccaaatttgcgccgttcaacgcggaagcgaagaatgtctgtaactctggaggactatggcacagatagttccagtatggaagatgatgaccttatgagaccc

SEQ ID NO: 72059 - DNA, 612 bp, Triticum aestivum
  Clone ID: PAT_TA_72059
ccacgcgtccgaaaaggcgctacgtaaattccagttttacctgagataaactaatggtgttgtatctcgtctgtcctgttgaatagaaggaatcaaggaaatgatgacgttagtcttgatctgggaaagtgttcagttcaagtataggatatatgccattgataccagtacaacacggtttttgtttgttgcaaggtagcctctcttttttattttctggttcctcagaccattaccttttcttctttagaacttactccaagtgacaagtactgataagcatatccctcggatcactacctttcctttagaacacacacaacatatccagacacactcgggtatcaccctctcatacacatgggtaataccctctatctctaacagtatgtagacatatcttctctttgcctgttcaatttctttctcgttgctcttcagttgatcaattagaacatggtaccccatgcccacgatatactcatcgtcactgctccgattcgcccgaccccaacgactcagctacttcctatcaccacctggtactcctctttgcctgatgctcctgcgctgcttattgtgctcgccgttgctgatgtatttagtttcatg

SEQ ID NO: 72060 - DNA, 444 bp, Triticum aestivum
  Clone ID: PAT_TA_72060
ccacgcgtccggcgggcggagctcagatccccggcgagcggattccagatcgagaaaggcccagctcgaaggaagaaagaatggtgaaagatgtccatgagccacgaaatggcgtttctctgaatagttcatcttcgcaaagtatcgttaattcagaaaaggtttgtcgtggacaaattccagagttgacatgggaacacaagctaagccatgttagatatgatttgccgtcattcggacttacatggagggaagtacggcagatggctggtcttggtttacgtcttggtcgacacatccttgaagaaacttcaaaaggacgaactgctattattgatcccatgaagaagcgcactgcaagatctggtcagggtgttccacttggaggcattggtgcaggaagtattggaagaagctgcaaaggtgagtttcaacgctggcaat

SEQ ID NO: 72061 - DNA, 445 bp, Triticum aestivum
  Clone ID: PAT_TA_72061
tacccacgcgtccggttaaagtattgaaatgaagactactggacaatgcagagcaatttattttcctttcatttgttgcatactttgcatcaacttaaatttctcgtgactgcctaagagaaaaccatgcttgttttttttaaatcgagcaagacaccgtccttggtaaaaaagatacataccaatgtttgttttctcatgttatgttgcaatctcgagtctctctactgctttgcagcgagacttatattttacgaatctggctgtctttcttgaaaataattgagcttttgttttccacaacaaaaagacactaggaaatgcattcgtaagctgccatttatattaattgccattcttgcccacttcctctgattgcagctctttgtgtgaatcatttagttcatcagcagtcaggctttttaaatttcaggtatcccaccct

SEQ ID NO: 72062 - DNA, 443 bp, Triticum aestivum
  Clone ID: PAT_TA_72062
ccacgcgtccgaaaaatcttactggggtaaaaactgacaagacttttgctaaatggggtaattgggatgaaaaaaatgtttaatggggtaactagtgtcaaaaatgtggaagtaaagggtaaaaactggaattcactctaattctgttaagtcgtacttatacatcttacaaccaacatgtgtagtgatctactcagccaccttcttaaaagtgaaatttcttgccaattatagctgcatgcaagaattgattttctatctggtagctactagtatgttttagaagggagattactttgcttcgaggtacaggatgttgtgatatttgtttttatcgccttcttgtatttctgacattgacttccttcttttcctttcattctcagtgaacaaaggaagccttgcgccaaggagaagcggacgtggtgttcgactaggccaaa

SEQ ID NO: 72063 - DNA, 442 bp, Triticum aestivum
  Clone ID: PAT_TA_72063
ccacgcgtccgcaaaaggtacatggggatagcatatttaagttcagatatgccacatagtagaaacatttgtttttcagttttttgtatcaattaccgtgatgaaacatgcaatgttctcttatatttagctaataatcaattgtgaataggctaagtttgtaattatcattaaccacactatgatccattccggttgatatatgcaacaagatgaatctgtggtggttttgaacacttgggaggtacttttattctagaggaaaaaagggtttgtggttttttcgtccaaatcaagcatcatatcaggttgctacctacatgttatgttgagtaacagaaacaatacatttatgtatatggattggtagtcctcaatcaatattcaatcatgacttgatttatcttgcatgtttcttctacaagaaacactatcagattaa

SEQ ID NO: 72064 - DNA, 440 bp, Triticum aestivum
  Clone ID: PAT_TA_72064
ccacgcgtccgtttgattcctgtagagttgtctggactatctccttgcattcgcagctttagtcttttgcataatcatcaagacagtttcaaggatcgaagggatgtcaagatttatgcgccatttatcaaggtatgaattatgatgtatatcctattattattattgtatatgcccctttctattatctaaagttgaataggaacttgctaattacaggcttacagccttttgttattcatggtttaaaaactatgtaatatcgctaagcagaagctggtatagtggtatactcctgctcatcaatagtgttaattgttaatattagtatctctaggtatgtaattcattgttgttataagagcacacagttgaagtatattgcccacctatgctcatggttctagtctttcgggtgaaccagctggtttatgtaactc

SEQ ID NO: 72065 - DNA, 165 bp, Triticum aestivum
  Clone ID: PAT_TA_72065
ccacgcgtccggccaaggcaagctactagccagtacttggagaaaccaacaatggcgccgctcgcagcccggagccggaggccagcctgcctcctagccctcctctccgtcgccgcggccttattcctgaccccgccggccttggcggcgggggggggggggggg

SEQ ID NO: 72066 - DNA, 443 bp, Triticum aestivum
  Clone ID: PAT_TA_72066
ccacgcgtccggaatcctgccaatgttggggagcaagttgagaatacggtgggggttgttgaacaaaacacttctggtgatgcttctgttgaccatgtcactgaagataaaaagcccatgagaaacaagataattgaaaaggttgtgaaagttgttcgaaaaaagccaactgctgaagctccagtggataaatcacctcaagttgacaagaatgctgtggctgaaactgcgagcaaaaccgtctaaaagcacattgaacagaatagtgaggatcttgggaaagagaaggcgggagctggcatcgttcaacagcctgaggctaagaaaactgggaagaagaaggtcattcgcaggattgttaaaagaaaagttcctgcttcagcgactgagccaacagcccttgctgcacctgctgaggcaagtaaacaagatgtggatgttca

SEQ ID NO: 72067 - DNA, 443 bp, Triticum aestivum
  Clone ID: PAT_TA_72067
ccacgcgtccgcccacgcgtccgactcgttgcacaagaattcctcccacccccaccgtctcgccgccgccaccacagctagataagaaaaaaagagagagcagaactcgttgggagtgctcgaggtctgtgtcgggagagggggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgact

SEQ ID NO: 72068 - DNA, 442 bp, Triticum aestivum
  Clone ID: PAT_TA_72068
ccacgcgtccgcggacgcgtgggtcctatgcccccagcctccccccacgaacccacagcgcgcacccgagatccgcagccgaagcccgtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtcgcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgttgcttcaatcaaggagtaccgtaccaggattgaaaccga

SEQ ID NO: 72069 - DNA, 418 bp, Triticum aestivum
  Clone ID: PAT_TA_72069
tacccacgcgtccgctagttctagatcgagaggggccgcccttttttttttttttttgtgatggtatgtggcattttggccatatatttcctttgcttctagagtacataactttacatcaccttttaatcaaaaccatataacagtacatatatcggatcgctgtaacagaatatactttttttgatctacaacaaaatctgttaacgaatgttgatcctcaatgtgctccaagttaggtggaaaaactggtgcctactctaatggtcagctggtactatcttcaatatgattgtcctgagacgcaatctattcaacagtaacttttatctgttcaaagatgcttaaggtgacctcggaaaaaaattcagtgtttccttcggacgagccaccagtagcatcattaacttctattggc

SEQ ID NO: 72070 - DNA, 257 bp, Triticum aestivum
  Clone ID: PAT_TA_72070
caaaccatcaaacagcccatatccaaacccccgccctacgaatcccctctcggaaaccctaacctcactccatgccctcccggacccctccccgaggctgacggcgacgacgacgatgaggtcgctccgccgggtcctcctcccgcttcgaggacgacgccgacgccgcccctgcccccctcctcctcccgctccccctgacggcgcatcagccggcgccttccctcgcgctccccgccggcggggggcgaggggac

SEQ ID NO: 72071 - DNA, 641 bp, Triticum aestivum
  Clone ID: PAT_TA_72071
ccacgcgtccggcggcccatcggattcgtccatctcaagatctcatcatttagtgaaagtaaatcagatgacaaacggttctatatcattaccccaaccaagacacttcagctgaggacaggttgcgttaaggaccgtgtcgcttggattgaagcacttgtttcagcgagaagtgaatattctcttggtggtattttaccaagtgaccggaatggtggatcattttctacagaaaagctaagagatcgcttgcatgctgaaggtgttggtgcagaaattgttaaagactgtgagcagattgttcattcagaattttcacagtatcacgtacagatgaagcagcgttgtgaatcgtatttaagctttatcggcagtcttccacgggaacttgaggcagttaattcagaagatgcaactattcgtggcaatccacagtcgcagttgttcaagcctgacttttccagctctggaaaatgtagtgaatacagcaacacagaatcttctgaagatgctggtaaacaagaaatagggagaatgtcagatgaagatgagtttcatttctatgatacaaggcaaagttttagcgacggtgtggctagtcctgaattgaaagtgagatacttaaattatgggaatgaagc

SEQ ID NO: 72072 - DNA, 572 bp, Triticum aestivum
  Clone ID: PAT_TA_72072
ccacgcgtccgacctcgtaagaactttaggctcattctaactttcacttcttaccccccgcaaaaaaaaaactttcacctcttagtacatctccagccgttggccccccagggggcgtctaaaagcgccacctgggggtgagccggcgcaaaaaatggtcctgggggcgagtcggtccccagccgtcggcccccggggccgcccccaggcgcgtatttaaaaaaaaccgttcggcgaagttatgataaaaactagttatattccggccaaccatggcaagtttcggcgaaattcgtccaaacattacattaacttaatctaaagtaaaaaaagtggctgaagtcgtcgccgccatcgtcgtcggcggccttctcctccttgacgcgggtgcccctgctggacccctgcccggcgtcgccttggcgaacaggcggcggcgcgtcgtcgtcgtcgtcgctgtcgcataagacgacgaccccgccttcctcgcggctgtgtcggcgctccttgaagcggcgtagggcggcgcactggcgctccttctccttatcccggcgcgccttctccaacgc

SEQ ID NO: 72073 - DNA, 424 bp, Triticum aestivum
  Clone ID: PAT_TA_72073
ccacgcgtccggctgcgacggcttcaccgcgcgcggcctcgccgtcatcgccgagggctgccggcatcttcgagtactggatctgactgaagattatttccatgaggaggagagtgaagtagtggattggatctccaagtttccagagtgcaacacgtcgctggagtcgcttgtatttgattgtgttagtgtcccattcaactttgaggccctggaggcacttgttgcacgctcaccagctctgcgtcgtcttctcgttaatgaccatgtgtcgatagagcagttgcgttgtcttatggcaagggctcctgatctaactcaccttggcactggatcattccgatctgagccaggccctgggggtgctttgtctgtgtctgatcttgctacctttttcgcagcgtccagatcacttgtttgtttg

SEQ ID NO: 72074 - DNA, 312 bp, Triticum aestivum
  Clone ID: PAT_TA_72074
ccacgcgtccgggcttctcctccccactgagtcctcggttcccggtccggtcccgttccgttcgttagggtttagtagtatcggggaagaggaaggaatggcggacgtcgagtaccgctgcttcgtcggtggcctcgcctgggccaccgacgaccaatccctccagaacgccttctccaagtacggcgacgtcatctactccaagatcatcactgacagggagacgggccgatcccgcgggttcgggttcgtcaccttcgcgtcggacgacgcgatgcgccaggctatcgacgccatgaacggccacgacct

SEQ ID NO: 72075 - DNA, 588 bp, Triticum aestivum
  Clone ID: PAT_TA_72075
ccacgcgtccgaagacggccactccctcccccgttccgccctcatcatccatcccatcgacacttcctcgccggcggagatggcggcaatgcggaccctccacaccgcgccggcctccttcatcgtgccgcccgctcctcatctcgtctccccgactccaaccccaagagcaggtgccctgccagcgaaggctcctcctgctgcggcggccactatccagtcgcatgcccgcccccccttgtcgccgcgcgtgggccggcgccggccgtgcgcgagagccgcgtcgtccggcggtgcggtggtcgcttcactggaagatgccaagagggacgtgctcatcgcgctctcccagattatcgatcctgatttcggcacggacatcgtctcgtgtgggttcatcaaggatttggagatcagcgagaccttagaggaggtctcgtttcgtgtggagctgacaacccctgcatgcccagtcaaggacatgtttgaagaaaaggcaaatgaggtcgttgcagcacttccatgggtcaagaaggtcaatgttacaatgtctgcacaacctgcacagccagtttatgcaggggacct

SEQ ID NO: 72076 - DNA, 624 bp, Triticum aestivum
  Clone ID: PAT_TA_72076
ccacgcgtccgggaaaaatactttgaaactgttgttgccttgatgtcagacaaaattgatggggaccttccccttgaccagttaaagatacttacatcaaaagaatcaaaaacagaaaatacacaatattacctacaaatttggccggaaaagaagcaagttcagattacaaattttccccacccatacccccagcttgcttcattgtataaggaaatgataaggtaccagcgcaaagatggggttcaacttacagcaaagttgtatctacctccaggttatgatcaatcaaaagatggacctttgccatgtttagtttggtcataccctggtgagtttaaaagcaaagatgctgcgggacaagtacgtggttcccctaatgagttttcagggattggtgctacatctcctcttctttggttggctagagggtttgctattctttcaggtccgacaatcccgattgttggtgaaggtgatgtagaggcgaacgacagttatgtggaacagctagtaactagtgcagaggctgccgtcgaggaagttgtcaggagaggggtggtccatcctgataaaatagctgttggcggtcattcgtatggtgcattcatgacagcaaatctc

SEQ ID NO: 72077 - DNA, 680 bp, Triticum aestivum
  Clone ID: PAT_TA_72077
ccacgcgtccgcggacgcgtgggttcctggccatgtcgtcccaacccgccgccggagagcagtaccagctaatctacggttcgctcccggcgcaaattcacccctggcttgattcgctgtaggcatcaccaccatggatgatagtagttcgcagtccggcagctgtggagcaggcgacgctcgttatggtaaggacgtcgctcacgctgctgcaccttgccctgttgctcacccggagggctcatcttcaactgctaagtcggcagatccacctgcgcctacatcacgcatctccgtcaagcatgcagctagtgtcattcagaagtttgacgactacaagaaatggttagtagagcagattggttttgggggtatgctaaagctcccagccgtgcagaagctgagtttgaagtgtagcgcctggataatgagtagagtcagtgtgagccgtagggagatgaaacttagggataacaaggtactcaggtttttccccgaggatgtccacaaggtttttgggatcccatggggtcaccgcagtgtgaaaggcagggatgcaatcatcaatcctgaagctgttcatttcataaagacaacacttcaaatggataaaactggagttcatagcttgcgagctgcagaaaatttcttgttgcgcgatatcaatgagaattcaagca

SEQ ID NO: 72078 - DNA, 610 bp, Triticum aestivum
  Clone ID: PAT_TA_72078
ccacgcgtccgcactggaatctgtgaacgagaactgacgttctcacatctttggctggtgtaggtacaaccaaacgaaaagagctacatggtacaactagagtatgtgggttgtctggtacctgggcatcagagagaactgctgttaagcttcaaggctacaggatgaaatttctttgtgaccaagttggtcagaaatactctaattttgttctgttaattgataaaactatagcacatgaagctgctaatttggacattgatctgtttctacatgacaagatggtgaaagcttcagtatctccttgtggcctttttgagttggatgttcaacagctggagcaagcaaagctatttcaagcacttctgttcaatggtttgttcggaaagttgttcactggatcaaaatcatccggcgttccacgggagtttattctcagtaaagatgacacgtttatctggaataatccaaatatgtatttgattttacctatggatcctactgtggagtcccatgacatttcatgcatcaactggagagtgattgatgaagccgctacagctgttaaacttttgaggaagatttattctgaagaaaaaatgaacatact

SEQ ID NO: 72079 - DNA, 547 bp, Triticum aestivum
  Clone ID: PAT_TA_72079
ccacgcgtccgagagctggtcgttttgtgttcttgatcaagttaactggagccagtggacggaagtttcctgtggagggttttcatgatttcacaggacgcaacaatgtattattcactggaccgaaggagcaccggcattgcttacgcctcgcaacgaattcacaattgttctcatgatgaggcggcatttgctgttgaagcagtttgggtacctcactacatgtgtatcatcttgatcagcatctgctatgccgggagcagttgaagacaagggaatcagattccggcctcgcgtcgatcccagtattgcagcacagatgagcaggggctgattgcactcaagagtccagttagcgcttctgtttcatccatccagacagaggagtgggcatgccaatgtgaattccactctgctaccatccatgtacttgtgcttagaagatgactatggtaaaagaaagcctcccctttgtttgtactttgtagcctccctcgagacattgttgtttttgtaggccattattattattatctcttgttacatt

SEQ ID NO: 72080 - DNA, 678 bp, Triticum aestivum
  Clone ID: PAT_TA_72080
ccacgcgtccgaaaagatgtatattttaggcttttagagctggccacacaaatttagagtgttggtgacatgtctatatggcccatctctttttcctcacaaagccattaagttctccttttcctccacaaagcaaggccttgcaagcacactcttttttttgacatttttaagggcaagtaggaagacattggctaaaattgcattggaactttggaagtgtaggacagttattttgacaaaacttggaggggctaaaaggacgcttattttgaaatggagggagtaagagaaaaccaagacatattcagataattgaaaatatatcacgtaccagttatgcaccatctgtttttgggaaaaataataatagcagattgtttattttattggagtaaatctggaaggggcagcatttgttagtttttggaggtgtacaaggttttgattagtgaactagtggtgccttgcaggaaaatatccactcatatttcacatgtcctgtgacctagtacccagttaatgctggttcccttatgttataaccaaaagtgtgggtttaattgtgttcactagaaacaaagcactatcatgatgatgtattcttgaataccaaaggcatgccagaatcatcctacaactctctgatgagtttatgcccttatcggtaacccattt

SEQ ID NO: 72081 - DNA, 631 bp, Triticum aestivum
  Clone ID: PAT_TA_72081
ttacgactgtgatgtccactcatcgaacatatttgagaggatggtcaacggtctgcttaaaacagctcaagggcctcctgcgggtattgctaccacattggtaccgcctcaggataccacaatgaagagtgaagcaatgaaatgcttagtttctatcctcagatccatgggagattggatgaataagcatctacgtattccaaatcctgactctcctaagattgaatcaaagcaaaacgataatgatggtggaaatgagtttccccagacagagatcaatggagatgcatctagcgaggtatccgattcacattcaaaagtatcaaatggggtttcagaggctgcatctttggagcagcgtctagcttacaaaatggaacttcaggagggtatctctctgtttaaccggaagcctagaaagggaattgaattcttaataaatgccaacaaggtcggggagtcatctgaggatatagctgctttcctgaaaagtacttctggcttgaacaagactatgattggtgattatttaggggaaagggaagatttatccctcaaagtcatgcatgcatatgtggattcttttaattttcaaaatatggaatttgatgaagcgatcagagcctttctt

SEQ ID NO: 72082 - DNA, 665 bp, Triticum aestivum
  Clone ID: PAT_TA_72082
ccacgcgtccgaaggaaatgaaaaacggatggaggaagggaacttcttgcttttcttttccttttgtttctctgtttgataattactccctacgatgggaaggtttgggaatagaaacgtcctactctttgatcccttttagtgtgaacggctcgacggcaagcgcggcggtctgctcctcgctctattggttgtgtctctgccttccccgtgcactgcgccacacgcgtgtttgtggcttgcgtgctgctactgctgtgtttatggtgtgttggcttgatgtgtgtgtgtgtgcacgcactagctaggcgaggatcactggctcactgctctctctagcttcttagggaaaaaatattgcatctggtctgtatcatgctagcatctttccaggcaggtagatgtttccaagatcaagagagaaaaggttcttgcatgtatagacttttagatggcacatgaccagaagtctttcctatgaaaatcatgtggccttgtgatgccctgacccttttcttcagaaatttgtgatgtgtttatgcatgtctgtgttgtgatgtgcataggagcatgatttgtcctgccactttatgcattagcacacctataatacaggtcttgagtctacaaagtgtcctatacattgtgtgtgtgtgtgtgtgtgt

SEQ ID NO: 72083 - DNA, 354 bp, Triticum aestivum
  Clone ID: PAT_TA_72083
aaaccctaacccatgtccgctatcccgctgctctccaatccgcgacctagcctgaggcaccgccggcccctcttccggtccggcatccaccgcaccggcctgaaccgcgcgcggggatggaaaaccccgacggtcaagcggaagccgacgcggggcttccaccgcccccaccgccgcccctggacgccgagggggcgggcctgggcatctacccggccgaggttctaccaccgccgcccccgcatctcccggggggcgccccgcacgaagtcgcggcgcagggggccgacggatccgcatacccggccgatcacgcctagctgaacgggacctccggcgacgcggagggctacc

SEQ ID NO: 72084 - DNA, 422 bp, Triticum aestivum
  Clone ID: PAT_TA_72084
ccacgcgtccgcaggcgcgtgcatctggttcgtgaaactcactccagcgaccttgcacttaataagccatggcgggggcggtaccgctccggcccctcagggactgcatctgtgctactcctcctcgccctagccctctccgcgctcgtgccggcgccggatgcgtacgattcgcttgatccggttgggaacattaccatcaagtgggatgtgaaaaagtggagccatgatggctacgaggctactgtctcactctacaactaccagcagtatcgccacatgcaagcgccgggatggaatctcggctgggtgtgggcggcgaaagaaataatctggaaaatgtccggcgcccaaaccacggagcacggcgattgctacaggttcagagaggagccgacgccggactgctgccggacggaccc

SEQ ID NO: 72085 - DNA, 590 bp, Triticum aestivum
  Clone ID: PAT_TA_72085
ccacgcgtccggctcgcctctgcttcgagctggtcgtcgccgtcggcgagcgggatcacacgccactcgcgggatgtcgccttcgtcctcggcggcgaagaccgtcgccttcgtcggcgccgacgggctgagcgccgcgctcgccgcttctttcgcccgctccggcgcgatcgtccgcttctacatcgaccgcaaggcggatggatcggcggcgacggcgctcgcggagcagggcggcggcgtccgatgcgtgagccccgctgaagccacgcgagattctgcgctagtcgttgtgctcagtgacgccgatggtgtagatgagttgttctttggagctcagggtatagtgcaaggattgtgcaaagaggccgttgtattaattcggtcgacgttggtgcctagccatcttgagaagttggggcagaagcttgcagatgagaagaagggtatcttccttcttgatgcttacatttttagtggtttatctgatgaactgaagcaaaatattgtcgttgttgcatctgggagaaaggatgtagcagaaagagctgggcaattcttctccgatcttgacaaaaccaattactttg

SEQ ID NO: 72086 - DNA, 226 bp, Triticum aestivum
  Clone ID: PAT_TA_72086
ccacgcgtccgcccacgcttccgccaccacagccccactctcaaagagcacggacgccggacacacacaaatctttttgaagcaatggctaccaccccgatagctctctcctcctcgcacttagactttaaggagggagccaaattgaccattctgggcaaatgtggggaggcgcgcgtcaccatgcgcaagaccgcggccaaggccaagccggtgtcgtccggca

SEQ ID NO: 72087 - DNA, 677 bp, Triticum aestivum
  Clone ID: PAT_TA_72087
ccacgcgtccgcccacgcgtccgatttaaggcagtcatcattctttcaagaatgttaccaatacaacactgtttttgtgttccgaattatgcgtaaatgcccaagggcagtggaccaaagtcaacaacataagttgtttggcaaatgtgtcttagttccctttcagtctcttttgtaacatcatctcttttaaaaaagatcttttctatatcagtgcactgtaaatatagaaatgttggtttaatcgagtgtgagattgtcggttaccatgaaggaaatcactgtaagatttgagagatgcaaggctaacgtaaaagcagtaagagtctttgagatgccaaaacttctctcatacatgtattttgtgtacatgtaaatcttgatcttccagcaacattgacagcaggataattctctttcttttagttgaccacaacatgtgatcagggcccatttggaatgcaactaatgtcaagtgcaccatcatcttaagcattatttactcatgttgtcactgattgcatatacaataccatcagaagcatccattaaaaatgtgtccttagaagcatccattcaaaaaagtgttgaagaactatagaaggctgggtgttggctgatgttgtttcggttaccattccttgtgattctaagttatttgcaacatagtaaatact

SEQ ID NO: 72088 - DNA, 237 bp, Triticum aestivum
  Clone ID: PAT_TA_72088
ccacgcgtccgcccacgcgtccgcccacgcgtgggcagtgacatataaagtgtcaaacaatgtgtaatatgactttcctatactacttgattaaattgtaaattaaaatataaataaagttgtttcaaaaatatgttcatattgatattgtttggatgtttatctgattgccatgcttgtaagtttataagtttgtctttactattcacattcgtaacctgatgccttaattaaaaa

SEQ ID NO: 72089 - DNA, 148 bp, Triticum aestivum
  Clone ID: PAT_TA_72089
ccacgcgtccggttgttcgaggagaggggagggggagagacgagaaggggaacggaaaagaaagccaatccctctctcgcggaggccaacggcgaggctttctcccttgcgccctcgatcagttcagcggttcggctcctctctacca

SEQ ID NO: 72090 - DNA, 503 bp, Triticum aestivum
  Clone ID: PAT_TA_72090
ccacgcgtccgcgcctaccgcccccaaatcgggaaaccctagctctgccccacccccacccccaccccggagccgggcggcatggccgaaaccggcgacgacaagctcgcctacttccaggccggcacaggcattttcgaccccgacctttggaccgagattcttgggggcaacaactgggacctccagcttgccgtcttcttcattaccggggaacccttcttgcccgagccggccaattacgccccggcggccccggcttcggtggagtccgattccattggctaccacccccctggaccgggttcggagcagcagcagcagccggggatcgcgtggaggctggtgacgctccccttctacgtcgtcttcggggggggcgggcttgtcaccggttccattcgtctcggtggctgggtcgcaagcggggtgctggcccgatcccttttccttcttgggcttgcgcagcgcgggggggaccggttgcttgaactggccccgtc

SEQ ID NO: 72091 - DNA, 646 bp, Triticum aestivum
  Clone ID: PAT_TA_72091
ccacgcgtccggttcttccacgcactccagggtcatcatgggttctcatcctgctctttcggcatttatgactggttgctgctctacccaaggtttcatccaaaccattgaacttgacagtaaaactctatccaaaattctgaacaagtgtataagagtgttgatgatgtggcttagaggaggcctcgacttgcaccaaatatatgctcatatgcaactacagcctatgcaggcgaatcatgcgcttgtgccgagctgatccaagcatgaaaagcaggtgaatgagaagctgcacaacccgcacacttaaacgcctaggtgaagcatcaaaattcaatataactagttctggacatggacaagggcttcatttgatcttttgttgctctcaagccatattttccctgtgtgtctctttgtgcagtggtttttacagaggaattagtccaggtgctactggttcatttgctacaggtgcaacatatcttgaatcaactaagacatggatggagcacgctaatcctaatctaagaggtcattggtctcactttattgctgcaggaattggcattgcaatcattttcctctgatcttcctatttgcttgctccgcggggcaaaactcgggaccaatgggttgtcaagtg

SEQ ID NO: 72092 - DNA, 649 bp, Triticum aestivum
  Clone ID: PAT_TA_72092
ccacgcgtccgcgtgtactgtcagcacgccatgtccaaacagcaacagtcgtccgtctgcaggtgtgacgaatatagcaggcagttcgattattcggaaatggccatgctcaaccattcggacatgtcgccgtgcaagctcagcaagagcatggtggccgtgatcgccatactcacggtgttcgtcgccagccttggcaccataaccatagtgctgtcaagaaaagtgcggttgctgggccgccgtcctaggatcaagaagcgcatcgtcgtgaacaagagcatcactcctttgacgtgccgaccgccgcaacaggagaatcaacagtgcgaaataaccatcgaaaactgttgcaacatgaacatttgcgagacgccatgtttcgaaccggatttccgaccgcccaagatgggaggactgatgtcgttgggaaagtcgaaaaaagaagacaaagcgaacttgctgagcaacacagacatgtcgagtgaagacgaaaaaccgttgtattgatgtagtctggtataaaattgaaatgtaatttattcgtttttaccaatgtttttacttaaggggctgtatatgtataacacgctgtgcgttgttgttgtcgttgttactgtagttggacaaatttgtgatattctatatt

SEQ ID NO: 72093 - DNA, 649 bp, Triticum aestivum
  Clone ID: PAT_TA_72093
ccacgcgtccggttgccattgctaaaaatgggggtgctactgagctgtagtcgacacagcggaagtgccgtgtgccatgtccattggctgagcggctaggtggagttgccgctattgaaaatggtggtggtaccatgaggaagcagtgaacttgcactgccttaaatgcaccaacgatggtgttattcaaagatttcttaagctagaatatcgatatttagtttggatgaaatagttaggtctatcgcaaaaggcatgactatcttgcctaaataaatgctttatgcccgtaccatatactttctccagtcgaaaacttccctttattttgtaggaaacaagagaaaaagctagttctgatctcatggtgtgcatgtagtattgtggaactcccatgctctaaaaagggcaaccaaattgtgcagattaatctcttgcttggatgtttctgacgaactatgaccgctttataattttgttcctggtatggattgttcattgccattttattatttttcctgataatatatggatgttcattgcataatccatttgcttttcatccgtgttttactatttttttatggtcatgttctattgtgtatctttgtaaagaatcagcaaattatttatctgcttgttgctacac

SEQ ID NO: 72094 - DNA, 229 bp, Triticum aestivum
  Clone ID: PAT_TA_72094
ccacgcgtccgctcgctgcttctccaccgagccgatcacgagcagcaactagttgagtgcaagccgccgctgtcgccgtcgccgtcgccgtcttcttcttcgtctccgacaggaggagcggcaggaaaccccgggaggagctggccaacctggatcagctggagggcggcgccgcctccgtgcacgggcacgatactgatgagcagcgtaacaagttcctggtgctccg

SEQ ID NO: 72095 - DNA, 562 bp, Triticum aestivum
  Clone ID: PAT_TA_72095
ccacgcgtccgttcattggatatactgtatgttagcacacaaggtacaactctatgaaaaacaacaactggatattatgcatcttatcaaattgttaactcttgaggagtttaacttaaaaagctattttcgcaactattggtactactgtagtctgtagatgtgcagagatcattctaggggtattaagattagttttccaaaccatgtgtaaatctaaattctaggtgtgcagagatctattttcccaactattggtactattgtagtctgtagaggcgtagatatctattgctagcaatctaaatttctagatcagcagcttggtcttaagcttacaaaagactactttgtctgagcaataataggatgtaattgttttgagtgctagacatgggtgttcgtagaattttgtcctcacttcttggccccaattcagattagtttttttcttctcacgagtgttagttcatttggtgcttttgctgtcatacttagagccctggttcagaatagtttttttccttccagttcaggctagtgatttttgtatatcaatttt

SEQ ID NO: 72096 - DNA, 692 bp, Triticum aestivum
  Clone ID: PAT_TA_72096
attttcgccaacccacccttccggtcttcactggaatactctgttacatgggcaaaggtttcactgcagggctgagctggggcggaaagatcgatttggacagcctatttattgcccattacatgtgtgccatcattccttatccaagagaagctgccacatttgagaatatcagtaaggatgtgcatgcagtgatttacagtttgatcgagctctacagaattgacaacaagcttccaccgtatttcgatgatttggtttcttatgcagagcgtatccccaacaatattgctacagaccctgcagtccttgaggaatttctggtggaactgattaatcatggctctttccagccggatcctaacatagtcgctgccctgcaagagttccatagcaccttcaaaaaccttggtatcgatgaacaggaagattttactgaggaggcagaggctgcaactcttgtcttgccagcaaattggccaaatacagttcaaactgacagactacttagcttgatcttcagtcgcagccatgctctcctgagaacttttgcttctgaagtagcgttccatagacattttaccgtgcacgtcattgatatcattgtaactccgcaagagctgcagtgcgtcgtctccaagccacttcagcttttcccaacgcctatggatctactgcattggatcttccac

SEQ ID NO: 72097 - DNA, 600 bp, Triticum aestivum
  Clone ID: PAT_TA_72097
ccacgcgtccgcggacgcgtgggcgaccctgctgcaccggtgcggaccatgtgttcgacagattgtctagtccaggatggcgactgggtgcagcctgttcatcttgtggacaagagcaaaacttggtccctgccaccagtacggaagtggatcaagcagcaaccatggccgcctccaattcgagtgcagattgcaatggacgataatattcaggtcgttggcatagttgcgaatgatgatactggctatgtgtggtggccacctgactatcagccaatggtatggagcaaagtgcaaaaatggttactcccaataccaagatgtttgacggatttcgctacctgttttgctactggtccggttatgatctttcttgacaaggggatagcagattctcaagtactactgaagtgtaatttggctctccatgctgggtcccttgatagtctctgcaacacaactacttctctgcctgcatacaagacacttcaatggtttgttaattccttccattttcctggttgcattggtatatctgcttttcatagtcctattgctatgtggtgctcggacgcgaggagtttgagtgaccaccgtgcc

SEQ ID NO: 72098 - DNA, 633 bp, Triticum aestivum
  Clone ID: PAT_TA_72098
ccacgcgtccgctcctacccccagatccaccacccgccccggcgacggccaccgccatggacgtcccaaccacgccgtgcctcctgctctcgccgacgtccaaggacctcatcaccggaagctccttcgcctcgcctccttcccccacctcctcctcccccgaccccgcctccccgctcgacgccttcgcctccgatcccgtcctctccgccttcctctccccgtccttctccccctccgacttctcctccgacgagctctactccggccttgccgcctcccgcgccgagcagctgcaggacgccatccgcctcctccgtcgccacctccgcgccgaggtgctgcgccgacatccgctcctcctctagcacctactctccctccgctccgcctccgcctccctctccagtctcccctacaacctccgcctcctcttctcccacctctccctactctcatctcacctctcggcgccgcgcgcccacctcgcgctctcctcctactccctctccagcctcctcgccaccgccgacctcctcctccactcccaccgtctcgtccgcctctcctcacgcctcctcgcctcctcccctgcccccgacctcgcccgccaggctgagctccatcgcgaga

SEQ ID NO: 72099 - DNA, 198 bp, Triticum aestivum
  Clone ID: PAT_TA_72099
ccacgcgtccggttctagatcgcgagcggcgccctttttttttgtttttttttgttgttgaatctttctatatgatcaagaggcgctactacaggcaagaccacggagacaatagcgcctcctcgtcctcctactattaaggttctgattcggacaacaaccccgcggaagaagaggtctaggaggaggaagtagaag

SEQ ID NO: 72100 - DNA, 296 bp, Triticum aestivum
  Clone ID: PAT_TA_72100
ccacgcgtccgctccttgagatctctagtcagatggatgttacaatctggtatcagagctagtagttctcctggagaagccatggtaccggagaaagcaagctgccatgatcatccccatggaggagcaaatcgatgcactcatggtggctgtgaacgaaggatgagtgaaggacaatgacaagttcgaggacctctggaggtcagcagtgactaacctttgtatgttggcggacatactgcgagagcaggtggggaaagccacgctacatgcaaatcttgtgacctaggctgttg

SEQ ID NO: 72101 - DNA, 622 bp, Triticum aestivum
  Clone ID: PAT_TA_72101
ccacgcgtccgcccacgcgtccgcggacgcgtgggctgcactgcatgagctttactctgttagttccgtgatcaacttgtctatgcagtccaagccttctaaacttatttgcttactgtccatggcttgatgtgattttgtgcttaaaatagtttgctagattggctaatctcgatctgaactgtatggttttgtttcaatagttctgcagcatgagctaaattctgttatccattagcatggttgacttgtcatttatgcggaagtttttggtaatgtgattagtagtgtatgtacagatatggaaggctgcactgcttaactagcttgttgtatgtattgggatagtactgtattaatttgataccagtaattttatcattcctggactcagctcgtttcagacctgtgctgtgtgtattatatgtagcctagtgtaaatatcagtgacgtcccaaccattttaaccatgattgatagtattattactttagatttgactgtgaaatcattaaattgatgatgtgcttttggtaactgtattctaatgctctcatatttaagcaatgcatggattaactcatcctcgtcgattggccctcttttaattactgctttggat

SEQ ID NO: 72102 - DNA, 372 bp, Triticum aestivum
  Clone ID: PAT_TA_72102
ccacgcgtccgcgtctagcgcgtactcgcctacgtcccccgtccactacccccgtgaccaagctgccccatccaccaagccggacgcagttcaaatttcgaatctcatcaggcagacgcagctccatccaccggcggaaccacgccctccccattgcagcacctggatctcgagatttccttacgattcgtcgatgaatcgcgatggggagtcattttcatggatctcatgttcagcttctgttcccagccggtcgatgtcgatgccgttccagatctgggaggactagaggaagggcagggcggcgacgagtgcggggatggaggggaagatgaagatactgattctccttcctcaagttctgcatctcac

SEQ ID NO: 72103 - DNA, 594 bp, Triticum aestivum
  Clone ID: PAT_TA_72103
ccacgcgtccggggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacctctggagaggggttgtac

SEQ ID NO: 72104 - DNA, 551 bp, Triticum aestivum
  Clone ID: PAT_TA_72104
ccacgcgtccgcaaaaccaagcaacactagttggcactaatccaccatgaagaccttcctcatctttgccctcctcgccgttgcggcaacaagtgccattgcacaaattgagaatagccacatccctggtttggagaaaccatcgcagcaacaaccattaccactgcaacaaacattatcgcaccaccaacaacaacaacccgtccaacaacaaccacaaccatttccacaacagcaaccatgttcacagcaacaacaaccaccattatcgcagcaacaacaaccaccattttcacaacaacaacaactaccatttctaccgcaacaactattaccatttgttcatccatctatcttgcagcagctacacccatgcaaggtattgctacagcaacaatgcattcctgtggcaatgccacaaagtcttgctaggtcgcatatgttgcagcagagcagttgccatgtgatgcaacaacaatgccgccagcagttgcctcaaatcccccagcatttccgctatgaggcaatccgggctatcatctactccatca

SEQ ID NO: 72105 - DNA, 459 bp, Triticum aestivum
  Clone ID: PAT_TA_72105
ccacgcgtccgcccggctctcggtgtcggccgcccccatctcctcccccgatcctggctcgccccgcccccaccttctccctcactcccggcgcctcccgacccccatattctccctcactcccggcgccgccccgcccccacctcctccctcactcccggtgccgcccgacccccaatctccctggatccgcgtgcgtcgacgccggcttcgcagcggcgcttgatgtggagcgcgccggagtttcctcctccacgaccacgcagccgcagcggcggaggacccgaatccctagccagcaagctcacgcagccatggatccatgggtacgaatccctccacttctctctgagggaagaacactgctctgctacttcctgggtcgccatggaagaaatctcaaactttaacatggactgaataatgttgatgcataattcaaggtaaagaggtcaacct

SEQ ID NO: 72106 - DNA, 160 bp, Triticum aestivum
  Clone ID: PAT_TA_72106
ccacgcgtccgcgagcaaggtgagggccgtggtcaggttcaacgctcttgagcttattcatctgatctcgccttccaaacagcatcatctgtagtatccgtgggattgcagtgtgcctgtagccaaggacttcactatgggtgtgactaatgttgaccat

SEQ ID NO: 72107 - DNA, 560 bp, Triticum aestivum
  Clone ID: PAT_TA_72107
ccacgcgtccgctcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatcagcaaggagtgctgctccggtgtgcaggggctgaacggcctggcccgcagcagcccggaccgcaagatagcgtgcaggtgcctcaagagcctcgccaccagcatcaagtccatcaacatggacaaggtctccggcgtgcccggcaagtgcggcgtcagcgtgcccttccccatcagcatgtccaccaactgcaacaatgtcaactagttcaatatataacccttccgacgtgcatgcaaggacgcgcttgtgtggagcttaatgtctacgttgatggagtgctcatacgatactgagctactaaataataaaatgaagttgcttgcgtgtgtt

SEQ ID NO: 72108 - DNA, 525 bp, Triticum aestivum
  Clone ID: PAT_TA_72108
ccacgcgtccggattggagacctcacgggatggggatctggctctggtgggcttatgcctctgttctcgccgcccagacagcagcagctgtagtatccgtgggattgcagtgtgcctgtagccaaggacttcactatgggtgtgactaatgttgaccataggtacccgagctttgaactacctccgctgccaccatctctgagccgctgggaactgacggacgcgacctcgccacgactgtgtacaccgcagatgacgactatctgggagtcggctgccttctcgtttggcccctgctggttaccaaactgggttgaggcccaggcggacctgccggttagagagcccagctgggctgttggaccggaggtgatttttaggcctggggtggctggtattgggagcaggcctggcctgagcgagccgacgccttggtcagatagtacgggaggttttgctgatcatggattacagagggagcatgcccaatgatttgctgaaaaaatgcgtgcgcggagggcgctt

SEQ ID NO: 72109 - DNA, 358 bp, Triticum aestivum
  Clone ID: PAT_TA_72109
ccacgcgtccgggaggatgcctggagcgagggcgccacctccgcgctcatcgacgcctggggggagcgcttcgtcgcgctcggccgcggcagcctccgccacccccagtggcaggaggtcgccgaagccgtctcctcccgggacaactactccaaggcccccaagtccgacgtgcagtgcaagaaccgcatcgacacgctcaagaagaagtacaagatcgagagggccaagccggtctcgtcgtggcagttctacgaccgcctcgacgtgctcctcgcgcccacctacaaccagaagccggccgcccaccctaatggacggaacgcggtgcccacagcgctgcgcgcgggcttccctc

SEQ ID NO: 72110 - DNA, 445 bp, Triticum aestivum
  Clone ID: PAT_TA_72110
ccacgcgtccgcccacgcgtccggttgtactagcaattcctttgtgcacaagaaacgtaagtgacttttgggcttggtactatgagaaaaatggagcttttactgtaaagtcggcgtacaagatgcttgttgccactaaacaaagaagggaggcgtggttagaagggtctgcgggaacttcaaactccattgcagaggagggatcatggaagagattatggaagacggaggtgccggggaaaattcgcatgttcttatggagactgtcgaagcactccctcccaacaaacgatgtcagggcaaaccgacacatggctacctctgaccagtgcgggctttgcggtaaccgggattcatggcgtcactccttgctagagtgctcatcatcaaggagcgtttgggcgctcattgatgaggatgtcacacataaaatcatagggagcac

SEQ ID NO: 72111 - DNA, 448 bp, Triticum aestivum
  Clone ID: PAT_TA_72111
ccacgcgtccgctagggagatgatcaaggagacaaggacatgagcggcaacaagaaggcgggagatcatccggtggcggatgcggcgtggccggcgaggaggagggacgggatgggcagggcgggcgtgctgctcatcgcgtgcctgttcacgctgccgttcatggcgctcctcttcggcggccgggcgggtgcgctggccgtgtggcagaacgccgccaagctgaccgccatgggtggaggattactgaacgtctctcgtcagagcgccgccggtgcggacgagctctttggcggcctgctctcgccgggctccgaccggcgcgcgtgcctcagccgctaccagtccccgcattactacaagcactccccgtacgcgccgtcgcggcacctcctgtggaagctgcgcgactacgaggcgcggcacagccggtgcggccccggaacgc

SEQ ID NO: 72112 - DNA, 418 bp, Triticum aestivum
  Clone ID: PAT_TA_72112
ccacgcgtccggtggacgcgcccgcgagagccgacaagcgcgccgccccggccacgacgaccaccaccacgcctcctcccagcagcagcggcggcaacaccaccaccaccacgagcagcagagcggcggtggcggcgccggagccggcggcgtgcaacctgtaccaggggtggtggacgtacgacgcggaggcgtcgcaggtgccgctgtaccgggaggcggagtgcgagttcctgacggagcaggtgacctgcatgcgcaacggccggcgcgacgactcgtaccagcggtggcgctggcagccgtcctcctgcgacctccccaggttcgacgcgcgggcgctgctggagcggctgcggaacaagaggctgatgttcgtgggggactcgctgaaccggaaccagtgggagtcgatggt

SEQ ID NO: 72113 - DNA, 608 bp, Triticum aestivum
  Clone ID: PAT_TA_72113
ccacgcgtccgccgaaccggagcggagcccacccattcctccccaacctcccacgtgtttcctccttttccccgattcacctgccgccatgagcacaccatgcgccgccccaccgccgctcccagccaccgtgccaccccgccccagatcctgccgtcgcagcgcccccacccacggatctggctgtcgcgcctccccgctccaaccccagctttcggccacgcgcaagactccatctggcggcgccacggcgacctccaccaaccaacctccgctcgtcgggatccttcggctgcgcgacagccaccaacccgtgtcccaagacgccgggatcctgccaccgcgcgaccctcctccaccttccactgtgaccttcctccacttgccaccacgaccttctcccttccgccgcgcgcccatcgcctccggcggttccgcctgcatcacctccacctctcattgccagcccccgtgtgcggctccctccagttccctctgcgcccgcctccagctgaatttccccatccctgcttcctcccggcccctacgtccctggtgtcggccacgtgcatcacccccagacacacacctctcggcgagtggagctc

SEQ ID NO: 72114 - DNA, 596 bp, Triticum aestivum
  Clone ID: PAT_TA_72114
ccacgcgtccgcaagaaaccctcgggccgcaggcgcggctcccactccagatccgatctaaaccctgatagatcccgtcgcccatccctgccgccgagcaccatgctcgatttcggcagtaaagtcgccatgagcaagatcttctccgtgacatgcgagcccccaccgcaccggacccgcgaccccgcggcccctgcccccgcctgggtgttcctcgagccgcaggcgtacctcgccgacgtgaggaacgctaccaccgcggaggccttctcgagcgccggccacaccgtccaggtcactgtctgcgtcagcgacccgctggacgtctcctacctgtgcattcactgtcccggagttccggaggccaactgcggcaggcccagcatcgtctgctcggagaatgactttctcatcctctctgtcctcttcatgcccgccctcagagggtgcgagtacttcgtctacaaggcaggccccgtgccgtcgttgcgcctgctcccgggcccctaccctcgtgtcctcacgtcctcggatctgggcctcctgccccgcgatgacggcgaccatttcgtcttggccgtgttgtgctacttacc

SEQ ID NO: 72115 - DNA, 624 bp, Triticum aestivum
  Clone ID: PAT_TA_72115
ccacgcgtccgcaatccactcctctcccctccggtcccacccaccaccgacattgccatcctcctcacccaccgctgccgaccttgtccctccctcccctcaccatctctccccaccctatgccatagcgctccctctccccgatcccatccctcctgattcagatctgaccccgccgcccgtgcccgcgcgccaccacccactcctcgtcgcctcccgaaggacgtccgccgctcttccttcgcccgtcccggaggcctcagtcggcgccctccgccgcagggccgccgcgctcgtcccgccctcggcgccgcatctccactgccatctccgcttatacatctccgccctcggcatcccacccatggcgctccgcgcgctggacaacgcattgccggccgccgtggcggaccagcgccccaagaaggccgccaagctgctctccacggcacctcctgtcgccgtcgcccgctcccccactgggagtggagccgaccatggagtacgtccggtccgtggacctgctgcccgtcctcggccccaaagcccgggccactggcctcgtcgccgggctcgactctagggactgggtcatggtctgcgaggccctcaacgacgcgcgct

SEQ ID NO: 72116 - DNA, 630 bp, Triticum aestivum
  Clone ID: PAT_TA_72116
ccacgcgtccggccttcctccagatccccacgcgtggcgcttcgaactcttgccgcgaggacgaggagcgccgccctgcatctggcgccgaggtcctcgccgccggcgaccatcggcgcttctccctccgccccacgcgtcctgtacggcaagccagccgtgagcccctcccgtccccgcctccacaccccccatgcttgtgcaattagtagtaatgctagctggataggtgcttgttggtggatttgtgtggctgaacatacagtagaatttttcatcggttttatccatcccgtcctggatatcagctgtatacgaatcagtgacaagcagagagagttactctgttacatgagtatgtggacaagccaaatttaccatggctgggaaatgattgatttgtagacttgggaaaaaagcctaccaatggctggctcagtcccaggatcaaaagcataggaattcgatcttgacatgttaacaccttttggatacttggggctgtatgtgtcatcatgtagcattttagttacttgtatggtggcagctatttacattagttgcaaaagtaggactggcaaagcaggtatctctgaatctgtttcccaaatgcactggcaattttctctc

SEQ ID NO: 72117 - DNA, 668 bp, Triticum aestivum
  Clone ID: PAT_TA_72117
ccacgcgtccgattttgtagctaaaagtttccattaaattggtgcccatattagagggaggcatcggttaactaagcatatcgtcgcacgtatagagacctccagtccagcatgtcaaggttgctctgcgcgggctcgattagagggggcatggactttattaagaacgagtgagtgccgtcctgtatcaagtgcatgtcatgggtttgataatatcttaaagaatcaatttgtactacattattcgctggaggtagcatcacgatggcacagaattaaggactcgtgattgggtgtgtctaaaaatttatcaactattctgatgttccattagtttaccgaaaaaggaaggagctaccatcgcggtttgattgcgttcatcttggactaatcatgatcaatttgatgaggcctccatcagtttcgtataggttgtgctaaggattcaacaaattatgagaaacctgacgtcgaaagatagtgatagaccatcggatgaagtttactatatatttttgtctttaccatgttttttcttataccatgttgattttcagataaagtgcaagttgtgaatgaaagagtagacattttcttatttatgtcaaattttgcaataattttttttgccttaccaatcatacggtgtgggtgctcaccggcgctgg

SEQ ID NO: 72118 - DNA, 520 bp, Triticum aestivum
  Clone ID: PAT_TA_72118
ccacgcgtccgcccttctccgcctgccgcggcgccgcccactgggtggccgacgccctcgccggcgacgaggccctcgacttctccctcatcaaagcgctggtgggcgtcttgccggagtccctcgcgggcgcaccggaggagacgcgggagcgggttgcgctccgatgcctgcaggaggtcgtctccctcgccggcccgggcgagggcgatggcgagggcgaggccgcggcggcggcggcgggggtggcggggggcgggacgcttagggttgatgccacacgctcttgcgaggaattgctgattgagttgctcggacaggttggtacttcaggaagcttggagaaagatatgcttctgccttttagcaaggatatccaaaagtttatatgcatcaagacaccggctttaccagaaacttcttttgagctgcttagagaagtgaacacagacatcacgtgtatgggcccaccgcccccagtggagaagggtggcaagaacaatggcattgaccagtcgct

SEQ ID NO: 72119 - DNA, 544 bp, Triticum aestivum
  Clone ID: PAT_TA_72119
cgtttgaaaaatgatgttcgagtggttgacaaggtgcctggattcataatggagcggtttagtaacaatttgagtaatgtttataatttcaagataaaggcttggtctcctattcaatactacaaagatgttgttcttccgaagttgattgaagaaaggctcataaggatatcaccttttgcaaatcggctttcagttgatgctccgcctgctgttcagcgactgagatgcctggctaactttgaagccttaaagttttctaaaccaatcactgctttatctgacactttaatttctcgaatgagagaaaaaagtgtggaaaacaacgggaaatatgtagcagtgcatctccgttttgaagaggatatggttgcgttctcttgctgtgtgtttgacggtggtgatgaggaaaaaaaggaattggatgaggccagggaaagaggctggcgtggaaaatttacaaggcccggacgtgtaataaggcctggagcaataaggatgaatgggaaatgcccacttacacctttggaggttgggttaatgc

SEQ ID NO: 72120 - DNA, 649 bp, Triticum aestivum
  Clone ID: PAT_TA_72120
ccacgcgtccggaggagagtggttccaatgactattcgccccttacgtatttaaaggatccctagggttttgcagagaaactcttctctcggctacagaaatgcaatgaacgattcgaggtaaggatgatgatgttgaaggtcatagcaaggactattggcctgcatcacttggttttgttgaacttctatccatatcttcaaagatatgttcaacctcaccaacgagatgtgactactctacttgctgcagcagtacaggcttgccatgagatggtgcctcctgatgctgttgaaccgctgttcaagcagatagtaaatcaatttgtgcatgatcgttcccgtccggaggctattgctgttggcctgaatgttgtgagagagatctgcatgcgaattcctttgatgatgaatgaggatctactccaagaccttgttttatataagaagtcccacgagaaagctgtttctattgccgctcgctcacttatcacattattcagggagatctgtccttcattgttagtcaagaaagatcgtggccgtcctattgatccaactgctcggccaaaagcatttggagaaaccactattgctagtgatgtgcctggagctgagttgctagatgaagagatgtcaccagagggggg

SEQ ID NO: 72121 - DNA, 698 bp, Triticum aestivum
  Clone ID: PAT_TA_72121
ccacgcgtccggatccttttattggaaaagataatctattcccatgggggttggtttctcggtgatgaagtgaaacatgctactctcaaatcagagagcaggaaactacaggcttagttgatattggacctttatcttgttcttttttcatatggcgaaaaagagagttcatatttttcatatggccatgtcatcttatagaacaaaaatagggatatgttgcattcgacttttatgtcgtgattcttccatgatggttcgcctactgttaatatcttggttctccaactgaaccattcttgcaagcaatcgcaattggtgaaataattttcatcacttactttttagaattttatatttacaagaagatttactggttacaaagattaaatagacaaacctctttttgcagcaatccattttagatcccactgagacaaaatagaagtgggccaccgctactgtgtatatggttgacatgaatgctactgaaaattttgagttattttggtattcctaataacttaaagttgttgtatagattaactgaaccatagtactcttgaatgaaagagcaagaagttgggagttactaatttcttgtagagtaatagttcttttatatgcaactattcagttgacttgtgaagaaatagctaattaatgtcatgcttgaataactgggctgttctcatgac

SEQ ID NO: 72122 - DNA, 685 bp, Triticum aestivum
  Clone ID: PAT_TA_72122
tacccacgcgtccgcccacgcgtccgcgtaatcggcattcatggcatcggtggttctggaaaatcaaccctttcacaacttgtttgtgctcgtgaggaaaaggatggccatttcaaccttgttatgtgggttcacgtttcacaggattttagtgtggataccattttcaggcagatgtctgaggccgctagcaggaccccgtgccctcagttcaataatcttgacaccttacagactaatttgcagaagaaactgcatggaaaacggttcctcttggtactagatgatgtttggtacaataatagagatgtgaggcagtatgagaagctgcaacagatactttcaccgctgaacgctggagaggcaggaagcaagatcctggtgactagtcgaactaaagacgcattgatagctctgggtgctgcagagcaaagatgtattcccatgtcactgctagatgaagatgtcttcctgaaattgttcaagcactatgcatttcacaacgtgtgcgttgctgctgatgaccggataagactcgaagacattgcaactcacattgcaaaaaagctgaagggatcacctctggcggccaaacttgttggagggcagctacgtatgaggccaaacatcgattactggagaagttcccgagatgggaaccacttggatgacaccatgggagctc

SEQ ID NO: 72123 - DNA, 675 bp, Triticum aestivum
  Clone ID: PAT_TA_72123
ccacgcgtccgctcatccgccgctctccatgccctaggcctagaggctccatccatgagatgtggtctcagtattaggtagacgacgacggcggccggtggcgctcccattcatggccggcgagcagaagctgcaacttccgtcgcgccacgaggacggttggttcatcatatgaggaggtgtatgcatgatggtttggagaaaggaggttgccattggtacttgaggccgtcaagttgaggaattacgttggattggtggcactccaactcacaatccaaacccaactcgagttcatctccccttattcctgtcccaccccaccgattatacatttaggcgagcggaggggaaccaactagggtttgaactgcattgcttaaagtggcaccatccagtttgacttgaattttggcttctgtacgtatggtgttggttcgcctctccataggtttctacctcccggaattcatcttcctgttgccacataattacatcaattgttattggaaaatcaatgtatagatccattgtttccctctatagtgcacatgctcttatatttgtttttggactgattcttccatcgatttcttgctatgtttggataactagagtatctaatttgaaattatccagtcttctgtatgttcacttgcatagatggcttaatct

SEQ ID NO: 72124 - DNA, 602 bp, Triticum aestivum
  Clone ID: PAT_TA_72124
gggatagtgagcattgggacttaaattcgttgcctacagcaaaagaaatgattcctgtatgcctccctttttgttttagctcacataattttttaaagtttggtagatatcacataatcatggccgcaactaatatccaaaattcttagtgtcagtacactaagatttatcttattttggtatcaagaactatctatgctcaacatggtgtctgcgggtattctcgcgcccgcctctttcccctctctatatgaaccctgtcatcagcttcaaaatgtttctagaaaattcacacatatcgatggttcatatttatgactttgcaagttcacagaataatcaatcattgatgagcgtgatttttttaatattcggaagcatgaggaaacttgtttcatttctgtggcctgtgcgacagaaaaatagagcagatgaagctgctttttagctcgttcttgtcgttttggtgcagatggcaaatcaaaggatgtctcttcacaaaacattgaagatacatagtgcgctctgaaatgtacatgtaagatttgttttgaattttctgaagcttcaaacacacacttaaaaagggaggacatgtgttc

SEQ ID NO: 72125 - DNA, 610 bp, Triticum aestivum
  Clone ID: PAT_TA_72125
ccacgcgtccgcgctctctctctcccctcattactcgcatcattacacctccctccctctctctcgctccctatccactatccgcccctgctctctccctctcacaaattcacacctgtgaggactgaggagtagcggagcctgcgacattgccgccgctgcacagtgagagaggaggaacgcggccagcgatgctccctcgccctccttcccacctcctgccatggcggtgcctcctcctcctcctcatcctggccttggccggcagcagcaatggcgtctctgcgactgccaaggcaaaggccaaggcaccggcagcggcgcccaagccggccgggttcgggtacaagctggtctccctcgtccagcgccccaacgggggaggcctcgtcggcttcctccaggtgaagcggcgcacctccacctacggccctgacatcccccgcctcacgctcttcgtcaagcacgagaccatggacagggtacgggtgcagataacggacgcggagaagcagaggtgggaggtcccctacgacctgctcccgcgggagccatccccgcccctcggcgccaccgacgacagcgcccccttcaccgacggggagtaccc

SEQ ID NO: 72126 - DNA, 654 bp, Triticum aestivum
  Clone ID: PAT_TA_72126
ccacgcgtccgggtgacttctctcaaccaggaaattgttagagccttggcaagagaaggaataccgtctgttgggatgtcaccatttgcttgtggatggtctactcagcgaagagatgtgagcaaactagaggattcttgcatctttggatagacacctgacaatacacagtttttgtggatatatgtctaatcgtgtaaacaaagatgttgacatatgtgcatttgcagcttgcatcagccaatgcttctcaaatcattgagtcactccatgctggttttgtccctgtaagctattgcaccttaggttctttagtaattatttctgtagaaattttctttgatctaagtttgcagcccaagtacggcaattatgtgaatcatatgcggcaaaaatgttgtttctggatattagtagcatattctttagacttgtgtttaatgagcattgtttacatggatctttcactaatgcttttggtaagctgcaatgattcgcaatacatatatgttcccaacatagctctgggtgtattgttaagtaatagatcagttctgacatttgaaatagctcggacagtttttcagtaatgttataagaataagggaagcatcgcctaacttccacgtgttcttttttcatctacatatgaag

SEQ ID NO: 72127 - DNA, 646 bp, Triticum aestivum
  Clone ID: PAT_TA_72127
ccacgcgtccgcccacgcgtccgcccacgcgtccgcccacgcgtccgcggacgcgtgggctcacacagtgaatatcttgatctacgaaaaactctagatgaagaccataggtcaactggtggactcaattttgttacaaattgttgtggaatcattggtttcattaagttccttgggccttattacatgttaattatcaccgagcagagaaaaattggtgctatatttggccatgcagtttaccaagttaccaagactgcgatgatccagttatctaattccaaaatgaagcaaacgcttctaaattccaacgatgagaacaggtacaagaagctcttgcagacaatagatcttaggaaagacttctttttcagccactcgtaccatatcatgagaagtctccagaagaattttaatgatccacaggcaggatgggacctatatgacacaatgtttgtatggaatgaatttctaacacgaggggttcgtaacattctgcaaagtacctgctggactgttgcgttagtctatggtttctttaaacaggataaaatgaaaatatctgggaaggacattatgttgactctcattgctagacgatcgaggcattatgctggaaccaggtatttaaggagaggtgtgaatg

SEQ ID NO: 72128 - DNA, 196 bp, Triticum aestivum
  Clone ID: PAT_TA_72128
ccacgcgtccgatggtgtccaactgctcagagatagacacttccacatggtctgcacgtccagtctctaaaaggatgacttctgggacaagtcgctcatcattaattggaccaaggagagcctatacacttactgctattaacagatcttcttcccctgaacctcaacgatcgccctccaatactcctgctgtatc

SEQ ID NO: 72129 - DNA, 708 bp, Triticum aestivum
  Clone ID: PAT_TA_72129
ccacgcgtccgagagcaacatgaattgttgctggggctaaggagaccatggagattacatggaccgttgttgcttcaggttgttttcttcaaggagagagaaagagacgtggagaaggtacatacttttggggtgtccttggcttgtacgtgaaaggactgtgacccttatctctttcggcttcttctccttttaagcgcttttgtatatcctttcatgtttttttctaacttatcttcacggttgttgatagggagtatctcactcggcttctatttcttctacaaccgtgaaaactgcgagtcttctaaaaaaagatagtttgttatttgtgggccgttcaagaagttttttctgcctgattttttcttggtcaagatttcagccaaggattacatggattagatagaacggctcttattttctgattaatgtgtgatttgttgggagtctatatataattagtatagctatagatagatacatatagatagatagatagatagatagatagatagatagatgtatacaaaattacaaataaaatacagtatattatgttctctctatcatagtcatatcaggtatactaaatagtgtacattaaatcttgattatatagcaatatatgtttcatactgtcacagtaattacagaaactatactccccaatatcaatccattgattgccatgagcttcatagtatt

SEQ ID NO: 72130 - DNA, 355 bp, Triticum aestivum
  Clone ID: PAT_TA_72130
ccacgcgtccgatttcccacgcggcccatgtgctcccaagtccgtccgtccgtccgatcccccgccgcagcgagccgaccccaccagtccagccccccccgacccccgcccccgtcgccggcgccccggaaaaccccgccccccccacgccgcttgccggacctcgcggctcgcggcgagcatttcaagctgcggctcgccggggaccgcgccggatccagcggggcaggctcggcggtgccgcgggctgccgctgcggtcagcgcagatccgtgcctctgcgctgggaatttgagggtgtcggctcccggttggactcggcttgagttgatttccgcgggttggtggaggtagg

SEQ ID NO: 72131 - DNA, 572 bp, Triticum aestivum
  Clone ID: PAT_TA_72131
ccacgcgtccgcccacgcgtccgcccacgcgtccgcccacgcgtccgcgccggatctagaggagagatgaatggcggcgccggcgatgacgaggaggagccgcggcacggaggagcgtgcgcggtggggaggagctgtggcggggagtggaatggcggcggggaggagccgcagcggattgccggggaatgcggcgaggagaatccctcggcgctcggcggatgcagggtacgggtagaggtggcgcggcggagcagggcgccaccagcctccaaagcaccggtggtggtggacgccggcgcgggcatgctgccctggctatcatttccgcaggtggggtttctctggtgatctcaagtccgccgccgcagaagcagctgtagcacaagctcaccgaggtcttcgacgcgaggcagttgaccctcagctccaacagcgacagcaacgctatgaagtgattttcatcacaggttgcaggaactttttgtggttgatgtgatgctaattgatcagttttcatggccgagtgctggctcctcgcccgtgccgccacaacagcagtcgaggccgcc

SEQ ID NO: 72132 - DNA, 649 bp, Triticum aestivum
  Clone ID: PAT_TA_72132
ccacgcgtccgaatccatccagccccgaccacactagcctcaacccactccccgcgcggcggcaccaaccaaagccccgccggcgccggcctgcccacatctgcaccgccgcctgcatcccgcctaacgccaccccaggcgagccaccacccctccctgtcccgcacccaaaaccccagcgacgcgcgccgccgcggcgccgcccaccaccagtatcccgcgcttccgtcgccgaccactaggacctctcgtcgccgcccaccaccacctggatgtccccctctgcgcacggatccggtcttgcccgagctccccctgggacggatgaacacagggcagaggcacctgtgctgggaggagcagaataggggcgccgacaccaggaatagcaagtcgtgcctcacccggccacctcctcgcttctccctccgccggagcgtgccgacgccccgtatcccaccgccggtgccgctcctcaactctggcgacgccaagagcctgcaccaccttgggtctttacccacgcagccagtggcggcttcctcttcctccagccgctcgcgctcctccgtggaggactcccgttgtcgcctctgtaacccctgcctaagcatccatcgcacgtgaccttctctggcgtgtctgatcg

SEQ ID NO: 72133 - DNA, 683 bp, Triticum aestivum
  Clone ID: PAT_TA_72133
ccacgcgtccgctctgggcttgatggtgatgtaatccataggttttcagctgttaggccatatgaaaagcaactgccccctttcactttattctagaaatcatatacatacacaaataaaggattgcgtgcttctatgtagttccatcctttgcagtttcggctgctataaagaattttaatctctatatcctatttttgtgtttgcggtgacaaactatgccacattgtcataacttgctctaagcctagctatttagaaactaagattaaaatgccatctatctatgagtaaaaactcaaaagattccaatattcttcccagaaagaaggagaagggtcttatattgatggcgggccagggcattcctttctaagttcctgccatgttaattgcagagttattgatttccatcgatggggttgtagtagttgaagaagttgtgcatttactgggtgatgtaatgtgtatacgaagcaaacaggaaacatacaatttatatcatgacctaccacatcatcaaatgctatacactgcagttttagggcttttacagtatcatcatgctgaatgaccaaaacatattgccaaaggctttaataagtaaatataaaggtggagttcggcatagtaagaagcaactattcctttttcactttatttcagaaatcatgtatatacac

SEQ ID NO: 72134 - DNA, 558 bp, Triticum aestivum
  Clone ID: PAT_TA_72134
ccacgcgtccgcccacgcgtccgcctcgggccagtcgctgccggcgtcgtcgtcatcgttggccgggcagcaggtggcgaatgtgcacagctacgggacggtggacttcgagcggcgcccggcgctgcggtggagcagcctgtaccggcgcgtggcgatgggccacggcggccggcccgtggggcggacgctggcggactgggacgagggcgagcgccgcctcgacaagtgggagctctgccgcatcgccagggagctccgcaagttccgccggttcaacctcgcgctcgaggtttatgattggatgactgatcgaagggatagattttcgctttcatctagtgatatggcgatccagttagatctgattgcaaaagtacgtggtgttccagatgctgaagaatactttgaaaaacttcctgacccactgaaagacaagcgaacatatgggtctcttctcaatgtttatgcccaagctaggatgaaagagaaaacagaatacacatttgagcacatgaggaaaaaggcgtttgcaactgacacattaccttttaatgt

SEQ ID NO: 72135 - DNA, 639 bp, Triticum aestivum
  Clone ID: PAT_TA_72135
ccacgcgtccgataaaaaaaaagaaaataaccatcctcctgcctctccagctctcctcccccgagcacctcatcccgccaccgccctcggatcccgccaccgcgcgcccaccccagaaacccacaccccctccccgcgccgcagcgcgccatccccgaatgcccccgccgacgaccctcccagaccgacgcgcctcccgccgcagcccccccgatgggcctctcgccgccgctatccatccccggacggcaccgccgacggccctcccgccccgacgcgcttctcgccgcagctctgcatcctcggacgccaccgccgacggccctcccagctccgatgcacctctcgccgccgtcccccaggtgcgccttagatcgccccccgccgccgccctccaaccccaccactctcccaccgcctgacctccaccatccatcgcagccggcgaccgcgtcccctggctcagctgcacttgactgggatcccccatctcccagcaaaccttgccggtggacgccacctcccacctcctagggcgctcctcgtccagtccactccactggtttcgacgccccgccgcgccgacgagagctacaactccatgtgctcctctctcgtccaagttcatgcaactctgat

SEQ ID NO: 72136 - DNA, 679 bp, Triticum aestivum
  Clone ID: PAT_TA_72136
ccacgcgtccgcggacgcgtgggcaagaacgttgaggaagaggttgacaggggcaactaacatgattaataaggaggtacaccattcaaacgcacacatgatcatgccggcgagcacaaccaataacccaagggagtcgctgtcgatcactgaaccacaaaatcctacataatataactactcctaactcaaaccggctgaaggctgaccgctgttgaaactaatggggtgagctaacatgattaactacttggccaccgggccctcatcttcgacagcctcgaggggatcaaggacaaggtaaccgcctctcgcacagattcatggatctcggccgccggtgatcgtgcgatgtgtttgcttgctccctgctgtgttttgcgcgatttgacgggttccttccctgttcgatttctggtcgcctttgggcgctgctctgtgcaggtctacctcgaggggactcacatcgtcatcctttggttcgagaggcggtcatctacgacgttcgcgcacgacccaacctcatggagagcacttccggggaagatgtcatctccatatggtgagaattggtcttcgtgttcttagtttcttacacaacccatgccagagactaccaaccatgtagaggaccgtgggggataactataatgatagagtgttgccttcaatcattcat

SEQ ID NO: 72137 - DNA, 626 bp, Triticum aestivum
  Clone ID: PAT_TA_72137
ccacgcgtccgattggattgcaaccggtggaccggacacggggtaaactccattccggcgaagctgaccggcgggggcagccaggcagcgccgccgccgccggcggccctccgtcacgcactgggggagggaatgggagatcgtgcaggccccgccctatcctgattctcgttagcgaccggcacacgcatcgcaaaacaggggaaacgacacgaagcaagcgagccgggcaccgtgaccgtgaccgcgaccgcgcgaaacggccccgtcgtcgtctcgtcgcgaatcccatcccatccctcgctccctttcccctccccgacccggccgtcgcctcgaccggccaggccatatataccgcccgctgccgtcggaacaagcctctgtttactctctgctcctaaacgcgtccgtcgtcctcaagcttttttcctcccacctccctcttcacgtgaaccgctccacgctcgcaccatcttcgcctccgcccgcccgcccgtccgtgagccgcgccggcgcgtgactcccttcatactccgccaccgcctgcctatttctcgtgcttgatccaccatccagcgcaacagcaataatccccgtctccgcgccgctagcccaccatttct

SEQ ID NO: 72138 - DNA, 473 bp, Triticum aestivum
  Clone ID: PAT_TA_72138
ccacgcgtccgctacattcgatacttcagaaagtgaaatctacaccagagttgttgcacttgggctgcaagttatttcctagatgttctttctggttgccccccaagtgtgatactcaaaacatggcatatgactgctggcattgttctttcattgactcattgttcgttaatcaaagcatattttccggttttatgaggtttccttaaatctttgccttgtcatgtctgctcgtgactaaatatagcaaaaatactgctaaacaaaatttgccgatggccgatggttcggaggttctgaagccaactctggactgggataacttggaaaagtaaattagtaatgtttgaaggttctgaagctaaacaaatttagtcagcatacaaggcttggtaagcttataagttctaaatccatttcagattatggaaaggtaacttacaggtttgactctcattgatgtgcatgtctgc

SEQ ID NO: 72139 - DNA, 646 bp, Triticum aestivum
  Clone ID: PAT_TA_72139
ccacgcgtccgcccacgcgtccgcacgagggagcggcgtcatccccagctccgttccccacggccgcaccctccgcctccgcctccgaacccacgatgtcttctggagatgggatcgatggagatgagaagtctgaagagacacatggcaaagatattagacgcatcaagtgtgaattttgcactgttgttaggtccaagatgtatctcatacgagctcacatggtagctcagcacaaggatgagttggacgcatcagaaatctatgactcaaatggtgaaaaggttgtttatggggttggacacacatgtgaagagtgtggagcttgtttccggaagccagctcatctgaagcagcatatgcaaagtcattccaaagagggtttagataatagatacttaacagcgtgaagcattggatcccattacagaactccaaaatgcatggaggcacattttaatcttggttggactagtaacaggttgggatgacctcctgtgaagctccaacaagattgcctccttcacgcttactcaggagagatccttcgcctgcccacttgaagactgccccttcagctatataagaaaagatcacttgaaccggcatatgcttacacatgagggcaagttgtttacatgccctc

SEQ ID NO: 72140 - DNA, 309 bp, Triticum aestivum
  Clone ID: PAT_TA_72140
cacgggcccagcggagggcgggctagcgctgtcctcggccgacgccggcgcgaccggcggcggcggtggcggacatgggggcgggcacgggcgaggccgcgggcgcggcagctacaggcagacggtgtgccggcactggctgcgagggctgtgcatgaagggcgaggcgtgcgggtacctccaccagttcgacaaggcccgcatgcccgtgtgccgcttcttccgcgactacagcgagtgccgcgagccggattgcgcctacaagcactcctacgacgacggcaaggagtgcaacatgtataagatggg

SEQ ID NO: 72141 - DNA, 557 bp, Triticum aestivum
  Clone ID: PAT_TA_72141
gatggcccccactgtgatgggttcctcggccacctccgtcgcacccttccagggtctcaagtcgaccgccggcctgcccgtcagccgccgctccagcagcgccggcctcagcagcgtcagcaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgagttcagcaaggttggcttcgttttccgtgagcacaacagctcccccggatactacgatggtcgatactggacaatgtggaagctgcctatgttcgggtgcaccgacgctacacaggtgctcaacgaggtggaggaggtcaagaaggagtaccctgacgcctatgtccgcgtcatcggcttcgacaacctacgccaggtgcagtgcgtcagcttcattgccttcaggccaccgggttgcgaggagtctggcaaggcctaaactaccaattgaaacaatggcctatgta

SEQ ID NO: 72142 - DNA, 460 bp, Triticum aestivum
  Clone ID: PAT_TA_72142
tgacacgcctgggcccggttgtcataggtgacatttttacagccgcgctgctcgatctgtgagcggcggtgctcgatccgtcggcggcgtcgctcgatccgtgctggagcagcgggaggaggacggcggtggtggattggagaccgaagcagcgggaggaggacgacggtgctggattggagaccggggcagcgggcttcttctattcttctcttctgtccagaagcagccgcggcttgttgacctgcgcgccttcgtcctggccgtggccgctacctgagctgcccgcgaggcggcgcggcatgtgggggtcccgatgaccttgaggaggaaggcgagcatggtgctcccgcctccatggctaacattgtgatgctgctgtcgtcatcttcctggtcgtccttggcgtgcttgcctcctgtgccgctgcttcgccggacgatgttgcgcaggaggtgcg

SEQ ID NO: 72143 - DNA, 246 bp, Triticum aestivum
  Clone ID: PAT_TA_72143
ccacgcgtccgaatagttttggcccacgggggccgaggaggtaaggagaggtgtggtgagccgaggccgacaggccgggaggccgtcaatggcccagtacatatacgccaccacagctcgctgctgctgcagctccgcacgcgccctgcagctccacgctcccgcgctagccccgtcgtcgtttcgatcgccggtccggtggaggtcggccatgggcgcgagcgatcgcgggacggaggtagatgc

SEQ ID NO: 72144 - DNA, 230 bp, Triticum aestivum
  Clone ID: PAT_TA_72144
cgagatcatggatctgtccatcgaccctactccgcgcgcggctcgtgttccatcgtcctgtgcgcgcagcagttggctcgggggaaaggaccggatcaccgagcgaggtgatcgagatgggagggagatcgccgccgtcggcggggtggcggcgatggccgcggcttcttcttctcgcggcggtggcgctggcgctcgcggcggccacggcggtggaggggaggttcgtg

SEQ ID NO: 72145 - DNA, 289 bp, Triticum aestivum
  Clone ID: PAT_TA_72145
ccacgcgtccgcccacgcgtccggtctgcagccacatgagcgcgcaccgtgcccggctcgcgcgctggctccagctcctcgccgccaagggcgtccaggacctcgccctcgtcaaccgcccctggccgcgcgacgtgcccctcccggccacgctcttcgccgtcaccaccctcacccgcctctacgtcggcatgtggacgttgcccggcacggccgccctgcgtggcgcctcctttccccaccttcgcgagctcggcctgggctgcgtcgaaatggagcagggcgtggt

SEQ ID NO: 72146 - DNA, 215 bp, Triticum aestivum
  Clone ID: PAT_TA_72146
ccacgcgtccggacaggcgtctggaaacgcggggtttatactcgcatccgagccttcaacctactctttgcccatttcgtcagcggtgcagccaaccaaccaccccaacaaccagccatgagggagtgcatgacgatccacatctgccaccccggcatccaggtcgggaacgcgtgctggaagctgtattgcctgcagcatggcattcagcatga

SEQ ID NO: 72147 - DNA, 205 bp, Triticum aestivum
  Clone ID: PAT_TA_72147
ccacgcgtccggaaaggcgtctggatactcgcgtttctactcgcaaccgagcgttcgacctactctttgcccatttcctcagcggttcagtcgacctaccagccgaagaaccagccatgagggagtgcatgttgatccacatgagcctccccggcatccacgtcggtaccgcgtgctggaagctgtattgactgcaccatggcat

SEQ ID NO: 72148 - DNA, 555 bp, Triticum aestivum
  Clone ID: PAT_TA_72148
ccacgcgtccgctcgtggagtcgccgtctagggtttccgcttcctcccccatccactccctcaccgccatggactttgacgagtacgactacttggagaaggcagtcgagccctccgttccctcaaccaacggcgggggtgagaaggaccgcagttctcgccgccgctcctccaccgccggcggcggcggtcgagaccaagaggagcgcggatcgaagcgtcctcgctcgggagaagaccgcgagcggcaccgcagcggccgtgagcaccgcgaccgggaagacgggaaggagaaggtcgaccgggagaaggctagggagaaggacgagggccgcgaccgcgagaaggttagggagaaggacgggggccgcagccgcgagaaggttagggagaaggatgagagccgcgaccctgagaaggttagggagaaggaagagggccgggaccgagagaaagttagggagaaggatggcagccgcgaccgtgagaaggttagggaaaaggagcgggagggcagggataagctaatggagagggataatgggagggagcgga

SEQ ID NO: 72149 - DNA, 589 bp, Triticum aestivum
  Clone ID: PAT_TA_72149
ccacgcgtccgcttagggcgccaccggcggcgaggatgccagcggcagacgcagagcttcctgctgccgcatctcctccagcactcccgcagaccgcccctcctcggacggcgacgagcacaccggagcacccagacctccagccccggccgtctctgggagcgcctccatcacccaaggtgaaagccggcggggaaaaccgtgatccctggccgccgggggcaaaagcctccttctccggtgaggtggagaggggcctgggctctgtcggagcggagccctcccgtctcgcttcgccgacgagcacgccccccgcgccgcccttgtcgccttctgaatcgccggaggcggatcgtacagttactgtttcgcccatcagcagatcgacttcaagcccgacagggatgtggccggagctcagcccagataagcaggactcgctctgccaacaagatgatcattcacagggtggtgatacgtcgacatggtcatggcccaatctacctgaggatatctggtgccttatacattccctaatgccattgcgtgattctgccccgtctgcctgtgtatctcgcacatttctatg

SEQ ID NO: 72150 - DNA, 663 bp, Triticum aestivum
  Clone ID: PAT_TA_72150
ccacgcgtccgcccacgcgtccgtaccaatacagcctcaaaacgaactaatgctcttcagaatccagctgtcatggctgctgttcgaggcggttcttatgacagcacaacagcaaaaaataatgcctcagctttagttacttctgaccagattaacaacttcatatcaaacattaatctattagaccagattggcatttttgagttgaatcatatatttgctcatagccaaagattaaatagcaatgcaattgttgcttttgtggaagctctttgcaaggtcgcaatcacagagttgcaatcacctacagatcctcgtatcttctgcctaacgaagatagtggaaattgtgcattacaatatgaaccgcatacgtttggtgtggtctcgtatttggaaagttctatctgatttctttgtgtctgttgggtcgtcagaaaatctttctgtggcaatattcgttatggactccttgaggcagctagccatgaaatttcttgaaagagaagaactagcaaattataatttccagaatgaattcctgcgaccttttgcggtggttatgcagaagagcaatgcttcagaagtacgagaacttgtggttcgatgtgtctcccaaatggttttgagtcgtgttaacaatataaaatcaggatggaaaagc

SEQ ID NO: 72151 - DNA, 689 bp, Triticum aestivum
  Clone ID: PAT_TA_72151
ccacgcgtccgagaacactgaggagaaccaggggcaacaagctgagctgagtcaggaattggattcggtaatgatacatcccagggagcatgtcgatgaagaatgtgaagaggagaaaatatcacttgctgagttgaaacaagaatcggactctgcggcacttgcttctttggaacaagttacagagatttcaagtgagaacactgaaaaccatgttgaacagcctgagctgatgcatctgtccacttttatggcagcaggtgttcttgagtctcccggtgttaacgccaccgcagaccaagatgatattgaagttgatccaactgagtctcttctaccaagcttgcaccaactttctgatgggcattcaataagttcagataaatcatcttctgactgcagtgatgttgaagataagagagtttctgatacaccaactgatattgaagatatcagttatttataggaattaccagaccctaaagcagtgactgctgataccaggtctgttgattcaagtgtggctaatatgtttactgatctggaaagtgttgaactggtgagtgttgatcaactcaagtctgctttgggagctgcccacaagtcattgagtacactatacgcagagcttgaaaacgagaggagtgcagcagctatagctgctgatgagaccatggcaatgataaatc

SEQ ID NO: 72152 - DNA, 572 bp, Triticum aestivum
  Clone ID: PAT_TA_72152
ccacgcgtccgaagcctcggcgcgtgccttcggtgccttcgcgggatgaggacgactccccctcgccgtgccggggtacctcctcggagacaatgtcgccggagtcggagcctcagaggactgtcatgtcacggccgacgccggcagaattcagggttttcaagcccaccggtttgatggatgccgcaactcaaaccgatgacctcgggagaagatcagctcggagagtacctgagatgcataagaagagtctgagcactgatcatgacgctgtcgttcgtgatgtcaccgagtaccggcagcagagccatccgcgccggtcggccaagctccaggggatctccagggatgtcatgtcccactgtgccaccccattgagcatggcctcaacccatggcaagtccgagagcttagagtcgttgatacgtgccgacaacgcgtcagctaacagcttcaggatccttgaagaggacgacattgtcgtgccgacctgcccgaagctgaggccggcgaatgtgctgatgcagctcatcacctgtggttcactttcagtcaaggatcatgacaacatt

SEQ ID NO: 72153 - DNA, 633 bp, Triticum aestivum
  Clone ID: PAT_TA_72153
ccacgcgtccggcatcctcctcctcagaccccttgttcctcctctcccccgcagcccccttgcccttgcttgaacagcaagaagaagaagaagatccaatcccgtggatttctccccgcttcctttccatgcgccggagctggagccggaccccccagcttcctcgccggccgaccaggaccatcccgtggattcccgtagcctcctacctcagctacctccgaccctgccctcaccaacacccgacccaagctgggatttttattcttctattccccttccccttcccctccccctccccctcccttcagagcagagtaggttgcttctcaatcgggtcaacccggtccggaccttcccctccccgccggatcttgcccaccgatccccgccgccgtcctccgatccatagtcccccgaggaacagagcatggtggggcagaccatgatgcgcatcgtgcgcccctgcttcaagccctcgctgcccgacggcgcgcaggtcgtcgccgccgggggcggcggcaccagggagggcctgctctggtacagggacgccggccgccacgcctgcggcgacttctccatggccgtcgtgcaggccaaccagctgctcgaggacgccagccagctcga

SEQ ID NO: 72154 - DNA, 195 bp, Triticum aestivum
  Clone ID: PAT_TA_72154
ccacgcgtccgcggacgccgccggcgcgccggtgccagcatccaagcacggctttcctgtgactaccccttctctcacttgtttgatgcccggtcatgcatagccagaagcgcggtgagcacgcgccgacgacgctgtccacccgcgctcgccggacccgcacgacctctccgacgaccccgattacgccgacgc

SEQ ID NO: 72155 - DNA, 504 bp, Triticum aestivum
  Clone ID: PAT_TA_72155
ccacgcgtccgctcgtcccgtccgatataaatgggggaattctgctccccacccccgttccctttgttgacttacgatactgccccttgcctcagtctcatcctcccggctctctcggtcctctcgcgatagccccggccgcccccccaaatcggaagccgcgcagcccccggatctccgccgccgggcgccccgccgacccgcgccgcctcgagccctccgccggccccgctctgctcgcccggcgcggggcggagcggaggagatccgagccggggaggttccttccgctgtggggggtcctgcgcccccgtaggctaggtctacagccgagttgcatccgccgcctggtgggtgaggagtcgtggaagcgaggatgtcttctctcagccgctagctcgtcttactcatcctgcagttcctcgatgaggagaagttcaaggagaccgtacacaagctcgagcaggagtctggtttatacttcaacatgaagcactttgagga

SEQ ID NO: 72156 - DNA, 624 bp, Triticum aestivum
  Clone ID: PAT_TA_72156
ccacgcgtccgggtggaacgagctgaggtacgggaggaggcggaatgggtgcctaccgccgccggggacaatggggtggccgctgttcggcgagaccaccgagttcctcaaccagggcatgagcttcatgaaggagaggaggctcagatacgggaggattttccggacgcacgtcctagggtgccccacggtggtgtgcatggaccccgatctcaaccggcgcatgctgctccagggcgagtccagcggcctggtcccgggctatccgcagtccatgcaagacattctcggccgcaacaatatcggtgccttgcatggctcaatgcaccggttcatccgtggcgccatgctcggcctcgtgcaccctgctgcgatccgagccagcctccttcccaagatcgacgccttcatgcgctcccacctcgatggatggtccggctccgtcgtcgacatccaggcaaagaccaaggaggtgaccttgctatctatgctcaggcaaatcgccggcatcaccgctggcccgctctctgatgccctcaatacagagttctgcacccttgtgctcggcaccatctccttgcccatcaaccttccagggaccaggtactaccagggcttgcaggc

SEQ ID NO: 72157 - DNA, 614 bp, Triticum aestivum
  Clone ID: PAT_TA_72157
ccacgcgtccgtcccaactcccatcctcctgattcagtcatcgtcctggtcagactacactactcgccggagccatcgccccactccactccactcggccaccatggctctcctccggcggccaccactcgctcgcaccgccgccgccgcatccctcccccaccaccgcctccgcctcgccaccccgcacacacacctcaccagaccccctccctccactccccgcctccgcatcagcgcggccccctcgctccgccccctccgcggcattccgtcgagcaggtgccatgcggcggcgagagatccggcgccggcgccctctcaggtacccggcggcgcgcgggccgcgctggtgcgcgtcggggaggcgctgtcgctcgggttcccgctgtgggtcgcgtcggcctgcgcgctcgcgctgtggcggccggcgagcttcctctgggtcacccccaccgcccagatggtcggcctgtccttcaccatgctcggaatgggaatgacattgacgcttgatgacctgagaaccgcgctgctgatgcccaaggagttggctgctgggtttctacttcaatacactgtgatgccactgtccggatatctcatcagcaagt

SEQ ID NO: 72158 - DNA, 635 bp, Triticum aestivum
  Clone ID: PAT_TA_72158
ccacgcgtccgcccacgcgtccgcagccgacggcgatgcacgtcatgatgttccccttcctcgccttcggccacatcagcccgttcgtgcagctggcgcgcaagctcgtcgccgccggcggggtgcgggtcacgcttctgtcggccgcggccaacgtgccccgtgtagaggccatgctggggccggcggccggcgccgtggccgtggccccgctgcgcctccagcgcgtgccggggctccccgagggcgccgagagcacggccgaggtctcggcggacggcgccgagctgctcaaggtcgccgtcgacggcaccaggccgcaggtggcgaacctgctcgcggagctccgccctgacgccctgctgttcgacttcgccaccccatgggtcaccgagctcgcggcgccgctcggcaccaaggtgctccagttctcggtcttctctgccgtgtccggcgcctaccttatggtccccgcgcgccgcgccggtggccatgggccgaccgcggatgacctcgcgtcggcgcccacgggcttcccgccatcgtcttcgctcgccaccgtgccggcctaccaggctgccaatttcacctacgtgttcaccagcttccacggcgaaccgtgcgtgtacgatcgc

SEQ ID NO: 72159 - DNA, 589 bp, Triticum aestivum
  Clone ID: PAT_TA_72159
ccacgcgtccgcctcaacctcaacctcaacctgaacctgtcgacatggacgcgtccggctgtccggatgtgcagcctggcttgattctccgctcccgcaaccgcaaccacaacctcaacctcaacgcttcctcctcttccgagctcaatgcgttgcttccgcctgaccgtgaccgaaatcctcaccacatttcaggtagtgataaaaacagggcaattcagcatcacaacagaaatgcagagatgcctgctgtatctgtggagccaacaagcagcagcacactgatcaatggaacagggtctcaagtgcaggagattgatgtcgcgtcatcccctgggggcgaggttaagctgtctctgaaatgcagcgcacacccatcaaagctcaacatgcctgatctggaagcagtttacaagatggttgaggacaaataccactgctcggacaagcttcttcctcctgatttctccattcctggcctcatggccgagatatgccagagtgtcgtgcagctgggcactcaacatactgtggagcatattacacaatcacgtaccgttggtaacggcagcacgtctaaatgcgtgga

SEQ ID NO: 72160 - DNA, 328 bp, Triticum aestivum
  Clone ID: PAT_TA_72160
ggggtttttttggttttttttttttttttttttttttttcacaaaaaagggtttcggcccattttttttaaaccaacccaggggtttacatgaaccatacaacaaatagcctgggctgggggaaatcaactcccacccaaaaaaaagttggatcccggggcccttcccctaagggcatcaaagggggttggacatcacagttcctaatacatcaaggggaaaaaaggggggaaaaatgccttgcatggcacccgtttttattggccttatgaacccttcgcggccccgttgggtgattccaaactggtgcaagtacccctggcccttg

SEQ ID NO: 72161 - DNA, 425 bp, Triticum aestivum
  Clone ID: PAT_TA_72161
cgggacggtcctattgttaatagtggtacacggccacagtatttgtacacgggtcgtataggaacttttgacaaaacccaaggcgacggttggggtacatgtcatcggtagtcaaacttggcgatccggaaagggtacttgtcggatccacaacactgtaaccgtttgtggcaaaggaacttgatgttcacgggtctcccaaaaacgtcgtaatacttggcgaggcatatccgtgcgttgaggtacttggcaattttgtgtaaacggacttgaggtggtcttggaccgggtgatcttggcgtaggtatgttcttcggggatggccttggaacttgccaacgtggctgcaggctgctgtaggcaaaacaggggaacggctgggcctggcgctgccccgtgtgcgtcaacccacgggggcgggacgg

SEQ ID NO: 72162 - DNA, 476 bp, Triticum aestivum
  Clone ID: PAT_TA_72162
gggttttaactaaattttaaacccaacatcctttattggtaattttccgggcaactcaacccattttcccacaaaaatcctactggatatcaatataaacaacatgggccctgtcttttcctccgtttttatggggccttttacaaatatttaaaaggggggttaaccaatacccacccaacaaaacattttgaccccccaaatttacattctcccaccaaaaacatttgaaatctaattcccacggttcaacaactcctatgcaacataagataaattgtcctactacggcggcatggctaaaatctttaaaccataaaatctgatcaatcatccattgggattgctgaaaagcctaatcaagtgctattgccccctggggctgcactattaaccctctaatgctctcaccttttaaaccactttggtttggctgatttcttatttgctggtggtggggcaaaatcaaattggaa

SEQ ID NO: 72163 - DNA, 186 bp, Triticum aestivum
  Clone ID: PAT_TA_72163
ggaaaacaaaaaatcattctcattggcacctcaacccagggacttgcataagttattttgggatctaaaccgccatcaaaaaagtattctttggtctggaggatcatccacctcacacttatccaagggacatatttagggacttgcaaaaggaaatccaaactggacccctaaacatttttgctg

SEQ ID NO: 72164 - DNA, 427 bp, Triticum aestivum
  Clone ID: PAT_TA_72164
ggaaaacccgggcccaaaaaactgaactttttccctgggcaaaaaaaaaaattggcccttggccccttttgggaaaaaacaattcccggcccccaaaaaaaaaaaaccattcccaaaccaatttccggggttttttcccaaagggccccgcccaaaccttttttaaaagccccggtcattttcaaattcagggcaaaaaagggctttttaacccctttgttttttaaggaaaagggggttccccctcaaatgccccttttttgccccaaaggcccgggctgccccccctttatcccttatgggaaaatttttatttgccgcccccccttttaaaacccggggggtgtacccccctccccaggacctttttaagggaaaacccgggttttcccccccttttaaggggggtttccccattgccccccgg

SEQ ID NO: 72165 - DNA, 304 bp, Triticum aestivum
  Clone ID: PAT_TA_72165
aaaaaaaaaacaaacctttcctgaatttaaaccccaatgttcaaaaacatcccccactacaattatttgccaggggcccgcttacaaaaaacacaacgggctcctttctttttttggaccccccaccggaccaaaaaaccataaaccccttcctgatcccccccgggggcaaacctaacggtttccctttacaactggcaaagggcacaaccctttcaacaacacttatttggccacccttcccaaaaaaatcctttggatgggcccaaggccccggctgcccataaaaatggggtcaatcctt

SEQ ID NO: 72166 - DNA, 241 bp, Triticum aestivum
  Clone ID: PAT_TA_72166
gggttttttttggtccaacgaacccaccggcaagggcaccttttttattacccgaaaactcaccttctatacatacataaaaaactcacgtgcatgcctgccttaacccccaccaacccaaacctgcccattccgtacacaaaacatcgtctcttcttttctctggtacacccacctaatactgtaataagcaatacccgacctgctaactatttattcccctcacatgtacactcatgca

SEQ ID NO: 72167 - DNA, 405 bp, Triticum aestivum
  Clone ID: PAT_TA_72167
gatttcccaaaaaaacctgaaaaatattattggcctgaattatttaaatgaaaaccaatccttggccccctcccaaaaaacccccccccttacctgaaaaaattttaaaaactgcttcaataatctctttctcaaaaaaaactttttttaggccccaaccctaccctttttttgggtccccaaccaacctacttggctggtgccttgcccgtcccaacaacaaccacagcattaaatggggtcaactcgtcccaagcctccatccaagggaccctggcatcaacaagcttcacaaaataaggggcaattttgccaaacttttcctttacccgctcccaaaaggaaaagtaacccttttggactgggtcacactccttggaaaagggggccttctcgaaaaaaggg

SEQ ID NO: 72168 - DNA, 340 bp, Triticum aestivum
  Clone ID: PAT_TA_72168
aaaaaacaaaaacttttttttttttttattcccaaccttaaactaaccctggtcggggtcacacattatggcctcccccactttttttttcatccctacaacaattggtgcatcaactaaccaacaaaaatccctttacctattaccataactcttccatttttcattggccaccaatgcccacaactttttttgaaaatggtccctttatgggggaccactcaggggaaacataccccttccacatggttgaaaaaattctaaataccaatgacctgatcacctccaattaacctggtttttaaggttgaataatcccctcaccctaaaaaaactaaaa

SEQ ID NO: 72169 - DNA, 296 bp, Triticum aestivum
  Clone ID: PAT_TA_72169
aaaccggttctgccaaaaaaacttatttaatttttctttgctttttaattaaccctggcttttccccatgggggattggaattaccggcccccctttttttaaaacctcacactttgctttaaccaatcacttaccctattattccggggcggaaaaaaaaaccctcccctccgggggctcaacccggcccccgggcggtacccgtccctttttaaacctaacccaaccggcctggggtttttgctcccccccctccccgaaaaatccttttccttgttgccgttggggccttttg

SEQ ID NO: 72170 - DNA, 409 bp, Triticum aestivum
  Clone ID: PAT_TA_72170
aaaaaccccttttttttttttttttttaaaaattaaaacaccttttttgggggggccacacataaccttggggaaccctttttttggcccccctacctcaacttttccatcaactaaacaagggggacccaactaaattttactaaaaatttttttttataaaaaaaccccaactccaatcccaacccctaaggggacacttgggggggtttctaaaaacgggactttgaccctgcacatttttggcggggccccgagtccaatggaaactatcacctcaagctgaactttttggggggggtcaaaaaagggcccatttcccaactgtttttgttaagggtttcccccaaatttctcctcaaactgttgtggggggggggaaaaacattggcccaactggggggggggg

SEQ ID NO: 72171 - DNA, 336 bp, Triticum aestivum
  Clone ID: PAT_TA_72171
gtttttttattcccaaatttaaactaatatatttcgggttcttacataaaagtgcatgtcaaatttttttttcaccggtacaacaaccaaaccatggactgaaaaaacggggtttcatatttttaatactaaagttattttcttctcaattaataccaaaaatcccaaatggcccaatggggcaatatggagggatttaaacattgcacattgcaggtaccctctgtagggctaggttccttatttcctcaaactggggcaattgttgagggtggacaaaaccctgggcctgtgggttttgctaaaatggccggaaggacccctggcctaatggat

SEQ ID NO: 72172 - DNA, 461 bp, Triticum aestivum
  Clone ID: PAT_TA_72172
gttttttttatttcaaatggcaattttttctccactttaaaatacaactgatttcactggcaatataaactttcaagtcccggacaaaattaactggcccaaccaaaattaactacaactttttatcccactccccccaacaaacaaaacaaaaatgaattccttctccaatcttttcaattcattcagggttcggaaaaccacccactttgttgctttcacctgcaaaattggtctaataaaattcatactcaagggcggggggtgcccggccctcctttttttccttccataaattgctgggcctccccgggcggtattactggtattaccccacccccccaagcagggcaaaaaccccgggaacgggggatttcaccccgggtgggggggcccatgaccaatacaactgggcttttttccttttaaagatcccctttggcaacggggccttggtcttg

SEQ ID NO: 72173 - DNA, 434 bp, Triticum aestivum
  Clone ID: PAT_TA_72173
acaaatcacactgacaatggataacaatcccttttgcacaagtaacaggggaacaaaaaaactaacacttactgtacaatctccaccacccaaacaaaaaatttgacaaatccaaaatccctcatgaatgcccaaaatggttccataactgttccctcattaatcatatacacatgctgctccacaaataaacaggtgggctttattttccaaaccaacctttttgggcaggctgcccatcaatgtcgttcatcaacttgtcaaacaccacgttcaggtccacattttgaccgttttttgtcaacctgcgtacaatcccccttacttgctcctttaaaaaccccattgtaaaaaccttgtccaccacgttttccacccccacccttcttccggacaaagcactcggggtggaactcactggccctgcttggggc

SEQ ID NO: 72174 - DNA, 237 bp, Triticum aestivum
  Clone ID: PAT_TA_72174
aactggaaaactttttattttccattattattgggttttaccctatttacataaaaaactgggaaccccccccccctttattggatacctaaggggcattcttccccaaacaccattcaagctgcaaaaaattttattactgggtaaccaaaaatgcataccccccctccatccaaaacacttttggaatttttttctcgggcttttgcccctttcccaccattgggctggcccatt

SEQ ID NO: 72175 - DNA, 351 bp, Triticum aestivum
  Clone ID: PAT_TA_72175
attaaaaccccatttttataaaccgggggccctgaagggaaacccaacatcaatacaaggaaatcctcccaaaaaaacaaaaaccccaaactggggggggcaataaacataaccggggggatagggtcataattttgccaaggaattttttaggaaaatttttttatcatcatcatgacggaaaacaggcccccaccaattaacccccaatcaagcaaaaattgttccttaaaaagttgccccacctcctgttcctccagggggggcctttttcaaaatgtgaggggaaaactggcccttgctgatgtccctccccaaaggggtgatccaattttggaaggccttggaagg

SEQ ID NO: 72176 - DNA, 322 bp, Triticum aestivum
  Clone ID: PAT_TA_72176
gccccaaaaaaatttttttttttaaaacaaaaccggccccgggcccggctcatgcctttttgccaaaagggctttttttttggcccggccggttcgtttttccaaaaacccgcccccttgggggggccctgtttcacgggcctgccaaaccccggggggcaacttattggtcccgctaaaccccccccgggccctggttttggggggcccctcccccccccccaaaaaaccccccgcgcccaacccgggcgggccccttttccttgtccccctggttttcagggcatggaaaaaacccccccctggggggcaatccctaacc

SEQ ID NO: 72177 - DNA, 414 bp, Triticum aestivum
  Clone ID: PAT_TA_72177
ccataaaccatttccagggccgatttttttaattttttccaaaattttgaaatggggcggtcgggggtccatttatggccccatttaaaacaacaccttacttggaagggcaaacttccctgatcacaataaaaaaattttgcccttgtaaatcagttgaaaaaaccattttaaattccctttccaactttttttccttggacagggggggaaaataacctttggaaacctaaaccccttgtttttttgaaatttgctccaccacccattgaacctgatcggcaccaacttggtttggatccaaaaagcccccaatttccgggcatttgtccccttgaaaaaaaacaagcccctgccccgtgggaaaccctccgttccgtcggggaacccttggggggatccttttaagggggg

SEQ ID NO: 72178 - DNA, 477 bp, Triticum aestivum
  Clone ID: PAT_TA_72178
aactaatccccccttaaaaaaaaaaatcccaggggcaaaaccccccccccccctccttccccgggtttttccaaaatagggggggtcccccccatcccctaactttttcccccttttttgaaacaaattttttgggggcaggaacccctcccccccttaaaaaaaaaaaacaaaggggggggtttaaaaaggggggagaaaaaacctttggaaccccaaaaccaaaccgggaaccttgaaaagaaaaaaattgggggggggacccggccccccattgcggggcccccccccccaaatgggaaaattcttcgggggacaacccacatttccggggggggggcagttaaaaatttattgttcaaccccctccaacccctacaaagggtccccttgccccaaaagggcttacccttcccgatgtttttttttaacattacaacttgggcaaaaaaaatcttcgggttaaaaatttccctt

SEQ ID NO: 72179 - DNA, 358 bp, Triticum aestivum
  Clone ID: PAT_TA_72179
gggaaacaaaaaatgtgtttgtcttttattcccatgtttgaactattttatttcgggttcttacataaaaaaacatgttactttattttttcaccgcttccacgaccaaaccatggactaataaaacggggtatcatatatctactactaaaatacttctcttctcacttagtaccgaagatgccaactggagcaatggtgcaatatggagggatatacacattgcacattgcaggtaacgactctagcgctaggttccttatttcctcaaactggggcaattgttgaggctggacagaaccctgggcctgggggttttgctgaaatggctggaacgagccctggcctgatggatatt

SEQ ID NO: 72180 - DNA, 451 bp, Triticum aestivum
  Clone ID: PAT_TA_72180
aaaaaaaaaccggggtttggttttttttcccaagtttgaaccaatataggggggggttttccatgaaagggcctggcccatttttttttccccgctccaacacccaaacctggggcggaaaaaacggggtttcatttttttagccccaaagttttttttttttcaattacccccaaaaatcccaaaggggcccagggggcaattggggggggggtaaactttgccccttgcggggaccctttgggggggtggggtccttttttccccaaacgggggcaattgtgggggggggaaaaaccccggggcctgggggttttgctaaaagggccggaagggcccccgccctaagggatttttttccaaaggctgtgggaaggaaacccgccccaagggggggggggggtgttttcggggcggccgcaaaataatccccggacccccttgggggggg

SEQ ID NO: 72181 - DNA, 317 bp, Triticum aestivum
  Clone ID: PAT_TA_72181
gggcccttggtggtttttttttggaaccaccctttttgggaacattaaaggggttcccccccaaagggggggttattttaatccctgaaccaattttgacattttttcatgcccccttaaaaaaaaacttttttcccggttggaaaaatacgggaaaaactttggctggatttaagggcgaaaactcccaactcctttttcctggtaaaattgagggtttaaacttttggcctaaaaaagccccatgccttggggaagaaattaacggggaaggggcccaaaaatgagtttttttctgggaagggactaaccctggg

SEQ ID NO: 72182 - DNA, 415 bp, Triticum aestivum
  Clone ID: PAT_TA_72182
ataataccccaaaataacatatttaaatactttcatgtttcaaacggaagtaaacacacatttattccatatttccgatttaattaaaacaagcccaaagcacaaactggacacacatttgtttatcgatcgatgggtgtctcatttttcgagcatagtctttggaccaatcgatggagtagtaggtaccatataaaccgggtaactgactgggccatggcatattttaaagctccagctccatgcacccaatttaattgtaggccaggtacctgcatgcatggatggatggatggatcaaccattcaggcttggaaggggtgcctggaacagggcacttaaaccctggcccaaaggggcctgcccttgatgataaacttggccgtgggctcgcccccaagcaacaccgggatca

SEQ ID NO: 72183 - DNA, 437 bp, Triticum aestivum
  Clone ID: PAT_TA_72183
caaacaacatgtttttgtcccccataaatcaaacttgtttaatccatctacaaaaataaattgcttcaaaccccccgttaaaattacaaaattttcatagcaatcgggaaaactacaaaggcggggggggactttactttcccacaacattttggggttcttgggggggaacccattttttggtccacattttaacaaaacacaaaaccttttttaaacaaaatgaccaaaaacaaaatggggccccaaaaaataaaaaaaaattggccccaaacccttttcaaaccgtcccaaaaatgaagccgggacctcatttttattatggccggcccgctccttttccacagctaagggcatctaatcagggaattaaacaggggacaaatccccacccttttttttgcatgggggacagtaaaatacccctcccgctcagg

SEQ ID NO: 72184 - DNA, 358 bp, Triticum aestivum
  Clone ID: PAT_TA_72184
ggaaacaaaaaaaggggttggctttttttcccctggttgaaccaatatatttcggggtcttacctgaaagggcctggtactttttttttttcccccttccaccacccaaccctgggcctaaaaaacggggggtcatatttttaccccttaaggtcttcttttttccagttgcccccaaaaagcccaccggggccatggggccatttgggggggttttaaccttggccattggggggggcggcttttacccctgggtccctatttccccaaaccgggggcatttttgagggcggacaaaaccccgggcccggggggtttgctgaaaagggtggaagggaccccggcccggtgggttttg

SEQ ID NO: 72185 - DNA, 374 bp, Triticum aestivum
  Clone ID: PAT_TA_72185
aaaacaaaacccacaaagggggtttttacttcaaacataggggatttttcaatttcccccctaatcaaattaatacaggaccgggataaccacctttcccaagtccccgaaaaataggataaataaatttcaattgcaaaaccaaattttaaaaaaacccccatgaaatgaaccccctttttttgcaaacccccacagttttgggccatcacttggccccaaaaaacaacccccacctttgttcaccaaaaaaactcctttgaagtttcccgttccacccaaccacaatatcgtcataacccccctgaccaaagtcggccaaaaattcatttttgtttttttaaacttcaactacctccctttgaaaaactttt

SEQ ID NO: 72186 - DNA, 392 bp, Triticum aestivum
  Clone ID: PAT_TA_72186
aaaaaaaacctgggtttgttttttattcccaagtttgaactattttagtgggggttcttacatgaaagggcggggcaaatttttttttcccgggtacaacaaccaaaccatggactgaaaaaacgggggtttatattttaaaacccaaagctttttttttttcaattaaccccaaaaatcccaaaggggcccagggggcaatttgggggggtgtaaaccttgcacatgggggggagcgtttggacccctggggtccttttttccccaaacgggggcatttgttgggggtggaaaaaaccctgggcctgggggttttgctaaaagggccggaaggacccccggcctaagggattttgttccaaaggctgttgaaaagaaacccgccccaaggg

SEQ ID NO: 72187 - DNA, 365 bp, Triticum aestivum
  Clone ID: PAT_TA_72187
gccccccaaaccaaatggcatcacataatatcacattacacttgccctaaataaaaaaatcacattactaactggcccccaaaaaatgcaatggtgcaacaaaaatatgggtggggaggggaaaggccaacccaaagggccacccctaatacttggaccgggattgggatatgccacaaaaaaaacaaagggtgaactttgggcgcacatgccacctaactttggacccaaccaccctttcgctataaaaacctgctaggcccccggggaattgaccccaagtccccaaacccggggaaaatgcaacccaagggggggaaaaattgacaaatatcaaatgggcggcccaggggaatatcacccgc

SEQ ID NO: 72188 - DNA, 208 bp, Triticum aestivum
  Clone ID: PAT_TA_72188
gggaaacaaaaaacttggggggcttttattcccaaacttgaactaacactgggggggggcacccctgaaggggcccccccctttatttggcaatcttacatccattggggcctttggttaataaccaagaaccctctatctattactataaaacttggttttttcattgggccccaatccccccaaattttctgggaaaaggggcccc

SEQ ID NO: 72189 - DNA, 415 bp, Triticum aestivum
  Clone ID: PAT_TA_72189
aaagggcaaaaccaaaaatggattttcaaaaaaattgtaaatttttttgccccctttgctttggaaatttcccaaaaattaaaaaaacttgtcctatttggaaaaaacccaaggctcaggcccaaaacccaagctgttttcggcttccccccaaaaaaacctttaaaaaacttttccggggggggttcccccccggaaatgggtgccggaaaaaaaaaaaaccccgggcccccctaaattttttggcaaggccaaaaaaaaaaaaagtggggggccccaacccccgggggtttgttttttccccccaatttttaaaaaacaaaccccccaaaaaggacggccctttaatataaaaaaaacccggccgccccctaaaaaaggggggtttccctttggaaaaaaccccttttgggcc

SEQ ID NO: 72190 - DNA, 382 bp, Triticum aestivum
  Clone ID: PAT_TA_72190
ggacccaattcagggctcacttattctttaaattcatcaaaactgctgcccaccaacaaaaatttgcacttacaaacaataaccctggattacaatacgggttttttttttaaaaacaaaaaccgttcaggccaccacaaacaccaaccaaactccattggggggcccccaaaaccgattacaaaaaccgctccatgggcaccaacttactggccacctcggaaaccgggcccccaatgaaggggtgaccccttctgaatggtgtaatctgccaaggggcgggcattcttaaactggttaccaacaaaaaagaagcccttctggtcccgggggatgccccccttggcccggaacttggccctcaccttgtccatggggtcaa

SEQ ID NO: 72191 - DNA, 286 bp, Triticum aestivum
  Clone ID: PAT_TA_72191
gagcccaacccctcgatttattaaccttaacaaaaaaattgaactgccctttgttcaaatgtttgatccccaaaagggaacataacttatcaatttttattatcaccatccgggaggaccattctaatgttgccgatgggattattattggcacgatcaaagggggccggatacattggtggctggctccaagcccaggctttaacaccccttgagggggggatagcccttgtaccccttgcaaacgtaaactttgaaattcccgtaatcgttataaagcgggttg

SEQ ID NO: 72192 - DNA, 420 bp, Triticum aestivum
  Clone ID: PAT_TA_72192
aacccaaatcaaaaagcacccccgggaaatgcctgcctgcctgcctgggaagaaaaccactggcgtcgttacccatttccccaaagcaacaatggttggggggatttaacaaaagtttccccattttttcagaggcaatgctcaggggtttccaccggggctgttctttcatgcccatcaaaaacaagggcccgttatctgaggtttggttgcaatcatatgaaccccggcccctgccttaattatgtacatgtttcacaggcaatttgttcggacgtaggcattcccccctacctccatttgattaaaccggttcaggcccaaactggaagcgatgacattgaaagcccccctaggaacagggggacataggccattacttgctgccggggggaccctgttattttcccacccaaaaaa

SEQ ID NO: 72193 - DNA, 351 bp, Triticum aestivum
  Clone ID: PAT_TA_72193
aacaaaaaaaaacccatttggtttttttttaaggggaaagcttttaatttggcattattatgggggtttactttatttacaaaaaaaacggggaacccccctaacgtttttgggatagctaggggggatgcttgcccaaaccccatgcaagcggaaaaaagtttttttatggggtagccaaaaaggggtgccccccctcaatccaaaaaattgggggaaattgggtcgggggctggtgcccctttgcaaccatggggggggccgtttggtgttttggccaaaaagggggggggggggcgaaccctgggggcttttgcccggaagggggcccttggccgggggggggccctt

SEQ ID NO: 72194 - DNA, 338 bp, Triticum aestivum
  Clone ID: PAT_TA_72194
aaacaaaaaatgggtttgttttttattcccatgtttgaactaatatagttggggtttttacatgatagggcctgtcccttttttttttcaccgttccaaccaccaaaccctgggctaaaaaaacggggtttcatttttttcctcctaaagttttttttttttcagttagtccccaaaatcccaactgggccaagggggcaatttggggggatttaaactttgcccattggagggggcgtttttacccctggggtccttttttcctcaaacgggggcaattgttgagggtggacaaaaccctgggcctgggggttttgctgaaatggctggaaggaccc

SEQ ID NO: 72195 - DNA, 381 bp, Triticum aestivum
  Clone ID: PAT_TA_72195
aaacaaaacctgggtttgtttttttttcccaagtttgaactactttggttcgggttcttacatgaaactgcatgtcacattattttttaaccgctacaacaaccaaaccgtggactaaaaaaacggggtttcatatctctaccactagaaggtattttcttctcaattagggccgaagatgccaaatggcgcgatggtgcattatggagggatttacacattgcacattgcacgtagcctctgtttccctaggttccttatttcctcaaactggggcaattgtttaggctggacagatccctgggcctgtgggttttgctgatatggccggagggagccctggcctaatggatattgttgctgaagctgttggaaggaaac

SEQ ID NO: 72196 - DNA, 371 bp, Triticum aestivum
  Clone ID: PAT_TA_72196
gcggggaaagaattcccgttaattccatttccccccctttggagcatctaattgggagccattactttcccccgggggaaacccccccttttctattacacaatcttacctatcaaacattcattttatgaaaataccccaaaattcccggaaaaagggaactttggtggaaaaccccaaaaactaaatgcctctacccgggattgggccattgaattaccatgggtgggaccaaaacttccaaccccggggacttaggatgagggaaaaaatctcttcttaacccaaacttgaattggtgccccccgaggggggggggctcacccttgaatgatggttaaggggtacccaactgggcctgccccggttga

SEQ ID NO: 72197 - DNA, 465 bp, Triticum aestivum
  Clone ID: PAT_TA_72197
aaacaaaacatgtgttcgtttttttttcccatgtttgaactattttaattcgggtttttacatgatactgcatgtcacttttttttttcaccgtttcaacgaccaagccatgggctaaaaaaacggggtatcatttgtctactactaaagttctttttttttcattttgccccgaaaaacccaactggaccaatggggcaatatggggggatttaaactttgcccattgcaggtaacgtttttagcgctaggttccttatttcctcaaactggggcaattgttgaggctggacaaaaccctgggcctgtgggttttggtgaaatggctggaaggacccctggcctgatggattttgttgttgaggctgttggaaggaaacctggctcaacggttgttgttgttgttgttgttgttgttgttggtggtgttgaggccaaatattaccctgaacaactttggggatg

SEQ ID NO: 72198 - DNA, 416 bp, Triticum aestivum
  Clone ID: PAT_TA_72198
aaacaaaacatgggtttgtcttttattcccatgtttgaactaatatatttcgggtttttacatgaaactggatgttactttattttttcaccgctacaacgaccaaaccatggactaaaaaaacggggttttatttgtctactactaaagttctttttttttcagttagtaccgaaaaacccaactggagcaatggggcaatttggggggatttaaacattgcacattggagggagcgtttttagcgctagggtccttatttcctcaaactggggcaattgttgagggtggacaaaaccctgggcctgggggttttgctgaaatggctggaaggacccctggcctgatggatattgttgttgaggctgttggaaggaaacctggctcaacgggtgttgttgttgttgttgttgttg

SEQ ID NO: 72199 - DNA, 440 bp, Triticum aestivum
  Clone ID: PAT_TA_72199
ggggaccttaaacatctccctaaacttaacatatctggagttcatgaccaccccaaaatcatgcatatctcaaacttctgctacagttttaacatatctggatcataaacaaaagctaaaacccaaacttcatacctatttggcacaagggcacaaaaggaaatccaacatctacttaaatttaactcctaaaacacaccacattgcaccacatgacttgtttgaaggctattatcgttcctttgacttagcccgtccatggataaaaacacacccccacattaaactggccatacttcaacgtccagtcatcgggggagctaaaagggccggcatttccaccctgaaaagtccactggaaaactgattcctccacctctaactgaaccttcaggtctctctctgccttcacagcaacaacgtgcttgaaaaccttctcc

SEQ ID NO: 72200 - DNA, 353 bp, Triticum aestivum
  Clone ID: PAT_TA_72200
aaacaaaccttgtcctccagaatccaggttttgatttcacttgtcaccccaccaaaccaaatcattttaaaaccccaccccctcgttttattacccttaacaaaaaaatggacctgccctttgttcaaatgtttgacccccaaagggaaacataccttatcaattttttttatcaccatccggcgggaccatcctaaggtggccgagggcttcatcttcggcccaatcaaagggggccgtatcctttgttgtttgcctccagccccaggtttcaacccccctggggggggggataccccttgtcccccttgcaaacgtaacctttaaattccccgtaatcgttataaaggggt

SEQ ID NO: 72201 - DNA, 420 bp, Triticum aestivum
  Clone ID: PAT_TA_72201
aattgttctaaaaaattttttgttgcccctcccatttccttcacaataaaactgaaaaggggtccattgtcttcatggtcaataaaattttttttacaaaacttggggtaaatgaaggccaaaaaatctccccttccctaacctaccccatgataaacccgtaattttgctcccttttcgtccccagtagtacccattttctttattcttggacccaaataaaccttaaaactaggaaattgctccccggaaaggggggtatttcttttcaaaaaaaaagggggaagttttagggtctactttaacccgttttggggcaatttattttcggacttttttttgggagtgctcccataaaaaaatttttttgtttttggggaaacgggcttttcctgttttttaacaaaaggggcttttttt

SEQ ID NO: 72202 - DNA, 460 bp, Triticum aestivum
  Clone ID: PAT_TA_72202
aaaaaaaacccgggtcgggggggaaaaaaggggaaaaaaaattttttttaaacaaaacaatatcccccatccttgcccccctaaaggagggaaacttttttgatcccggcaaaacttgggggggggctaaacccccaaaaaccccaaaaaatgaaaaaacaaaaattttaaaacccccccctttttttaaaggggggctgaaaacccaagatttcccctccccacctaagccccccctggttttaaaaaccccaaattttttgaccaccctgtttgacccccctgaatttttgggtcaccaaaaccaaccccccggcccattcctttagggcctaaaaaagggaaccaaggggcccaatggcaaaaaaatttgggggttaataaaccaaaaacttttgggggtccctaaaggccccccaaacaaaaatgacccgggccttttgcccataaaaaaggtttt

SEQ ID NO: 72203 - DNA, 355 bp, Triticum aestivum
  Clone ID: PAT_TA_72203
aaacaaaacctgtgtttgtttttttttcccaattttgaactagtttgggcggggttcttacatgattgggcatgtcacatttttttttcaccggttcaatgaccaaaccatggactaaaaaaacggggttttatatatttataactaaagttatttttttttcaattactacccaagatgccaaatggcgcgatggggcaatatggggggatgtaaacattgcacattgcatgtaacttctgggccgctagggtccttatttgctagaactggggcaaatgttgaggctggacagagccctgggcctgggggctttgcccaaatggccggaaggagccctggcctaatggatatt

SEQ ID NO: 72204 - DNA, 366 bp, Triticum aestivum
  Clone ID: PAT_TA_72204
aaaaaaaacctttggttggttttttttcccaagtttgaactattttagttgggggttttacatgaaagggcatggcactttttttttcacctttacaatgaccaaaccatgggctaaaaaaaggggggttaatatttttagtactaaagtttttcttttctcaattaataccaaaaatgccaaagggggcgatagggcaatttgggggggtgtaaacattgcacattggagggagcgtctggaacactagggtccttatttcctcaaactgggggatttgttgagggtggacaaaaccctgggcctgggggttttgctgaaatggccaaaaggggccctggcctgatggatattggtgttgagggt

SEQ ID NO: 72205 - DNA, 360 bp, Triticum aestivum
  Clone ID: PAT_TA_72205
aacacccaaaggccccccaaccgggcctcactaacatcaacatttttgtctgtctctcaatcccacttaacaacccccggtttttcaaaggccaaccaaaacaaacgggggaacaaacttcatctttacaaaacccaacccaaagggggccccaccggcccaaaaccctataaaaataaaccaaacccaggccccaggtgggcaaccccccaacaaattaacccggcccccttgatgtcccggcaccaaaccaaaaaaaactttttttacctcaaaaccaaaacaatcaaaggagcaagctgccgtccacccaaacgtccgtccccccccttctaaaatggaacaaaggatcccggtttt

SEQ ID NO: 72206 - DNA, 430 bp, Triticum aestivum
  Clone ID: PAT_TA_72206
aaaaccccaaaattttttttataaaggggaaaacccttttttgccgcattgactaactgacaatccctggacctttgcggggttgatccattaaattcaacattcaacctgccacctggtgcaccccccctttgacaaacaaacaatcataacaatgatgttcccttacataaaaaccttaaaagctgacaaaaattaacccccgcccctcctgttttgtagtcaatacgtacaaaccaaaaacagcttcccattatttaaatgaatttcagtcccctagggaaaaatccccctcccccaaaataaacagctgatcgtttagttgcgtcaatttacttacccctaccataaactaaatgggcaaaaacaaaattttttgagggggaaattcaaaggcaacccgggaatgctagggttaaaaattcctggg

SEQ ID NO: 72207 - DNA, 418 bp, Triticum aestivum
  Clone ID: PAT_TA_72207
ggaaaaaaaaaccggggttggttttttttcccaaggttgaaccaattttgttcggggttttacatgaaaggggctggcaaattttttttttaccggttcaacaaccaaaccatgggctaaaaaaacgggggtttatttttttaagaccaaaggtttttttttttcaatttatccccaaaaagcccaatggggccatggggccatttggggggggggtaacattgcccatttgaggggacctttggaacccttgggtcctttttttctcaaaccgggggcattggtgagggggggaaaaaccccgggcccggggggttttctgaaaagggcggaagggaccccggcccaaaggatatttttgctgagggcgttggaaagaaaaccggccccaaaattggggggggtggttttggggggg

SEQ ID NO: 72208 - DNA, 194 bp, Triticum aestivum
  Clone ID: PAT_TA_72208
acaaatttggaaaaaaacccaaaacccttttttatccctggggttacaaatcccgggggaccccaaaaaaggacgggacttgtccacctcacaacaataatttacaaaaaaagctttttaaaaaactcccccctaacaacaactggaaaaccaaccaatccccttcctttttgactggttaaaccccctagggc

SEQ ID NO: 72209 - DNA, 419 bp, Triticum aestivum
  Clone ID: PAT_TA_72209
caaaaaggaacaaaccttgggccccacctttttgatttttataaccccaaaataaccctcaccccaaaaaacccccaaaattccaacaaaattttggggggctctgcccccaattccggagggaatttgtcaaaaaattacagtaaacttcgttttttaaaaacccctgggaaaaaaaacagggatgctaacagggacccttaaaaagttcatccttttaggcggggatgctaacacccttcctttaaaaaagccatccatttattggggttattccccattggggccccccaaaagggggcttaattttgttcaaacaattggacctttctaatgaaaacaaaaaacattttgtattttatcagggccagggggaaacacaaaactttttaaatccctgtcttccggggctaaattgt

SEQ ID NO: 72210 - DNA, 379 bp, Triticum aestivum
  Clone ID: PAT_TA_72210
ggcgctaaaaaactacacaatccatatgatggggtatattccccgggttcattcattcatttccgggatccttgctggtactggcacatgttttttttttctccctcaacaaatccatcctacataacaaaatgatgaaaccggaccccccttcggcggggcggggccttcatggaccacaaccggtgatcacttctccgaaccctctgggtgttgctgctgctgcttctggtcccccaaaatgcgggtgcggaaatcctggaccatgagggggaggcccttccttaaccccaccttgggctcccaccccaacaactccttggccttggtgatgtcgggcttgcgcttgtgcgggtcctccgcggtgtttgccccgaac

SEQ ID NO: 72211 - DNA, 664 bp, Triticum aestivum
  Clone ID: PAT_TA_72211
gggaaccattcagcaaacattaccactgacaaaccatcctttaaaagtaagcgactgcaattcgatagtttacaacatctggcagctaaaagtaatctgccgatattaccaccactaaccatcctttgcaccagtcacaacagttgtaaacaaaaataatgttaatcacacaataggcaagccctaaaatcaaaagcttacacactttctctgacaactagatatgaggatagttcatctgctttctcacgacctcaggagggataatctcttcttggcctattacattacatacataagctggaggctgcaatttgagagcccatggtaactgtaatctttccatccagaaaagggagcacacatatcttactaaggagccttacaaacaatagagcgtttgacaccataaagatgaaatgtattattctaaatgttttggaaatgtatgcacatcgccgtctgcttcaaatgtccgccctcatatactcattggcatcactaattgtagtaaaatcacatggatttctgttggtcacacagatatcctgtcttaccaatctatccaagggattgggattgggattggccattctcccttgatctctggtccaagactgagcagtatcattcctcactgaagaaaatcctggactggaactaa

SEQ ID NO: 72212 - DNA, 268 bp, Triticum aestivum
  Clone ID: PAT_TA_72212
ggaaggcttaacaaaaacatttattggatttattggatgggtaaaaagggtgaccggggaaacccctccatttcatttaaagggggggggaacccacaacacccccttttaaaaccaacacctttccaaaaaaaaaagggggtggcccccttacccctgaattggaccccccccaaaatttttttcccgaaaaagaaaaagaaaaggggaacccccaagaaaacccttacccagggggggccttccttttgggggaaccttttaaaaa

SEQ ID NO: 72213 - DNA, 352 bp, Triticum aestivum
  Clone ID: PAT_TA_72213
aaaaccggggtttggttttttttcccaagtttaaactaaattgtggggggttttaaaaggaaagggcgtttccacatttttttttccccgctaaaacaaccaaaccttgggctgaaaaaaaggggtttaatttttttagccccaaagttttttttttctcaattaatttcaaaaatcccaaagggggggaggggccaatttgggggggtttaaactttccccattccggggacccttgggacccctaggttccttttttcctcaaacgggggcattttttaagggggaaaaaaaccctgggcctgggggtttttctaaaaaggccgaaaggacccccgcccaaagggatttt

SEQ ID NO: 72214 - DNA, 312 bp, Triticum aestivum
  Clone ID: PAT_TA_72214
ggcttgaaacaaccttatttggattttatttcaaaatttaaacaactattttgggcggggcacaccccaacttgggggacactttatttggcacccctggatccacatatccatcgactaaacaacggggatcccacttttttttactaaaaacctttccttattaatagggaccaacttcggggccaacccccaatgggacacttatggggggtctattcaacgggccattgaccccggacatttttggtaggggaccgagccccatggaaatcattacctcaagccgaactatttggggggggtgcaaaa

SEQ ID NO: 72215 - DNA, 441 bp, Triticum aestivum
  Clone ID: PAT_TA_72215
aattaaaaccccaagttgggggtgggacctggcaaaacaaacttataaacttgcaagcatgggattcaaatcgacgtccacacaaccccgatttgaacattggttaaaaaacacttcatttgtttttattccaaaatttaactactacttgggggggggcacacatgacgttgggggacactttatttggcaccgtttcctcaacatggtaatcgactaaacaacggggggccaacttttttttactaaacaactttttttatcagtaggcaccaactccggggccaacgccaaatggcacactggggggggggcttgacaacgggacattgacactggacatttttggcaagggacggagtgcaatggaaatcaccgcctcaaggggagctatttggggggggtgcaaaaagggaccctggaatacctgttgttgttgtt

SEQ ID NO: 72216 - DNA, 521 bp, Triticum aestivum
  Clone ID: PAT_TA_72216
cggttgagttggaccctttaaattaagcaaaaagggagggagtattacacaaaaaacacaagtatatggccaggagcccaaagcccagtgtcctacccaccttcatgccccttctcgggagcatgaaaaaggcccacaaaagcccagcagccacccagcctagcgtctggtaaagcctgggctcccagggtatcgctacgggcttcgggtacccggcccagcaagacagcaacagagacaggcccagccccacgaggacgttgaacaccggcccgccgtagcaacctgctacggccacctgggctccaccggggcgcgccgccacggccacggccacgttcgcgatgaggtcgcccagcgagttgccccatgctaaaactgtcatccccagcgtcgccggatccacacccagcaccaggccggcggacacaaaaagggagaggagctcgttcgcgatgacgtactcccaggccacgctcatgacgaacccaccggcgagccaggccgagaggaatttcgtc

SEQ ID NO: 72217 - DNA, 382 bp, Triticum aestivum
  Clone ID: PAT_TA_72217
aaaaacaagggaatttttttacaaaagacctaaaatttttggtaaaacaatttaaaaaaaattccggaacgtaacaagggaccccctaaaagggttcggcccccaaaaagaaaattttccccctcaaggaatttgggttcctttgggccccttttttttgccccctttgccggggccttttttgcccaaatctcgggaaaatttttatcgatttcactccccccaagttgccaaagggcccccttttttggcaacaccggaaactcaagggttttcccaccccttttaaaaacctttaaaaaaacacggggggggaacttggggggccccctgccggagggggccttggattttttttccaaaaacccccccaggggggggg

SEQ ID NO: 72218 - DNA, 353 bp, Triticum aestivum
  Clone ID: PAT_TA_72218
gcaaaaaaaaaccggggttggtttttatttcccaggttgaaaaaatctaattcggggttttacctgaaaaggcctggccctttttttttcaccggtacaaccaccaaaccctgttttaaaaaaacgggggttcatttttttaggaaaaaaggtctttttttttcaattagtacccatgaagcccaaggggcccagggggggccacccatttggggggggggaaaccttgcccattggtgggaacgcctgcaacccttgggtccttatttccccaaaccgggggaattgctggggggggacaaaaccccgggcccggggggtttgctgaaaagggcggaaaaaaccccggcccg

SEQ ID NO: 72219 - DNA, 161 bp, Triticum aestivum
  Clone ID: PAT_TA_72219
gggtttttttttcccaagcaattaaaaaaattttatccaaacgtccattctcatcattaacataatgataaacataccataatccctttaacttggcttcaaccaaaattatattgcccgggcacctaacattccttttcctttacaaaaaaatgggaaac

SEQ ID NO: 72220 - DNA, 465 bp, Triticum aestivum
  Clone ID: PAT_TA_72220
aaaaaaaaaatgcttttttataagttgaaacaacttttccccaaacagtttgctcattgggggaaaccccccaaaccccctaaagctaatagtttattcaaaaagcaatagccgggccgggtggttcacagtaaccaaacgacaaaagacaaacagtcagagcaaattccacaaactgaacatttgacagcaaattacttgcacagcaccaccccctcctccaaaaaatcctccgctcgccatgcaaggggggtggggagcttgcctttcttgaccagggggggggtttccacagtctcggcctcaaaacaggggaaaacggacctgggcgacccggcaaaaacagcaaccttttttttcgggggaaaactttggtaaatgaggacccctccacaggggagctcctgctccacaacgttgttgcagtcgtatgcctcggggtcaaactttttgccccaagggggg

SEQ ID NO: 72221 - DNA, 321 bp, Triticum aestivum
  Clone ID: PAT_TA_72221
aaaaaaaaaaaaactttgtttgtttttttttcccaaacttaaactaacccggggggggggaaaacatgaggggccccccccttttttttttaattgtaaaaaaaatgggggccttaattaaacaacgaagacccatctcccttttaacaaaagggtggcttttttaatgggcccccaatgggggaaatttttccggaaaagggggccttggggggggacccctcagggggaaaaaatactttgcccatgggggaaaaaattcccaatcccaaggacctgatccccccaaattgacctggtttttgagggtgaaaaaacccc

SEQ ID NO: 72222 - DNA, 440 bp, Triticum aestivum
  Clone ID: PAT_TA_72222
ggggctgaaaacccagggaaaacccttttttggaagtactattttattttatgcttggattttttgcaattatacaattatttttccagggttttccccaagttttttttgacatgaccaactatttttgatttgcacggcacctaaaaggggaccttgaacctttttgcttgggcgtgggcataaaacctaaaaaatgttgctttgacgtccttttaaaatttagggaggcccgggaatttgcaacccattttttcaaccactttcaatacagggctttcccggatctacctccaccccactagggggccgcaatgtacaaatagggctgcccctttggctcttccttttttttgcttgctgggcacctgtactccaacacctttttcctcccttcttttgcctggggacaaaaagcgggaggaaaatctacagggagg

SEQ ID NO: 72223 - DNA, 402 bp, Triticum aestivum
  Clone ID: PAT_TA_72223
gggttgaacccaaaacttttttatttactggcctgggggcaaaccccagccaaaatccattttttcccgtctttgaaaaaacccctacaaaaacacaatgggttggtttctcccacccccctttaaaaattttaccaagccccccccagggggggggtactacccctaattggactgggggggcaactcccctttcttgaaaaaggaattctccccggggaaaaccccccccctgaaaaacccattcaaaatgttctttaattcaacccgggaccccaactgggcataaaatggaattccaaaaaagggagggggcattgggggaataagcatgttaccccctgggggaaccctgggggccgggtgggggaaacaaaaattacccccattttcaacaatggg

SEQ ID NO: 72224 - DNA, 393 bp, Triticum aestivum
  Clone ID: PAT_TA_72224
aaaaactttggggccccccccccaaggaacccttttttttaaaaaaggccaaaaggggtttttgaaattccaaaaaaaaaccaaaggcccattgggggggcccccacatggggaattttttgggaaaaaaaacccccccccccccaatttattagggcggggcggacctttaaaagtggaaccattcaaaaaagcaaaaatttggtccgggcataaaagaaccaaccctgccccttgaaaaaaaaaaaagtggggcccccaataaaaacaaaatcttttggggggggggggggaaaaaaaactgaacagggggttcaactttaaaacttttttaattcccttcaccccaaaaagggttccccaaaaccccaaattttttggcgggggggcatt

SEQ ID NO: 72225 - DNA, 422 bp, Triticum aestivum
  Clone ID: PAT_TA_72225
aaaaaaaatcccgggggtgggcacatttgggcccctaatgggctttttccaaccctccaaggaaaaactaaccttttaaaaaccccttttttttggggcccaaaaaaaaaaaaaaaatgggggtcctttcaaaaaaaatacccggggccaatatttttttccaacccgggggtttttattcgggccacatttcaaaaaaaatttttcaaaccccttccctgtttggggttccccaacggggattatttccgacccacttaaaaggggccacaaaaaaaacttttttttttggaaacttggggggaacctgggccaaacccccttggggggggcttactttcaggggctttgctgagggccttgggtttccccccttttctggaaaaaaaattccatccgggttatttttttgccccccgcct

SEQ ID NO: 72226 - DNA, 413 bp, Triticum aestivum
  Clone ID: PAT_TA_72226
gatgggccccaaaaacaaccattttcattaaaccctttaaaaaaaggggcccaaaaccccacaactgaatggaatataacacaatcaaatgccccaaaaaacagggcccaacgtaaaggaaacaatttaaaaaaaatgaaaatttttcctggcttggggcccccttaaaaacccccatgggctttggtacttttggccaaactccttttttgcctttctttttcttgccaccaccctttttttttgactttgggcccaaaacaagccaaaccttaatttcaacatccccctcgatggattttgagggccccaattgctgtaagggatgtgaaattattttggcaaacccatttggcattaacaacacggggaacttgatgggggcaaccaagtccccttggtttttatgtaaa

SEQ ID NO: 72227 - DNA, 308 bp, Triticum aestivum
  Clone ID: PAT_TA_72227
gggtttttttttggacccccaaaacccaattgctattgatgtttataaagggggctccatactctttccacaagttaatacaacacaaaaacccctttgacaaaaacccacacaaccgacaaccgggaaaaccctatttttcaagggtctttttacctcacacaaatttattaatataattttgggtcaagctatataggagggaaaattcgacttttccgacaacacatgcgggtttggacctcctttggggagggaaaacccaaatgatcccacccggtgacctttaaaaatgaccattgaccaaa

SEQ ID NO: 72228 - DNA, 428 bp, Triticum aestivum
  Clone ID: PAT_TA_72228
gaccataaccaactcaattttgctctaaaagaacttaaaaaatccaatagttgctgaaaatcaattaactaggaaaaaaaatgggtggaatcaaatcaccacactaataccctaacatttttttttgggtaacaactaacactggatgtaccccttacaaaattaaattgcaagtttcacatgtgccaatccacccaaaacttaactcccacacgtgcatgcacccacaccctttttccccaaggggcatgcctgcatatgctggaccttaattaaactaaatttcgcaatcaatcgatcgctggtggtgctggtttttttttacggggccggggggccctgctttttgtgccgggggctggcaacccaaaaggggcttaccgccccgaggcgggggaaataatcggggatggggacaaaacaacaac

SEQ ID NO: 72229 - DNA, 317 bp, Triticum aestivum
  Clone ID: PAT_TA_72229
aaaaaaaactttttttgttttttattccataatttaaactattttgggcgggtcacacatgacattgggggaccctttttttggccccgctccctccacatttccctcgactaaacaacgacaatccaacttttttttactaaaaatttttttttatcaaaaggccccaacttgggggccaaccccaaatggcccaatagggggggggccctaccccggcccgttgaccctgcacattgttggccgggtcccaagtgcaatggaagccatccccccaagttgacctttttgggggggctgcaacaagggcccctggg

SEQ ID NO: 72230 - DNA, 436 bp, Triticum aestivum
  Clone ID: PAT_TA_72230
aaaaaaaaaccggggtttggttttttttcccaagtttgaacttttttatttcggggttttacatgaaagggcctggcacttttttttttccccggtccaacaaccaaacctggggctaaaaaaaggggggttcatttttttccccctaaagttttttttttttcagttagcccccaaaatcccaaaggggccaagggggcaattggggggggtttcccccttgcccattggggggaccgtttggacccctaggttcctttttgccccaaacgggggcatttgttggggggggaaaaaaccccgggcctgggggttttgctaaaatggggggaaaaacccccggcccgagggatttttttcctgaggcttttggaaggaaacttggctcaacggggggtgttgttgttggtgttgttgctggggggggggggggccc

SEQ ID NO: 72231 - DNA, 262 bp, Triticum aestivum
  Clone ID: PAT_TA_72231
ccccaaataaacatcccaaatttttttatttcggtcacacataaaacccccccccacctacctgccccccgtgggccctacctaatcaagcaacccgggggcaaaccgtgatcccatcggcaatagggacctgcccgggctcaacccgggtgtcgggggcaatcatggggttaaaccccctgaaggagtcccgttttttgcggccctcctccgtaagcggggtgtcttcgggcttggcaacggggcccccccaaagcgtgtt

SEQ ID NO: 72232 - DNA, 630 bp, Triticum aestivum
  Clone ID: PAT_TA_72232
gggggtgttcctaacaggacaaatacatgactaattttgtacaaaaaatttcagtgtccttagcaagaaggagggaccaacctttgtggatactatgtttgcaaacacatgatctccatctacaaatctgctgatagttgtgatgatccttgcgaattagtaccagtaagtctatcttaattaatatcttctactccactcatatgccacattctgatcttaaaaataccgcagctcatcttaaaaccgaggacccctgaaccactcccggctggtgaattgctgatggtttggagatttatcaacgacttcttcctgaatcactacatcaatcccactggtgataatgaagattttagcatgcattctcctgaaacattgagtaagagttaccgctaaacatatatgcatggatccattgtttttcatctgatgaggtcttcatatttcgtacactatgattaattatgtaatgcatatatgtgtggacaaatcattgaaatttagctacactagttgaccaaatggcgcagagaccggctaaagcaatgttgtcgatgaaaatagtttcattttgcaagaacctattcgatatttgtagtagaatgctatattgaaaatatgttatta

SEQ ID NO: 72233 - DNA, 398 bp, Triticum aestivum
  Clone ID: PAT_TA_72233
ggaggaaaaaaaggggtcccttttttttttactgccgcactccaaaaaaaccctggggttaaacaaactttttttttcagggccccccaacccggaaagggggggctccttttaaaccccagcccttttttttcccttttaaaatcgaaccccaaatcctccttttgggcccctcccagggttacccccggggcccttccggtcccgggccccccccccttttttttcaaaaaaccaaacccccccccccccgggttggcggcccccattgaattttttccgggttttctccaagggtcactccccccattgaacccccattggaccttgggcccccatttcccccccggggtgttgccccccttttttctgttgttaccccccccgaacggggcccc

SEQ ID NO: 72234 - DNA, 436 bp, Triticum aestivum
  Clone ID: PAT_TA_72234
aacccgaaacaccgcaatactttgaagtttgggaaaaaaaaaaccatgtcttaactggccccccccccgtataaaaaggggggcccccaacaaggccccccccagggggcctcactgaccctaaaaatccttaaacataaaaaaccacataaacaaactgccaacgagggcccccaaatctcttaaaaaaccaagggtaggaaatatcatccccatgctagggcatcccttcaaggatttttcaggagtcatatcattttcaaccataaattcatacctcacccttaacccccaaaaatcaaccccttaagggccccaatttgctgctacaaaaaaacaatctggaggggcccacaccccaatccttggttttcatggcggacccccggaacccaggcttttaaaatgaaaggggaaacttttccacctttgccct

SEQ ID NO: 72235 - DNA, 417 bp, Triticum aestivum
  Clone ID: PAT_TA_72235
aaaaaaaaaccgggggttggtttttttccccaagttggaaccattttttttggggttcttacatgaaagggcggggcacatttttttttccccgctccaaccaccaaccctggggctaaaaaaagggggttttatttttttagccctaaagttttttttttttcaattatcccccaaaatcccaaaggggccaagggggcaattggggggggtgtaaactttgccctttgcggggaccgtttgaacccccgggttccttttttccccaaacgggggcatttgtgggggggggacaaaccccggggccggggggttttgctgaaagggccggaaggacccccgccctaagggattttgttcccgaggctgttgaaaggaaacccgccccaaaagtgggggggggggtttttggggggg

SEQ ID NO: 72236 - DNA, 415 bp, Triticum aestivum
  Clone ID: PAT_TA_72236
gggaaatttaaaaaaaattttaaaaaggggggggacccaaaagggggtggggggggggggggggaccaaaaaaaaacccccaaaggggggggggctaactttaaacaaaaaaaaccccaaggaaaaaccccctaaagggaccccctaaaccaggaggaggggggggcccccaaggggggggaaaaaccccccaggggttccaaaacccacccctagggccaaaaagggcaagggccccaagggggggggacccccccccttggaactgggggggggaccccaattcgggggaaaggaataattgttccccaaaattccaaaggccccggaaaaatttaaggggaaacccaaggggccggaaaaaacccaaaaatttaaatcccaaaaaaaaaaaaaccccccatttgggggcccg

SEQ ID NO: 72237 - DNA, 475 bp, Triticum aestivum
  Clone ID: PAT_TA_72237
gggttttttttcccggccaaaaaaaaaacagtattttattttaacaacaacaacttgtttaaaaaaaactcaacaccccgtcccttttggactgtcatattttttccaaaaaaccaaaaacaccagtgatccgccaaccagggtcggggttacccgtttgattggcattaccggccgtacgtacagtaggcttaaaggaaacaaaatgaaaaacaggtttttcaggggtagtaaagcgcacaaaaaaacccgacagtgcacaggaggacccctgggcccacagcgtacgtacatgattcatgggaaaattacctaaggggacaatttatgaaggcgcttcaatcgggggagttaataggggtattgcttctaataggggccgttggcggcccccaatttggtggcgctgccgtttttgccgtcaacaacaacctcggtcatgggcacctggtcggccttgcgcttgcgggcctcc

SEQ ID NO: 72238 - DNA, 378 bp, Triticum aestivum
  Clone ID: PAT_TA_72238
ccaccaaaaccataaaccttttttgggatttttggcgggggtaccataattgatggcccaacccccccccttacttgaaacaccgggggcaaagaacaaaacccttaaaaccaacccctttacaaaaatggggggggatgccccccctccccaaaaaataaaccccccccgaaagtttctccccggataaggaaaaggaagggggaccccccaaaaaatcccaaacccggggggggggggccttgccaaagaactacttaacaaatagtgggggccccccccccagtcccggtttattccccttcaacaaagcctttgaaaaaaagggataaaatgtaagggtcctgccccttggggaaaccccccttccccaaaaaa

SEQ ID NO: 72239 - DNA, 366 bp, Triticum aestivum
  Clone ID: PAT_TA_72239
cgcaaggcccccgaaaaagttttatttacccaaacatccccggggggttggttggctcggggccatttttttacctaaaaaaaaagcctttttttttttattacgggggcaaaacaaacgacttttacttgggcccacgggtacttactacttactacttactacgggggcggccgggccccccctccattttaagtctaacccattaaaagcttaaaagggcccccgtcccggggtaattcctccagcccgggccccgaaaacccgacaaaaacaatcagcgcagggcaaagggggtcggggaaccccgtcgggccggccggggggggctttaaaaaagggggccgtcctggaggggggggtttt

SEQ ID NO: 72240 - DNA, 636 bp, Triticum aestivum
  Clone ID: PAT_TA_72240
cggacttaataattgcataggtaatatgcatagggtcattaggaaatagtaataacatgagtttgtcgggattacaattgaagcaaggatgtaactaaattttatgtaaaaaggtagtagtgtacctcgtaggtctcttctatgtcgttcatgttgctaacttgtgcagcattattcttgtgattgcatgcaccttgacaatgtcatttttccctcgcatgtcctaaatgcacaataatctcttttttgggggtttcatcttctgaaagttcaatgctcattttacccaaagagtacctattttttttctcaatgacattatttgcgggttggcaaaagggaggtgtagtattgtttgcatcctctggtgtatgggtcatcgcactctcgatattcttcaaaaatggatgggtcatcatttctttgcatggatatggctttgtaaaaggtaacacttgtgcattgtcaaccgaaaagcttttctttatgacataacttacggggaacctggatactgaatcaatcttcattctctctggcaagcgccaaacaatctcatttggtgtcatatagcgacattctggatgattttctatttcattgactgtttcacttgatgaaccggatgatccatca

SEQ ID NO: 72241 - DNA, 414 bp, Triticum aestivum
  Clone ID: PAT_TA_72241
gggataaaaaaaacaaactgttgatggaagggtgatttatgcctacaaacatacatatattttttggcttggaacatctgaccctgaataccttcacattttatccctacccatattaaccggcaatgggtggtggggggccattgccttggacctttttgcccaacccggcaaacccctttttggaaaccatggaaaaaaaattccttccaagctcaaacccaaccatgaaacactgggctgcacccatttgcatttggatttgcatcaattggtggtggtgggaagacaccattggggtgccccccatcatttcgtgggggggggtggtcaccatggggaacaccaaactggcccttatttccaaacccactttggggggatgcaaatgggaccaaaaaactttaaaaaaaa

SEQ ID NO: 72242 - DNA, 409 bp, Triticum aestivum
  Clone ID: PAT_TA_72242
aaaaaaaaaatgggtttgttttttattcccatgtttgaactaatatatttggggtttttacatgaaagggcatggcacttttttttttccccggttcaaccaccaaaccttgggctaaaaaaacgggggttcatatttctcctactaaagttctttttttttcaattaatccccaaaatgccaactggaacaagggggcaatttggggggatttaaacattgcccattggggggggcgtttttacccctggggtccttttttcctcaaactggggcaattgttgagggtggacaaaaccctgggcctgggggttttgctgaaaagggtggaaggacccctggcctgatggattttgttgttgaggcttttggaaagaaacctggctcaacgggtgttgttgttgttgtt

SEQ ID NO: 72243 - DNA, 367 bp, Triticum aestivum
  Clone ID: PAT_TA_72243
gaaaaacaaaccccaagccacttggaaaaacttgggcaaacaccccatacccctgggggggggggttttttatggttggtcccccaacggaaaaagggggcggtttattacattacacacaaacccttggtactaaaaaagggggggtttattacaaacacccccaaacccttggtaaaaaaagggggggccccccgcaaaaataaaatttgagcccggtcattttcaagggggttccttggggaaatccccatgaaccaccaaaaacacttttcaaccatttggggcaaggaaaaaagggaatttgggggtcaaccccgggagggggcccgggtggcttaaaaactttccacccaattttttggga

SEQ ID NO: 72244 - DNA, 432 bp, Triticum aestivum
  Clone ID: PAT_TA_72244
gcccaaaaaacccatttcattattcattggcctttcattatcactggcatttccccatgggggaatgggattaccgggcacactttttattaaaactcacacattggattgaccaatcaactaacccaataataataccgggcggggggaaaaaaccctcactcctgggggttgatcccgcacccgggcgggaaccccaccttttttaaacttaccccaacgggctgggggttttggtgggcccccttgccggaaaaaccttttccctggtggcggtgggggcttttgggaaaaaacacctgtccttggcggtgggcaccaccccccaaggggaccccgggggaaccccccccctggtggtgggggggggttcctcctgggtcactggcatactggcccccttggacctcctggcggtggtccgggttcggg

SEQ ID NO: 72245 - DNA, 517 bp, Triticum aestivum
  Clone ID: PAT_TA_72245
aagggcccctttttgctattctgaactaattcaaacaatgggccaaaacacataaatcacatccatgaccccaaagtttttactccaaaacacttgaacccccaaatgggccaaaacccccataaaattcaaaaaatgattgaagttggttggcccaaaatactacaaacccccttttgtgttccatgacactccaagtcctcctcacatccaatgctagggggggataaatacctgcccctcctgacacattaattgtcttcttggcatttttgaccccatcgtttatttcaaccagcttcgggtccaccatggccacctacaccgagccccattttacgtccccgacctttgttggcaactcatttcaaggcccggggacaactggattcgggaggggcatacctcaaaggaaatggacccccggcaccaggtccggtaccaccgtaatgaccctggaaatggatccctggcataaacatgtccggcaacagcgggaggcccgcaatggaccccc

SEQ ID NO: 72246 - DNA, 320 bp, Triticum aestivum
  Clone ID: PAT_TA_72246
ccccaaacccccaatttatttattataaaacccgaaattcccaaacccacaccattatacacccaacattcaaaaccctttcaaaattttaaccccgaaaaatacttgttaaacccctcttagaaaaatattttccaaaaaaaatttaaaaaccccccccggcggaaaacacaaaaaagggggaaaacttttccaatttctccccccgggggccccggggggaaaaaaacccccccccggttaaaaacccggcccctttttgtttaataaaaatcaacccttggccccccccccgaaaaaaaaacctcttcttaaacccc

SEQ ID NO: 72247 - DNA, 460 bp, Triticum aestivum
  Clone ID: PAT_TA_72247
aaacaaaacctgggtttgtcttttattcccaagtttgaactaatatagttcgggttcttacatgatagtgcatgtcacattattttttcaccggtacaacaaccaaaccatggactgaaaaaacggggtttcatatatttaatactaaagttattttcttctcagttaatacccaaaatgccaaatggccccatggggcaatatggggggatgtaaacattgcacattgcagggaccgtctgtacccctaggttccttatttcctcaaactggggcaattgttgaggctggacaaaaccctgggcctgggggttttgctgaaatggccggaaggacccctggcctaatggattttgttgcaaaggctgttggaaagaaacctggctcaaagggtgttggtgttgtttttgttgttgatgcaaaataatagcctgaacaacattggggatgggctggcact

SEQ ID NO: 72248 - DNA, 431 bp, Triticum aestivum
  Clone ID: PAT_TA_72248
acaaaaccacaaattttgttagcttttattcccaagcttgaactaaccctgggcgggggcatacctgatggggcccaccactttttttttcattgttacaacgattggggcctcaactaaacaaccatgatcctttttccttttaacataatgcttggatttttcattggccaccaatgtgcgcaactattctggcaaatggtgccttggtgggggagccctcagggggaacaaaaaccttgcacatggttggaaaaattcccaatcccaatgacctgatcacctccaattgaactggttgttgagggtggattaaccccttacccttgatgaactggaaaaagggccccatgaactggatgccctggtgttggtggtggtcttgccgcatgaagatggaatgccccacaccctggatgggtgcccactgg

SEQ ID NO: 72249 - DNA, 462 bp, Triticum aestivum
  Clone ID: PAT_TA_72249
gggggggaaccaaaatttaatttacaacccctccaaagggggcccaaaccctttccccggaaaaaaaaaacttggaaacaaaacggggaaaccggcggggggggaaaatttttccccccccgggccaactttttcccaaaattttttttttttttaaattaaccccagtttttctcccccaacccaaaaggggaccccctttgggccctggttcctttaaaggggggggcaaaaaaaaccccctgggtgcccaaaaaaaccccccttctggggggccaaaacaatactttcctttaaaattgggggggggggcttaaggttttttttccccccgaacaaacaaatttgggggccaaaaatcccgggtttctcaacccccaaggggggggggttccccggaaaaaaaaaaatccgggatttccccttttttttttttttcttttcaaccctgggggttttttt

SEQ ID NO: 72250 - DNA, 404 bp, Triticum aestivum
  Clone ID: PAT_TA_72250
aaaaaaaaaccgggggtgggctttttttcccaagtttgaactaatatagtcggggttcttacatgaaagggcctggaaaatttttttttccccggtaaaaccaccaaacccggggctgaaaaaacggggtttcatttttttaatcccaaagttttttttttttcatttaccccccaaaatcccaaaggggcccagggggcaataggggggggtgtaaactttgcccattggggggaccctctggacccctagggtccttttttccccaaacgggggcaattgggggggggggaaaaaccccggggcctgggggttttgctaaaaaggccggaaggacccccgccccaagggattttgtcccaaaggctgttgaaaggaaacccgccccgagggggggggggggg

SEQ ID NO: 72251 - DNA, 559 bp, Triticum aestivum
  Clone ID: PAT_TA_72251
gggacaacgaaaatgatacacgggaacattccgatgatccgacaactcattgagatgtcggggcaaaaaaaaaagccgcgggagcatgtcatgcaaggatgggggggtgatccaagatatcgggttcccacgggtcgacgatggggccaagcgaggaaaacaactaacgttcgcgggaggatacaacatccaaacatgcatctcatacaacacatgcattcgtctcggggttataccttccaaacgtgcaaacgggacgggtctggttcggtgcaaagtaaaggaagtaaacgttctcgggacgttcgtagtggaagtaatcgttctcgtttcgtaattgtacacactccgtaggtgttcggagtcacaacgtgaaacttaacatccacggggtcttccagggtcggcggtagtggtactcggttgtttcaaacaggtacttggggtcttcgaactttccgatctcgtcgactcgaaggggtacttggcatttctgctacctagggcggcgacgacatagttgttctatgcatcgggcatcaaagtacttgtcgttttt

SEQ ID NO: 72252 - DNA, 393 bp, Triticum aestivum
  Clone ID: PAT_TA_72252
ccttaaaccatttcccgagaaaaaaccaaaaaaacccccccaacatcccctgttttggggttggacggcctcaatttacatgaacccaaaaaaatggccaaagcttggaaaaactaaaacttttcacccctgaatttttttatcaactttaaggaaaggacccccttaaatttaaacctaaactttgagaaaaaaccatttttggctcaacccaaatttccgggggggaaatcctttttttgctccaaatcggaactcctaaaaacccccttttttctttaaccttgaagcaaccggggtccacccccaaaaaaaactccccgggggaaagggatttaatttggccctgaacaacctggggcctccttttgtcccggggggggggttttttgc

SEQ ID NO: 72253 - DNA, 505 bp, Triticum aestivum
  Clone ID: PAT_TA_72253
ggcggaccacacatttaaaaagcacacacaaacatacaagtttaggggataatactaagggaagcctaaactctcattgctcaacagaaaaaccgccaagcacaagcacgtagcgaaaacaagaaacgacagaatccgacttcagataatactaggggtaagctcaaattccctggattaggtattcaaaagcatcttgttttaacctggattaaagccgacagaacccgatattaaaggcttggcaagattgaggcgcggtacattgttttaaccttttaggtaccgtataaacactcccgaacataaagatccgatgtgacaaaccaatgacaactaacaaccacaacaaccctttcttcacccgttaaaccgtttcggcacattagcacatcaaaccagagtcatcctaacattttaactccatcagttccaccggcaatggttgtgcctagtggatagaaactcgtgaaagtatagcaccaatctgtgtagcgggttccat

SEQ ID NO: 72254 - DNA, 516 bp, Triticum aestivum
  Clone ID: PAT_TA_72254
ggggacaaaacatgtgtttgtcttttattcccatgtttgaactaatatagttcgggttcttacatgatactgcatgtcactttattttttcaccgctacaacgaccaaaccatggactaaaaaaacggggtatcatatgtctactactaaagttcttctcttctcagttagtaccgaaaaagccaactggagcaatggtgcaatatggagggatatagacattgcacattgcaggtagcgtctctaacgctaggttccttatttcctcaaactggggcagttgttgaggctggacaaaaccctgggcctgtgggttttgctgaaatggctggaaggaaccctggcctgatggatattgttgttgaggctgttggaaggagacctggctcaacgggtggtgttgttgttgttgttgttgttggtggtgttgatgcaaaataatagcatgaacaacattgtggatggcttggcaccgcgactgctcggggatctgccacagctgctgacaacacaatt

SEQ ID NO: 72255 - DNA, 314 bp, Triticum aestivum
  Clone ID: PAT_TA_72255
aacagggggaaccctgcccttacaaaaaaaaaaagggtcataaaaatccccctcatcccccccaaaaatatttcaatttacttgggggccacaacataaaacattacaccacacaaaccaacaaaaaccccccccatttgaaaccccggccctaaaccctgccggaaaaacaagtccattatttccccccgggcttgcgggggatcccggatacaaaattgcttcactcaaaaccccagggccccccttggtccacaacccccagggtttccttgccccccggggggatcccattgccccaattctttttgggg

SEQ ID NO: 72256 - DNA, 376 bp, Triticum aestivum
  Clone ID: PAT_TA_72256
gaaatcaaatttggtcacttttattatttcgacatgattaacaactactaatccacttggctaaatgcttacaagctaaccaaacctttttgcaactgcatcgacgatgggctgcacaaaggacgggcactggaactcgtcgggggggggtgggccggggttgcgggcggaacaattccgggggacctttcccaaggcgctggggcccaccctcatttggcccatcttgcccatggacaccccgaactggtcgaaaaaatcccgctggcttcgtgcaaaacgctcaacaatgggccgggggatgtccttggggaaaagggcctggtcggaaaccaaaaacccctcccgggtcaccaagtcgacataatactgggtg

SEQ ID NO: 72257 - DNA, 333 bp, Triticum aestivum
  Clone ID: PAT_TA_72257
aaaaaaaaccgggggttggctttttttcccaagtttgaactaattttgttggggtttttacatgagagggcctggcacatttttttttgcccggtacaacgaccaaaccggggactaaaaaaacgggggttcatttttttagtaccaaagtttttttcttctcaattagcccccaaaatgccaaatgggcccagggggcaatttgggggggtgtaaaccttgcccattgcagggaccctctggacccctaggttccttatttcctcaaactgggggaattgttgggggtggacaaaaccctgggcctgggggttttcctaaaaaggccggaag

SEQ ID NO: 72258 - DNA, 445 bp, Triticum aestivum
  Clone ID: PAT_TA_72258
cattccactataataattaatataaggggcagcattcctatccacacacatttatcaatcatcatcatcatacaaaaaaaaacacaaaaacaaaggccactaaggcccaaccctaacctacataacattggccaatccatgctaacacacacccagttaaaacacaacccataaattttggccaccgaaaaaaaatcacatcacatcacatgggcaaatggccgttgttgttgaaggcccccccgttgtaggccttgtcctccgttttcctccttttgaccacaagggcccaggggatcacctccagcgccacggaaaccccccccaaaatggcaatggcaataatgtcccccgttttccatttttgccccacttccagaatgctcatgcccttaaaaatgttgacaatccccaaaataataatggtgtaccccaccaagggggg

SEQ ID NO: 72259 - DNA, 446 bp, Triticum aestivum
  Clone ID: PAT_TA_72259
cacaccacaattaatgcccccttgttggccccaaaacacccccataacacccacccccccaacccaggcaggggacagcccacccaaagggccccctgggaacaaccaaagcacatcaggggtcaaattattccaacctaaacggggcctacgggggcccataattaccgacacagggggggggggtggggtctccaaccagggggggggcttacgggttcattttgggcccccacccgggaatcaggttctcctgggccgcctgggttttgacaaacaactcggggttgaaaaaaccctcggggtaggcatggaccctggtcagggtttaagggaccttccaccccttaaagggctccagggcaaccgggagggggtaaagcttcggacccaggctgaaatcgacgggggaaatgtcccccccgttgatgtagggcccaggggcc

SEQ ID NO: 72260 - DNA, 437 bp, Triticum aestivum
  Clone ID: PAT_TA_72260
aatcggaaagcacagggcatttgtacatacccaaaacaagcaacaatcggggacaaaaactactaacattgggcatgaaaaatatacggaaccaagtttactagtccccccccccccgcacatggacccgattttcgtcattattattatcaacctaaacacagcacaccccccccaccgtttttttttgaaaaaaacacatttccttcaaatcgcacttttaatttggttgaggggaaaaaaaactttggggccaacaacgaggatctcctcggggggggggctgccccccccaatcttggagcggggaaacacctcaaagtttttcccaaacaggccggccaacttaaggagcgtttccttgtacccggccttgtccgtccaggggttgatcgggtcaaggatctcaaacgggaccccctcgaggggggggggga

SEQ ID NO: 72261 - DNA, 393 bp, Triticum aestivum
  Clone ID: PAT_TA_72261
aaaaaaaaaaaaattcccaaaaaaacaaacggaaaaatttttttaacctttcccacctttacaccattaaaaaaacttttatcccgggggccataaggaaacaaattttttaataaggcggcccggctttccaaaggggcaaaaaacaaattcccaatttcccccggggggctttggttttcccccctttcaaaaaaaacctaaccccttggcccctgggttaaaaccgggtttaaaaaaaattaacttaaaaaaacccaacttttaaacggaccccttccttaactttttttttaaaaacccaaccttattccaaattcccccggcccccttttaaagggaaaaaaccctttctttgccgggaaccaccccaaaaaaaaatccccccggggg

SEQ ID NO: 72262 - DNA, 409 bp, Triticum aestivum
  Clone ID: PAT_TA_72262
aaaaaaaaccccgggtttgttttttttccccaagttgaaacaaatttatttcgggtttttacctaaaagggcctttcaaatttttttttcccccctccaacccccaaacctgggccggaaaaaacggggttttatttttctttcccaaaagttttttttttttcatttcaccccaaaaaccccaaagggcccagggggccaattggggggggtgaaaaccttcccctttccggggaccctttgtacccccgggtcctttttttccccaaacgggggcattttttgggggggaaaaaaccccggggcctgggggttttcccaaaagggcccaaaggacccccgccccaagggatttttttccaaaggcttttaaaaaaaaaccccccccaaggggggggggggccttttt

SEQ ID NO: 72263 - DNA, 273 bp, Triticum aestivum
  Clone ID: PAT_TA_72263
gcccttcaaaattggcttttttttttcaaaacgggggggataccccatttttacattttttacaaccttaattaacccccaaatgggaaaaaaaaacaaaccccttctgccttcctttttcaaaaaaatttacccaaacaatttttttttgggcaacttgctggggccctttccggaaatttttggggttttcatcccatcccattataaaaggccttaccaatgatccccccccaaggctgtttttgcccatcctgggttttttttctttgg

SEQ ID NO: 72264 - DNA, 435 bp, Triticum aestivum
  Clone ID: PAT_TA_72264
agcccaaagtttatttcaacataaatattcataacatgttgggccctccaaataatgatatacccaaactcacatggaaacacaatccaaataacatacatgaaaattaaacatttaaccctccatatagttttcaaagcaaacactcgttgctcaaccacttcaggggggctcttattctacgtaataaacatggaattgttccctagggacttgttatttgttcccaagttatatggatggacgggtgaaatctccgcataaagtgcagttacatccagcaaaacacagttggatttccaaccacacttaacaacaccgtttttgcagtgacccaacttagtgaacccatcttggcatgcgaaggggcattccttgcgggtacatgcttcctctatcggaccaatgacaaatgacttgcaaccattccaccct

SEQ ID NO: 72265 - DNA, 177 bp, Triticum aestivum
  Clone ID: PAT_TA_72265
gacatgcaacacaaactttttaacccccgttttgttctttttttaatccgaaaaaactttcatcttgcattattattgggccttaccctaaatacccaaaaaaccgggaacaccccttacgtttattggaaaaataaagggcatgcctccccaaaccccatgcaaactggaaaaaat

SEQ ID NO: 72266 - DNA, 535 bp, Triticum aestivum
  Clone ID: PAT_TA_72266
aaaaatcataaaacgtataatgataaaaaggaccaattttggataatgttattcgctgcgcctctgtcatccaaaaatcattcttggggcagggggcatataccaacaatcaaatggcatatgtccagcttcaaatttcttaaaaccaaaataataaacgaaacaattcactcggttacaggtagcaacaaaatccctttacttaacgacacaggatggctaaaaaccgctcaaacttttgattttgggtaaaaaacaaactccaagcgggaccatgacctgatgatggagttcatgatgtcaaacggcttcactgggatcttattcttcttaaaattaattttcgtccattcattcatcgaccattcgttcttcaggacaaaataaaccttgagctcctggactttaggaatcagtgcagtgagcttgtattgcacctcctcatacagcaactcaggtacaggaacacctgtatgagtaaacacgaggcatgctggaaaacagcgtgatgacttcagggcataacctttgcgtt

SEQ ID NO: 72267 - DNA, 436 bp, Triticum aestivum
  Clone ID: PAT_TA_72267
aaacgggggccaaaaccgccccaaaaacccctaaaaattttaaaaaaaaaaaaaaaaaccccatttttacctcccaaaaaaaaaaaaccccaatcaacccaaacggaaaatggggccccggcccaaaaaaaccccccctttccctttcgtttgacccttccatcccccacccaaagtgggaaagggaacatttttggaacccccccccccccccccgtgggggggaaaaaaaaggaaaaccttccccaaggttttgctttgggaataaaaaaaaccctggggccacaaaaaaaacccggaaagggcccccccccccccaacaaaaggggttttggggggccaaaccaacccacccttgggggggccccctttcgggcggcccaaaaccttagagggggattttacccccccccttccccccggttaaaaaatgaaa

SEQ ID NO: 72268 - DNA, 448 bp, Triticum aestivum
  Clone ID: PAT_TA_72268
acctacatataattcacaggatatataatcaaaggtttgcaacctataacaactaaaaaaaaacaaaaacaaagctgctaaattcaatctccgcaaaaagcgaaaactttgttcaaaaacccttttatctacttcagtttcttatatatatattataccctgaataaacatccttcctttggcgaccactgttatatggtccaaacattctaaacaaattggaatttttttgttgatgattaattaccacggcgtttggaacaaccgctgttaaccaccgccgcctccttaactcgcccttttgtttttttaaaccccgcttggggcctgaggcggtcgtgctcctgcccacaaacttgaggacctcgtcgatgaacaccacggggagggccaccaccagcaccaggagccattcattcaggctgagcggcacaatgccaaacacttg

SEQ ID NO: 72269 - DNA, 368 bp, Triticum aestivum
  Clone ID: PAT_TA_72269
attcccaaatttaaaccaatatatttggggttcttacaaaaaaagccatgccacatttttttttcccccctccaacaaccaaaccatggactgaaaaaacggggtttcatatttctaaccccaaaattttttctttcccaattaaccccaaaaaacccaaatggccccaggggccaatttggagggatttaaaccttccccattgcagggaccctctgaacccccaggtcccttattcccccaaaccggggcaatttttaaggctgaacaaacccctggcccaaggggttttcctaaaaaaccccaaaagacccccgccccaatggatttttttccaaaaccttttaaaaaaaaaccccccccaaagg

SEQ ID NO: 72270 - DNA, 182 bp, Triticum aestivum
  Clone ID: PAT_TA_72270
atacgtgtttttttcttttattgcaaactttcaactattctacaaacggttcttacattaaaaaacatgccacattatcttttcaccgctacaaccaccaaaccatgcactcataaaacggggtttcatatatctaacactacacctattttattctcacttaaaaccgaacatcccaaatg

SEQ ID NO: 72271 - DNA, 318 bp, Triticum aestivum
  Clone ID: PAT_TA_72271
ggaaaaaaaaaaaggggttggctttttttcccctgtttgaaacaatttaattcggggtcttgccttaaaaggcctttcactttttttttttcccccttcaaaaacccaaccctgggctaaaaaaacggggggttattttttcccccccaaaagttttttttttttaatttatccccaaaaagcccactttggccaaggggccatttgggggggtttaaaactttgccattggggggggcggcttttacccccgggtcctttttttcccaaaccgggggaattttttaggggggaaaaaaccccgggcccggggggttt

SEQ ID NO: 72272 - DNA, 284 bp, Triticum aestivum
  Clone ID: PAT_TA_72272
ccccatactatataacaccactttttttttttttttaacccaaaaaacttttcatttttcatcattaccgggctttacattaattacataaaaaaatttaacaccccccccatttattttataactaaagggcattccttcctaaacaccaaaccaactccaaaaaattttatcacttggtggccaaaaattccttccccccctttaacccgcacatttcccgcaactttgccccaaacctctttcccttttccaactttaaggttgcccccttgggccccccc

SEQ ID NO: 72273 - DNA, 284 bp, Triticum aestivum
  Clone ID: PAT_TA_72273
cccaaaacccccccaagggatggcctttttttattccttttaaaaaggcaaaaaagggtttttttgccccacacaacataaaagggcctggaaataaaaaaggtttcattacatgggggccgggacccccccacccatcccaccaggggggttttaaacctccccacccttgccaccaggggggccttaaacctccccaccaccaatccccccggggccttaaaccggcaggtgggggtccttttaaaaggggaatggctttatttttggctgacctgcttgaa

SEQ ID NO: 72274 - DNA, 380 bp, Triticum aestivum
  Clone ID: PAT_TA_72274
gttttgaaaaaataattttgggctccctggccattttatatggggaaaattaccgggggaggaactccacacccacaggccaaccccctggtctgggcttggataccggtacaatcctctggatcttctccaatcttgcagctcattacacacgggggccaacactcaaaaactgggggtaccttccgggaaagtaaatcaccttgggattacagggtaccaactattttttttgcttttaaaaaaatctagggcccattaatcaacttaacaattttccaaaaaattgcaccattttgaatggaataccggcgcctttgctcctgttttttttattacactatgggctaacacttttttaaaaatttcccccatttttt

SEQ ID NO: 72275 - DNA, 265 bp, Triticum aestivum
  Clone ID: PAT_TA_72275
ggttttttttgggaaaagacctcatgataaccgaatcttgaataaattccaattacataatttctaaaaattcattccttggaaagaaaggctggtttttctcttacaacttttgtttttcaatatctttttaaattaacccaaactgtaaatgcccatcccaaccttttcaaaattattaccattagcgggtgtcaacaatgggaaaaactacatttttcaatggtccctgggaatgatccttccaaccaaaaaaaatcaccaa

SEQ ID NO: 72276 - DNA, 255 bp, Triticum aestivum
  Clone ID: PAT_TA_72276
ccccaaattccttcaaaaaaaacctaatttttccattttccccccttcaaattccccctgacaactcttaattaccccctaaggttttaaaatccaacccccccaaggttttgaccccaaaacccgtgggggaagttccttttaactcaacctaaaatttccccttttacccctaagctcccaaaacctttttttttttaaaatttcccacttaacccaaactttcctttcccaccaaaaaaaaattcttaaccc

SEQ ID NO: 72277 - DNA, 426 bp, Triticum aestivum
  Clone ID: PAT_TA_72277
gttttttggactgaacgatttattttatcttcacaaaccacaaccaaaaaaaaattctttattaacaactccattacaaaaatactaattgatgccgaaaacaaaagggaactcatgttcaactaacattaaccaagccttgtctggggacaccatccacatttattcttcccataaacaaaacagggacaccttttaccaaaggaaatcaaaaccctctactgaatcttggccatgtgggggatcaaatccacaacccgggtgctgtaaccccacttgttgtcgtaccaccaaaccaactttaccaaatgggccttcaaaacaattccaaccttggcattaaaaatgctccacctgctgtcacccacaaaatcaatggaaaccaaatttttctcgacataacccatgatccccttgagttttccc

SEQ ID NO: 72278 - DNA, 437 bp, Triticum aestivum
  Clone ID: PAT_TA_72278
gttaaccaaaacagggatttttgcccccccaaattcactttttatcccttgtttcatttttccccccatttcccaattaaacccgggaaaaaaaaaaggaaaaacaagccccccctttttttccacctaaatgacaggatttttacagcccttcacttccttcccaccaaaatgccggggcaaaaaaaccttccaaactccttttacaaatttgggggagggccccctaactgcctacctttaccccgggaccattgaaaataatttttgcaaaaagggggtcaactgaaggcccaaaacccctcacagggccaacccccacctgaatgtaaaaaaagggtttttcccccctttttattcctgcctgacttgccttgggccgagggtttccttttggagggggggggggctttttttttcaaaatcaacgggccccc

SEQ ID NO: 72279 - DNA, 315 bp, Triticum aestivum
  Clone ID: PAT_TA_72279
aacacaacccctaactttttaccttttttttttttttaaaaaaaaagcaacccgcacaaaaaaacataaatccttattaatctatataaaaaatttttttttttcccccttaaataaaaaaaacggttttttcctcacaccgaaaccctaaaaaaggataaatcccccatcccccaaaaacctttttccttttttaaagaaacggcaaatttttccattgaaaacggcccaatttccttcccaaaaaccccttgtttcctccccttaacccccaattccaaaaacccctccccccaatttttggctggccccttc

SEQ ID NO: 72280 - DNA, 449 bp, Triticum aestivum
  Clone ID: PAT_TA_72280
agggggaatctaataacttgcatttcacaacaaatcaatctcaggggcccaggagtttaccccacccaggaataaaaatacagtaattaaaccacaaacaaatcattgctcgctcgggataaaaatctgaaccaacaaaaccaatgaccgggaacaaaaacattctgctaaataacacccctatttcttcttgatggcaaccttggtaaccttggcgccgggggggtcctttttctccacccccttgatgacaccaacagcaaccgtttgtctcatgtcacccacaacgaaacggccaaaaagagggtaggtggcaaaggtctccacaaccatgggcttggtgggaatcattttgacaataccaacgtcaccgttcttcaagaacttgggcagcgcctccagctccttaccaaatcgcctgtcaatcttggtcaccaactcaacaaact

SEQ ID NO: 72281 - DNA, 370 bp, Triticum aestivum
  Clone ID: PAT_TA_72281
aaaaacaaagtttggggtcccaccaaaaaaaatttctttgaaaaattgttggacaccacttcaacccaaaaaattttaataaacaacaaacatttattgtaataaaaatctgaccacacaaaaaaatgtacctcctcccaggtcattgaaaggaaccactggatcaaatgctaacatttttttttttatttaaaaaaaaacttacaaggggttggttttccatttttaacccctccccaaataaattaaggattttccgttcggtccaaaatccattattttccggcaaaattaccaaccaaaactaaaattggccaaccaatacccctgcctaattgatcattacctaaataaatgtccccgttttaaa

SEQ ID NO: 72282 - DNA, 349 bp, Triticum aestivum
  Clone ID: PAT_TA_72282
ggcccctaactccatggaactcttttttttcaaaattttaaaattacatttgggcctcccaaaaaataaaaaaaaattcttgcttggccatcaaaatacaaaccttttaaatcatggcattttggttttctatgcctttcccaaatacaaacatttcctcatcaattttgctcaccaatgggctgtttgcttgccctaaggcccaagggggtgggctggcctccttttttccctgggccttggaaaccccaaaaaccaaaaacccatgggcgtaacacaatgggtttaacccaaatgcccttaccaaacaaaataattgtgtggacccctctcaaggggaaaacaaaat

SEQ ID NO: 72283 - DNA, 383 bp, Triticum aestivum
  Clone ID: PAT_TA_72283
aactggaaaaacttttcattttgcattattattgggttttactctaattacataaaaacctgtccccccccctcatgtttattggatacctaaggggcatccataccaacccccatccaagttgcaaaaagttctatcactggctaacccacaatgcgtcccccccctccatccaacacattatcggcaactgtgtcccgggttgctgcacctttgccacctttgggctggccctttgctgctctgtgttaacatgggatgggttggcctacccttggtgctcttggcctaattgctgcccttgtcctaattgggggccttgccctgattggtgcccttggcctgactggtgcccttgtcctgactggtgcaaaaaaattggg

SEQ ID NO: 72284 - DNA, 358 bp, Triticum aestivum
  Clone ID: PAT_TA_72284
aaaaaaactgaataccccccaatttttccatcccccaatttttacaaaaaacattttccccaaaataaaaacaaacattttgcccaaaacatttgccccaaaatgggacccctgggcccctaaatcctaatcaccactttcccccccactggcattttttggggattgatttttcccatccccaaaaaaaccccatttttccccggggaatcccccttaatcctaacccccaggtccaactggtaaaacatcctggaaaatatccaataatgccctcccccccattcttttttcaaaaaactaaaacctgttctcccaaatttaattcatttgccgggggggggaattaatcatttcc

SEQ ID NO: 72285 - DNA, 417 bp, Triticum aestivum
  Clone ID: PAT_TA_72285
ggaaaaaaaaacaaggttttttttttttttccaaattttaaacaatataattcggggttttaaattaaaatgcctgttaaattttttttttacccgttcaaacaccaaaccatgggctggaaaaaacggggtttatttttttaatactaaaagtttttttttttcaattaatacccaaaaatcccaaaggggccaaggggcaaatttggggggtttaaaaatttcccatttcaaggaacctttttaacccttaggtccttattttcccaaaatgggggaattttttagggtggaaaaaacccttggcccttgggtttttcttaaaagggccgaaagaacccctgcctaaacgattttttttcaaaaggtttttgaaagaaaaacgggcccaaggggggtggtggtgttttttttggg

SEQ ID NO: 72286 - DNA, 340 bp, Triticum aestivum
  Clone ID: PAT_TA_72286
gaaaaaaaaacctggtttttttttttttccccaatttgaacctttttatttcggggtctttccttaaaaggcctttcacattttttttttccccctcccacccccaaaccctggggtgaaaaaaacggggttcattttttttagcccaaaatttttttttttcccatttacccccaaaaaccccaatgggcccaaggggccaattgggggggggtaaacctttcccctttccgggaccctttttaggggtagggtccttttttcccccaaccgggggcattttttaggggggaaaaaaccccgggcccgggggttttttttaaaaggcccgaaagaaccc

SEQ ID NO: 72287 - DNA, 307 bp, Triticum aestivum
  Clone ID: PAT_TA_72287
gacaaataatgccggcaaacaaaaactttttttggcttttattcccaaacttgaactaaccctggcccgggtcacacattaaggggcccccccctttttttggcatccttacatccattggggcctcaactaaaccaccaagaaccctctaccctttaatataacccttcaatttttcattggcccccaatgcccccaaattttctggcaaatggggcccccattatggaacccccaggggggacatacccctttcccatgggtggaaaaattttccacccccatgatctgatcccccccaatttaa

SEQ ID NO: 72288 - DNA, 317 bp, Triticum aestivum
  Clone ID: PAT_TA_72288
aaaaaaaacttttttttttttttattccaaaatttaactcctattttgcgggtcacacattacctttgtgtgacactttttttgtcaccctttcattcacatttccattcactaaacaacggggatttaacaacttttttttactaaaaatttttttttttcaataccccccaactccaatgccaatgcttaatggcataatatggggcaacctttacaacggcccttttaccccccacatttttggcaaggtaccgagtgcaatggaaatcatcccctcaagttgaaatttttggggtggctgcaaaaatatcccc

SEQ ID NO: 72289 - DNA, 360 bp, Triticum aestivum
  Clone ID: PAT_TA_72289
aaaacaaaacctgggtttgttttttattcccaagtttgaactaatatagttcagggtcttacatgatagggcctgtcactttattttttccccgctacaacaaccaaaccatgggctaaaaaaacgggggttaatattttcactactaaagtttttcttttttcagttattacccaaaatgccaaatggaccaatggggcaatttggggggattttcacattgcacattgcaggtaacgtttggacccctaggttccttattgcctaaaactggggcaattgttgagggtggaaaaaaccctgggcctgggggttttccttaaatggttggaaaaaaccctggcctaatggatattgttg

SEQ ID NO: 72290 - DNA, 381 bp, Triticum aestivum
  Clone ID: PAT_TA_72290
ggaacaccacccaatccaattctgggtacacaatatattttccaatggttgaaagaaaaataatccattcattccattattaaaatttttcaaaaaaataagaggaaccaaaccctaataacaggaatgggttgggtaaatacaatactttgaacatgttataaaaaagaagtccgggaaaaagtaatatatgcggcttcacatcaaatattttttttgttgaattgtccaggggctcacaacccaactaaaaaagatttcctgaattggggcttggaccaacaaagggggtatggggaaggaagtccacaacgctgccatgaaatacctgaacacccaggaaacctacagcaaaacgaaccactgccgggttgaaaaggg

SEQ ID NO: 72291 - DNA, 331 bp, Triticum aestivum
  Clone ID: PAT_TA_72291
aaccaaaaaaacttttcattttgcattattacggggctttactttaattacataaaaaactgggaacccccctcacatttattgtttacctaaagggcatgcctgcctaaaccccatgccaactgcaaaaaattttttcactgggtggccaaaaatgcctcccccccctccacccggcacattgccggcaattttcccccaaacttctgcccctttgccacctttaggctggccccctggggccccaccctaacatgggatgacctggaatacccttgttgcccttgtcctgattgctccccttggcctgtctgttgaaaaaaaattgggt

SEQ ID NO: 72292 - DNA, 333 bp, Triticum aestivum
  Clone ID: PAT_TA_72292
ggaaacaaaaaatggggttggctttttttcccctggttgaaccaatataattcggggttttacctgaaaccgggtggccctttttttttttccccctcccaccccccaaccctgggcttaaaaaacggggggttatttgttcccccccaaaagtttttttttttcaatttacccccaaaaaaccccccggggccagggggccatttgggggggttttaaccttgccccttggggggggcggcttttacccctggggccttttttccccaaaccgggggcatttttggggggggacaaaaccccgggcccggggggttttccgaaaagggggga

SEQ ID NO: 72293 - DNA, 416 bp, Triticum aestivum
  Clone ID: PAT_TA_72293
aaaaaaaaacctgggtttgtttttttttcccaagtttaaactaatttatttggggtttttacatgaaagggcctgtcacatttttttttccccgttacaacaaccaaaccttgggctgaaaaaacggggtttcatttttttaatcctaaagttttttttttttcaatttatccccaaaatcccaaatggcccgatggggcaatttgggggggtttaaactttgccctttgcaggtaccctttggagggctaggttccttttttcctcaaactggggcattttttgagggtgaaaaaaaccctgggcctgggggtttttttaaaatggccgaaaggacccctgccctaatggatttttttccaaaggtttttgaaaagaaacccgccccaaggggggggggtgttgtttttgggggg

SEQ ID NO: 72294 - DNA, 393 bp, Triticum aestivum
  Clone ID: PAT_TA_72294
ggcccaaaaaaccattttatttttcattggttttttattatgaacggcatttccccatggaggaatgggggtacaaaacacacttattattaaaactcaaacaatacattcaccaattaactaacccaataatactgggcgggggggaaaaacccacactcctgggggtccaacccggaccccggcgggaaccccaccttttttaaacttaacccaaccggctgggggttttttttcccccccttaccggaaaaacctttttccttgtggccctgggggcttttttaaaaaaaaaactgttctttgcgcttggcaccaccccccaaggggaccccgggggaaccccctccctggtggtgggcccctcctggtttaatggcataatgaacccct

SEQ ID NO: 72295 - DNA, 484 bp, Triticum aestivum
  Clone ID: PAT_TA_72295
caaacaaaaccctgaatggcacctcctactgttaaaaacttcacaatctttaatttgaaaccccaacctgttttttttgttcaatcaaatccccccacaaaagggggacggattcccaataaactgcacctcatcaaaaaaccttccaccctcttgattcccaatccaatatttttcccaaactttttggctataacattgtaacccacagtttatttatccccgggggtttatttcctgtccccctaaattttaacaaaacactttttgcccctttaataaactgcttaagggatccccatttttttataaaaataaaaaaaaatttttacacaggggcaacaaccccctattccccaacattagtgtaatctttaactggcaggccggtgttcttataaaagggaaatggctccatttttggctgccctgctttaaggatcatttaaatgggcttttttggctttaatctttccaaaggccc

SEQ ID NO: 72296 - DNA, 419 bp, Triticum aestivum
  Clone ID: PAT_TA_72296
ggggaaaaaaccccaaaaaacatacttttactttttaaagaaggggccgaaaataaaaaccctcccttgggttattgggggctttttaccttaaaaacctaaaaccccccccttttgggggggccctaaaaaaaaaggccccccaaaacaatggcctccccctctttttttaaaaaaaaaaaaaacggtttccctggggaaaccccccttattcccattttatttccaaaaccattattttaaaaccaaaaggcccctttccacaaacgggggggaaaccggcccccaatttaaattttccgaacaacccccggggattccccttgggaagaaacccccggggttttcctttttcaagaaacccccaaatttggggccgggaaaccaaaccttttctccttcaaaaaaaagggcccccc

SEQ ID NO: 72297 - DNA, 422 bp, Triticum aestivum
  Clone ID: PAT_TA_72297
aagaaacatttgttaattattttaatgttgcaattaatactaggcacacataaaaatccatgccttttttattttcccactgctttattgatcaactaacaggtcccatcggtatacctacctgccatggtaatgctatagggggggggggggggggctggccattgaacagggatttaaattttccacatcaacgggagggggtaaagtaacatcctcaggccctaaagttgtactttttgttggggttgggaatgttgttgttccctaataaactctaccacattatggatggcttggcaccgaaatttttttggaatttgggctacctgccggcacatttgggcctgcaccctttggcatttggggggcttatgcaccggtgtttgcggaaatggaactgacattggcctacattgatg

SEQ ID NO: 72298 - DNA, 347 bp, Triticum aestivum
  Clone ID: PAT_TA_72298
aaaaaaatcccccggccccaaacccaccctcacggggatggccctttgctgaaggcccggaaacaaacctccctgctgcatttaaaaatcctgccttaaaaaggactttttgctcccccccaaccttttttttaaggggggtttgcccccaaataaagccccaaactaaagtaaccattaacccttcatcccctcatacaattctcccaatctaaaggttttttttggcaacaaaagccttttgtttggccctccaggtccaggcaacaacccgagcaaactcggaattcaaactcaaaggggcttgaaaaaaaggccccccggcccggcaaaaaatggcccaaaaa

SEQ ID NO: 72299 - DNA, 347 bp, Triticum aestivum
  Clone ID: PAT_TA_72299
ggaaaaaaaaaaaggggttggctttttttcccctggttgaaccaatattattcggggttttacatgaaagggcctggccctttttttttttccccgttcaaccaccaaaccctgggcttaaaaaacgggggttcattttttttcccccaaaggtttttttttttcaatttatccccaaaaagcccactggggccatggggccatttgggggggtttaaaccttggccattggggggggcggctttaacccctgggtccttttttccccaaaccgggggcattgttgaggggggacaaaaccccgggcccggggggttttctgaaaaggggggaaaggaccccggccc

SEQ ID NO: 72300 - DNA, 399 bp, Triticum aestivum
  Clone ID: PAT_TA_72300
gggtttttttccccaatttgaaacaaaataatttggggttttacatgaaaaggcctgggacaatttttttttacccgttcaaacaccaaaacctggggtggaaaaaagggggttcatattttttataccaaaagtttttttttttcaatttatacccaaaaagcccaaaggggccaagggggcaaatgggggggggtaaaaatttgccatttgagggggcggctggaaccccaggggcctttttttccccaaacgggggaatttttgaggggggaaaaaaccccggggccggggggttttcttaaaagggccgaaaggaccccggcccaaacgatttttttgcaaaagggggtggaaagaaaaacggccccaaggggggtggtggtgttttttttgggg

SEQ ID NO: 72301 - DNA, 357 bp, Triticum aestivum
  Clone ID: PAT_TA_72301
aaaattttctttttaatctttttttccaaagaaaaaaaaaaaatttcccagggggaaacaaaattttccaaaaaaaatttccccccaaaaaaattttaatcccctttccctgaatttaataaccccttttggcccttttaacaaacccggctttccaaacctttgcttttaaacctaaaaagggaaaagccccaaatttcaaacttttttaaaaacaaccaaccccccctttttccccaaaaaaattaccggaaaaaccctttgccaaaaaaaacccttttggttttttaaacaagtttttccaccctttaaaaaaaccttaaattggggcccccccaaaaaatttttgggcggccc

SEQ ID NO: 72302 - DNA, 400 bp, Triticum aestivum
  Clone ID: PAT_TA_72302
caaaaacaaaccacaggggcctgtaataaaattcccccttttaatttttaaacaaccccccaaaaacaaattttgttgttaaaaaccccccaaaccaaccaaaacttatttcttttacaaaaaagggcaaaaaaccttacccaaacctttacaaacttttttaaaaagaaaccttaaccgggattacctggcctaacccttgaaaatccccttttcctcccttttttaagttgaacaatttttggggttggggtttctaggggatacctttccccaaaatcgggggcccctccgggggggggcttttattaaattttgacggacaaaaaaaggtttgggccaaattaaaacaaaaccaaaaacccgggggccccatttaacaccttgagggcaaacccct

SEQ ID NO: 72303 - DNA, 300 bp, Triticum aestivum
  Clone ID: PAT_TA_72303
gaaaaggaacttattggtttttaattcccttgttgggactattccaggtgggggttccccatgagggggcccataattttttttataatcgtaccattttcctcctttgactaccaccaataattcccccgtttagttttacattttttattttattaggccacggatccttttaacgtccttcccaaatggttgttgtgggggattttgtgggtttggggaaggtttttggaattgctggggggggtttggttttgaaaatggttgttgggggaattgttgggggggttcctggggaaa

SEQ ID NO: 72304 - DNA, 307 bp, Triticum aestivum
  Clone ID: PAT_TA_72304
gtgggcacaacataaattatcttatcaattaaacattcatgaacattataccggctgcctcgatcaaaaaaacctaaccgggttcttttcggatccaatcacttgtaacataaaggaggcccctcaaattatgggaacatcttaaattatttaacggggaacaaacaaacataggaaaacactaaatcaacaccacaatcttaaatgcaacttaaatcccctgtaacatactgcaagggttactggtgcgggacctaatattaccccatgtcggcggcgggcattcccgccgcggggtggggcatcc

SEQ ID NO: 72305 - DNA, 456 bp, Triticum aestivum
  Clone ID: PAT_TA_72305
ctctcaaaaaaggaaaatcaatcaaacaagtgaatttgtcttttccaatcacttggattctcccatctgaatttattgcctgctcccctgaaccaaaaagtccccaggcaatttccaactgcttcaatcggccccccaaacccccaaggacccttcactttccctgctccggccccctgcaaacttcacaggggactgaaaaaagtaaggaaaaaaatcccaattttggggctgatggcttggcaacctacctaggctttgctccggaaggacccataccccctggcccttgcccggaggatcctctgggggtaaacccctgcaatcccccccccaataaacggccccccccaaaaaacccactgatccctccaggctttgtccccgttgtttataacgggggccccaaaactcctcgccgggttgatccccgtcccggtgatcgggatgggggcc

SEQ ID NO: 72306 - DNA, 419 bp, Triticum aestivum
  Clone ID: PAT_TA_72306
gaacaaaatttttttaacccgggccactttacccttacccagcatccaaaaaataaatttgggcttgcccccccccacaaaaagcccctcaaaaaccaaaacttgggcaggcgggtaaaaccaaaaccaaaacctgggcacccggggaaacctttttccggccccaaagggaccccaaaaaccctgcccccggggggccccgggggggggatgggaaacaaaccccttgggcctggacctttggaccaccccctggcgggccttgggcatttccatggccccccggttgaccaccgggcgcattaccttattttgggcatccggctggcggttatcccccagggggggcgcctcgtcttgccccgcctgggggaccaagccccgggtcccggaaggcttcctgaatgaaattgggggcc

SEQ ID NO: 72307 - DNA, 390 bp, Triticum aestivum
  Clone ID: PAT_TA_72307
gaccaaaaaacaacccccccaattttacaaataccctttcaaaacaaaaaccccaatttttaaaaaatttttcaaaaacctaacattttaaatttactgaccccaacatttgaaaattcactggccacccttccttaaacaaaacaaaaattctggccacccccaaaaattttacctactgggccattaacactttaccctttttaacccatttgcaaaatacaagaaaattggatcaaccaccccctcctttttataccccaaaaccacccccccattattattccttcttttcccaacaaaaaaacgaaaggcccttaaccttgtaaaaaaaaactttttgggaaaatcaaaatttttttttaaaaaatttaagggatcccctttaaa

SEQ ID NO: 72308 - DNA, 568 bp, Triticum aestivum
  Clone ID: PAT_TA_72308
ggttaaacaaaacatgtgtttgtcttttattcccatgtttgaactaatatagttcgggttcttacatgatactgcatgtcactttattttttcaccgctacaacgaccaaaccatggactaaaaaaacggggtatcatatgtctactactaaagttcttctcttctcagttagtaccgaaaaagccaactggagcaatggtgcaatatggagggatataaacattgcacattgcaggtagcgtctctagcgctaggttccttatttcctcaaactggggcagttgttgaggctggacaaaaccctgggcctgtgggttttgctgaaatggctggaaggagccctggcctgatggatattgttgttgaggctgttggaaggaaacctggctcaacggttgttgttgttgttgttgttgttgttgttgttgttgttgatgcaaaataatagcatgaacaacattgtggatggcttggcaccgcgactgctcggggatctgccacagctgctgacaacacaattgttgcaccagctggtaagtactttgttgcaaaacttgtgaacttcca

SEQ ID NO: 72309 - DNA, 492 bp, Triticum aestivum
  Clone ID: PAT_TA_72309
gaatctggatagctttaaatcacaacccaaacaggcaaaacattctcagttcaacctaggactcgaaccgtttacaaaaaatggggttcaatatgtctgcaaacatgacatggacccaacatttaaaaaaatccaacgagtaacatgcagcagcttttcaacctaagctggggcacccttgcccttttttttctggagcttcctcatgtaaaactccaactccttgcccttcaggatgtacccatcaactttgccacactgtccagggggaaacaaaatgcaggccaacagccttccaccactgaactggtccttaatgggcgaatccagtgtacgtccctgctggcgcttctcaaacttcctctggacattggtgctcttctttgcttcctctgggggagcaacaacaaccttaaccttttgcccctcaacaggttcctttttggcaactgcaacaactttctttttcctaccgatttccactccataatg

SEQ ID NO: 72310 - DNA, 383 bp, Triticum aestivum
  Clone ID: PAT_TA_72310
aaaccaaacccgggtttggcttttattcccaagtttgaactaattttgttggggttcttacttgataggggattggaacattattttttcaccggtacaaccaccaaaccttgggctgaaaaaacggggtttcatttttctagtactaaagtttttttcttctcagttaatatcgaaaatgccaaagggggtgatggtgcaatttggggggatgtaaacattgcacattgcagggatcgtctgtaacgcttggttccttttttcctcaaactggggcatttgttgagggtggacaaaaccctgggcctgggggttttgctgaaatggccggaaggacccctggcctaatggatattgttgcaaaggctgttggaaggaaacct

SEQ ID NO: 72311 - DNA, 308 bp, Triticum aestivum
  Clone ID: PAT_TA_72311
aatttggcattattatggggttttactttagttacataaaaacctgggcacacccgtaatgtttatgggatagctaaggggcatgcataccaacccccatgcaagtggcaaaaagttttatcactggctacccaacaatgcgtcccccccctccatccaacacattatcggcagttgggtcgggggttgctgcacctttgccaccttggggcgggccgtttgctgctctgggtaaacagggtaggggttgccgaacccttgttgctctggcccggatggctgcccttgccctaatgggggtcctggcc

SEQ ID NO: 72312 - DNA, 308 bp, Triticum aestivum
  Clone ID: PAT_TA_72312
gatttttgttacaagaaacacttatttgatattttacaccgttcttccaccaattattttgcgggtttttactggaagggggtgattattttttttttccggcgctccaacccccaaccggggggaaaaaaaaggggggtttttttttgctaccaagaaagttttttttttttcgccctctccccaaaaaacccttctgactgctggggctaagggggggggttaaaaaactcccgtctttgggggtggcctccacgcccgggggtcttttttttctaaactggggcctgttggtgggggggaaaaaa

SEQ ID NO: 72313 - DNA, 326 bp, Triticum aestivum
  Clone ID: PAT_TA_72313
atcccaaagggggaacaaatataggggggggtttaacaggaaggggcggggaaaatttttttttcccgggtaaaaggcccaacccgggggctaaaaaaaggggggttaattttttaaggccaaaggttttttttttttaaattagccccaaaaagcccaaggggggcgggggggcaattgggggggggggaaacttggcaaatgggggggagggttggaacccctgggtcccttatttcctaaaacgggggcagtggtgggggggggaaaaaccccggggccggggggttttgctaaaagggccggaaggaccccgggccaaaggg

SEQ ID NO: 72314 - DNA, 337 bp, Triticum aestivum
  Clone ID: PAT_TA_72314
aagcaaaaaaaaacttagtttgccttttttttcccaaggttgaactagggccgggttattccacacaggaaaaggccgggcactttttttttcaccgctccagggggcggaccattgactaaacaagggggggccgtttttgggatactaaacctttcaatacccgcccctgccgggggggacctcaatggggggggatttggggggggaacaatatgggggaacatgcccctcccacattgggggaaggggatgaatcacccatgttcctttgaccgcaatccaaccctgatccaattgggtttgttggtggggctggctaaaaccctgaccttgg

SEQ ID NO: 72315 - DNA, 426 bp, Triticum aestivum
  Clone ID: PAT_TA_72315
gctaacaaaaaaaaaatttgtttggcttttattcccaaacttgaactaacactgggggggggcatacatgaaggggcccacccctttattttttattgttacaaccattggggccttaacttaacaaccaagatccctttacctattaacataatggttgcatttttcattggcccccaatggggggaactattctggcaaaaggggccctggggggggaaccctcagggggaacaaataccttggacatggggggaaaaattcccaataccaatgacctggtcacctccaattgaaccggttgttgagggtggatgaagcccctaccctggatgaaccggaaaaagggccccatgaactggatgccctggtggtggtgggggtcttgccgcctgaagaagggatgccccacaccctgggtgggtg

SEQ ID NO: 72316 - DNA, 426 bp, Triticum aestivum
  Clone ID: PAT_TA_72316
gggcaaaaaccccaatccataacaaaaaaaaaccggggaaaatcccatttcacaaaatccccttacaacatggtcacaagaaatttttttggttttaccaacccaaaggggaaaaaaacccaggggacttaacatcaaggggcaaaaaaacaccttcaaactggaccaatttaaatggggccccccaaaatctggccccggggggggattatgaaaaaaacggggcccccctttaaacccggggggggaaccctggggggcaactcgccccccttttggcaaaaggccccagggggggaaaaataggggggaactagggggcaggggaaccccagggggccacccctttccttgtccttaaaaagggccccggaacacccacattggctaaggaaaaccccaaaactccccccaaaaatggttttt

SEQ ID NO: 72317 - DNA, 428 bp, Triticum aestivum
  Clone ID: PAT_TA_72317
gggaatacaggggacacctttttttaaaacccacacattggatttaccaaacaacttacccaataataataccggggggggggaaaaaaacctcactcctgggggtccaacccggaccccggggggaaccccaccttttttaaacccaccccaacgggctgggggttttggtgggccccccccccggaaaaaccctttccctggtggcggtgggggcctttgggaaaaaaaaaccggtctttgcggtgggccccaccccccaaggggacccccgggggaccccccccccggggggggggggggggttctcccgggttaatggcaaaatggcccccttggaccctctggcggtggtcccggttcgggggatcccccgaaaaatcccggttttggtgaacctccccccaaaaacccgggggccctttttc

SEQ ID NO: 72318 - DNA, 232 bp, Triticum aestivum
  Clone ID: PAT_TA_72318
aacccgaaaaaacttttcattttgcattattattgggttttactctaattacataaaaacctgggcccccccctcatgtttattggatacctaaggggcatccctaccaagccccatgcaagttgcaaaaagttctattactggctaacccaaaatgcttcacccccctccatccaacacattatcggccactgggtcccgggttgctgcacctttcccacctttgggctgg

SEQ ID NO: 72319 - DNA, 469 bp, Triticum aestivum
  Clone ID: PAT_TA_72319
aaggaatataaaaccctgccttatttttttggacaaatcataacaaacaggtttattattatctcggatcatacaacctttattaaacttgtaacatttgcccacacatgctttgcttgcccaaaaccaaaccgacctgaaaattaaacagttttgggggtcatccccccaccacgggggaaccctttgccgccttcgcaaacccaatttttatgttgccataatcaaaaacgggttgggaggctcccatgaatttttcccccagaatccaaaaagggccacggggacaaggaatgtccatggccggaaatcccctgatgcactgggtaacatccccctcaccgatcttaaggatatattgctctggggtcaacacaaactgtttgcccccgatggaaaaagcgatgtcaggcttggatgcaattctgccgcaatccacaaatgattctcccatagggctaggaatacg

SEQ ID NO: 72320 - DNA, 519 bp, Triticum aestivum
  Clone ID: PAT_TA_72320
ggaaaaaacgggccaagtaaaaaacccaaaccctttacaagcaatctcataggggcccctaaaaccccccgggccaagggtcccaaagggccaaacccccaatagggggggtaaaaaaaaaaagccccgggggggtcccaaaacctacaaattcaaatcttccaacaagttaaataaccccccaacccccttagggggccaagggggggggggtttaccctcaaagggccggaccaagggttaaaaggggcaaaaaaccccttttttaggacccaaccccccggggggcaccgggccaaaggaaaattgaagggtcccacctttgaaaaaaccccgtccctggggggggaaaaaaaaacacccattccccattttgggaaaggtccccccccgccgggggtttccccattttaaaaaacccccacaaggggccaagggtctgaaaaattccaggggaaatttacaatcttggccctaagaccggggggggaaaaaaaaaccccccccggggaatgggga

SEQ ID NO: 72321 - DNA, 421 bp, Triticum aestivum
  Clone ID: PAT_TA_72321
ggaacgaaatcatgttattggatcccatgccacctttaaaaaccacacttttaatacaggggtacatttcgaataaatcgaccaccccacccgtaaaattcaaaaaaattcaaaacttgcatgaccaccaaatttggaaaacaaaacaaacccccagccgaagtacatttgccacagggtgatgcaacaacgccggggaacaaaaaaaccaccatctcaaaaccagcgggggacgggtggcatgcctggatctacttggggaaccccatggggaatgccttggcgtaaatgtaggggggcttgatgggggggaaaccggcgcccttggccaggggctcaaactcccttttgtacctttccctgcccccgggggtgtgccccaacatgatcatgtcgacgtggaacaccccctgcgccttgg

SEQ ID NO: 72322 - DNA, 380 bp, Triticum aestivum
  Clone ID: PAT_TA_72322
ccccacccctaaaattaatttaaaaaaaattgtttacctttccatctttccaaatcaattgtaacaaaatagggatcccccctttgtgggggtccctcattgccccttttccccaaaaaaataaatattccccctttttttggcccgggttttgggggggggaaaaaatttttcccccccccacccaacccaaaaaaaatttgggaaaaaacccccccttttttggaaaaattgattttttccatggccccccaggcctggggggcaaaaggaaacccctgggttaatttccccccttgggggaggaaaaatccaaaattttgctgccccatttcaaaaaattttccccaggggaatgaccacccccccttttggggggg

SEQ ID NO: 72323 - DNA, 276 bp, Triticum aestivum
  Clone ID: PAT_TA_72323
aaacggaaaacctttttatcttgcattattattgggctttactctatttacacaaaaagctggaaacacacgtcacgtttattgtataactaaggggcatgcatgcccaaccaccatgcaagctgcaaaaagttctatcactgcctggtcaaaaatgcgtccctgccctccaacccgcacattgcccgaagctgtgcccaaagctgctgcccctttgccacctttaggggggccgcctggtactccgccctaacatggtatgggctggcgtaccct

SEQ ID NO: 72324 - DNA, 429 bp, Triticum aestivum
  Clone ID: PAT_TA_72324
aaaaaaaaccggggtttggttttttttcccaagtttgaactaatatagttggggtttttacatgaaagggcatggcaaatttttttttcaccggtccaacgaccaaaccaggggctaaaaaaacgggggttcatttttttagtactaaagttttttttttttcaattaatcccgaaaatgccaaaggggccgagggggcaatttgggggggtgtaaacattgcacattgcagggagcgtttggacccctggggtccttatttcctcaaacgggggcaattgttgggggtggacaaaaccctgggcctgggggttttgctgaaatggccggaagggcccccggcctaagggattttgttgctgaggctgttggaaggaaacccggcccgaaagtggggggggggggttttggggggggggccaaataata

SEQ ID NO: 72325 - DNA, 506 bp, Triticum aestivum
  Clone ID: PAT_TA_72325
gggggcccaaaacccatgggtttgaaaatttcataaaaaccccaacacaaattttggctcaatttttgacccccagggcggggggccacccaggaaaaaaaatttacccccccccgggaaaataccccccaaacaaaaattttacaacccccccccttcccctgttttttcacccccccccaaaaccaaacaacaatgcgggggaaggaaacaatgacagtaaggtttttttttcccggaccccccaaaaaaatcacctcccaaaaaaaaaaaaaaaccccgcccgatgaaaccccctactggggcgtcagtttccaaacccggatgcccccctccttcccggggggaaccagggggtctttttcgggaaaagaaaacccggggacccccccgaggggcccccccttgatgggggggcggctggcccctggcttttttacctcaaaaaagaacccccaggggtccaaccaccccggggccaaaaaacgggtgtggggggacccccc

SEQ ID NO: 72326 - DNA, 359 bp, Triticum aestivum
  Clone ID: PAT_TA_72326
gaaaaatattaaaaaaaataggcccaacctgaaaggggtgaatttgtcaaccacaaatttgatggaccttttccaacccaacaattggactttaatcatttcgaaaatccggctttaataatattattggttttaaaactgctcccattatgcctgggccctgctcaagggttgggccccactgcgcaaaaattgggtttgctccattttaacttcacccccatgcttggtgacctccaactggtccccgccccttggttgaactttttcaaccccacatttgcctggttcggcgttggacctatgcctcaacaattaactgtttttcccaaactgatggggggtgaagaccaaatgga

SEQ ID NO: 72327 - DNA, 213 bp, Triticum aestivum
  Clone ID: PAT_TA_72327
gtgcggttaaattcatccaatatttattgaatcgtgaacggttgcaaacgttgccacaatcaaaaacccacccatcctgatgccttttttggcttccccttgaaaaggatgcctgaggcgggatgtccccccaaactccaggggacaactggggaaaacatggggtatgcaaagagatatgatgaaaccacgggacaggaggagggtggggtg

SEQ ID NO: 72328 - DNA, 380 bp, Triticum aestivum
  Clone ID: PAT_TA_72328
aaacaacaaatgtttttgtcttttattcccatgtttgaactaatatacttcgggttcttacatgatagggcatgccactttattttttcaccggtacaacgaccaaaccatggactaaaaaaacggggtatcatatatctactactaaagttcttttattctcatttaatacccaaaatgccaactggaccaatggtgcaatttggagggatataaaccttgcacattggaggtaccgtctctaaccctaggttccttatttcctcaaactggggcaattgttgaggctggacaaaaccctgggcctgtgggttttgctgaaatggctggaaggacccctggcctgatggatattgttgttgaaactgttggaaacaaac

SEQ ID NO: 72329 - DNA, 342 bp, Triticum aestivum
  Clone ID: PAT_TA_72329
gtgttacagttaaaaaaaggtccacatttaccatggtatgaaacccaacacacaacttgcatcccctatatggaaaatattcttgccactccctaaaacatttcttttaggaaacaaacaaaaaccacatgattttagtcatgctcaatagcctctttttcatgataaccttacatttgggaacatggtaccaattccccattgctaaaataaaccaaggatttaaccaaaaaatgaccaaaacaaattctgtaaatactcttggcacaatctccaatgtcacttggattaatctcatgaattaccctgatggtcatttttgtaaccattggagcccaactt

SEQ ID NO: 72330 - DNA, 421 bp, Triticum aestivum
  Clone ID: PAT_TA_72330
aaaaaaaaaattcccccaaaaaaaatactttgaccaaaacttccccctccgacccccaaaccaaaatcccaaaaccaaaaaaacttttttttcccaaccggcaggaatctttttataaacctttgggcttcccttgggcccccaaaaaccaccccccttgttgggacaaaaaaactcccccaaataaaaaaacttttcccccttcttttgaataaaaagaaaaaaccgccccctttttcccttggaaaggccatttctaaaaaaacttaacgggttccccaacctttttccccgccccctttgccccccccttttccactgcctttttcacccccccgggggaaccccccaaaaacccttttcacaacccgaatgggccttcccccatttccccccccctttttgtttaaaggggccttcc

SEQ ID NO: 72331 - DNA, 389 bp, Triticum aestivum
  Clone ID: PAT_TA_72331
ggcaaaacacaacccctccatttattaacccttacaaaaaaaatgaaccccccttttttcaaaagttttaacccccaaaagaaacataatttatcaattttttttatcaccatccggcaggaccatcctaatttcgtcgatgggatcaccattggcaccaacaaaatcggccctacacattgtttttttcctccatgcccgggctttaaaaccccttcaagaagggataacccttttaccccctgcaaaattaaacttcaaatttcccctaatccttgtaaaacgggtttccctccaccccaacccctggaaccaactgatgaagaggccccaacccaactttttgtctcccctactccaaccaaaaaatgtggccccatcccgggaat

SEQ ID NO: 72332 - DNA, 445 bp, Triticum aestivum
  Clone ID: PAT_TA_72332
ggggacaatacatgtgtttggcttttattcccaagtttgaactactataattccggttcttacatgatagtgcatgtcactttattttttcactgctacaacgaccaaatcatggactaaaaaaacggggtttcatatatgtagtactaaaattcttctcttctcatttggtaccaaaaatgccaaatggcgcaatggtggtccaccaatgtggaaggatgtagacattgcacattgcacgttgcgtgtgtagcgctaagttccttatttcctataactggggcaattgttgaggttggacggagccctgaacttgtgggtttagctaaaatggctggaaggagacctggcttgatggatattgctgctgaggctgttggaaggagacctggcttgacggttgttggtggtggtggtggtgttggtggtggaggcgcaacaattg

SEQ ID NO: 72333 - DNA, 471 bp, Triticum aestivum
  Clone ID: PAT_TA_72333
aaaatgggtgggggggggcaaatttttatccccccccccaaaccgaccccccaaccctgcgggttttcccacttttttttccgggcgggttgaattaaccccatttaacaagggtccacccccaaaaccaaacctgaaccggaaacccccccccaaatatttatcccccccccacgggtcccggtgatccggcccctcctaaattgggaaaggaacccccaccttgctttttcaaaccaaaaaatttgggccccccaatccaaacctttgaaaaccacctggcccctgggtgtttgaagtgtcccaaaaacccaaccccctcactttaggggggggcttcaacaacccccctcaatgcccttctacaaccccttcactggatcccgcccccattgaatggggacaaggcccactttttttccccctccaaaaaacccatgttgctgcccctgggggtttctccccttgccc

SEQ ID NO: 72334 - DNA, 322 bp, Triticum aestivum
  Clone ID: PAT_TA_72334
ggggaaacaaaacctgggtttggcttttattcccaagtttgaactaatatagttcgggttcttacatgatagtgcatgtcacattattttttcaccggtacaacgaccattccatggactaaaaaaacggggtttcatatatctagtactaaagttattttcttctcatttaataccgaagatgccaaatggcgcgatggtgcaatatggagggatgtagacattgcacattgcaggtagggtctgtaacgctagggtccttatttcctcaaactggggcacttgttgaggctggacacaaccctgggcccgtgacttttgc

SEQ ID NO: 72335 - DNA, 597 bp, Triticum aestivum
  Clone ID: PAT_TA_72335
ggaagtttccagctacaatctaaaatgaactcacaactaaaacctcacggggtcaaggatgcatccgcaacactgaactctagtcacatcagggggccacatgccatagaacgtccccctaagtgcaagatgttatcaggttttcaagcagccaaactttaagcctacatacatgtttctacccccaggccgcagccaaaacggttaaaaggccaaccaaatcagggcacccaagcactattacagcaaggcagtaaactgcagactcaaccaaaaggccaagccagggagggaggagaagtcgccacagctagaatccgacgccatggatttcgtctgccccatcccttccttccatcaactactacagcgaagctactccatggtctgcatcgccaacggctgccgcccgagatgaatccatggttctagtaccaggggtgaccttaagttcttgagcagtaatatatccctcaacactccaccaggtaccccccaccatcaaatgccaaacctgtagtttccacatcattcgtcgatgtcctggacccaatgcaaaccttttaacaccgactccactgttgtgtttggaatgac

SEQ ID NO: 72336 - DNA, 411 bp, Triticum aestivum
  Clone ID: PAT_TA_72336
ccaaaaaaaaacccgaaatttattaaaaatttcccccccccccatttttttaacctccaaaaaaaatttttttcccaattcttttcctttaaacccccccaatttttcaaaacccccttcctccaaaaaaaagggccccccccagggaccccctttcgggggggacaaaaaacccctgggggaaaagggtttcccttcaaaaaattcccatccctccaacccttttaattgttcccaaatttcccccttgggttaccccaacctgtataaccccccccccttggataaccaaaaaaatccctagtgggaaggcccccccccaaaccccctttaattgcttaaaggggccccccccgggaccaaaacccgaatgggccaaaaaaaaccccattcccacccccacaattggtt

SEQ ID NO: 72337 - DNA, 492 bp, Triticum aestivum
  Clone ID: PAT_TA_72337
aaaggggaaaaccttttcactttgcattattagggggctttcccctattcccccaaaaaggggggaaccccccccccgttttttggaaaacaagggggccggcccccccaacccccctgcaaccggaaaaaagttttttcccggccggggcaaaaaggggtcgctcccccccacccggcaaattgccgggagttggccccaaagctgctgcccctttcccccctttgggggggcccccggggccccccccccaacagggggggggggggggaacccttgggccccttgcccggggggggccccttgcccgggggcccaaaaaaaaaggggggaaccccccggggccccttgcccagatgggcccccctgccccgccggggggaaaaaaatgggatagccccctgggggcccttgcccggggggaacccattgcccgggggggggccaaagcccgggggggggcccttggcccgacggggggggaaaaagggg

SEQ ID NO: 72338 - DNA, 479 bp, Triticum aestivum
  Clone ID: PAT_TA_72338
aaaaaacccaaaccaatttttttataaaaaaggggggggtgaacaaaccggaatttaagttccaacaaccactcagttccaattccaagggggtttttaataaaaataaaaaaataaaaaacaaagtcctaccacccccttgagctttgggggaaaaaaacacacaaattgggataaaacttgtttaacccaaaaaaaatttggaggcctatggttgggtttttaaaacccccaaaacccctaaatcccaagtttcgggggggggcaaccacccacagttgtttatttgccaccaccaatttccttaaaagggaaaatttgtttttcacccgggggggacataaaaaaaaggatcagggccttgccataaaaaaatccaattttgatttggccaaacaaaacattattagggggaaccttcagggcatccttaggggggccactctcaattaaaagggggacatatccatcatcagttt

SEQ ID NO: 72339 - DNA, 388 bp, Triticum aestivum
  Clone ID: PAT_TA_72339
gggaaaaaaaaacttgggtgggtttttaatcccaaacttgaaataaccccgggcgggggcccccaaaagggggccccccccttttttttgcatcggtccactgaggggggcctcaaccaaacaacaaagaaccccctccccattaaaaaaagggtttaattttttattggcccccaatgcccccaacttttttgggaaaaggggcccccaaaaagggacccccaggggggaaaaaacccttgcccaggggggggaaaattttgaaccccaaaaatttaaacccccccaattggcccgggtggtggggggggaaaaacccccggccctggccttaaaaaacctgcccccccccttggtgcttaaaaaaggggaaaaaaaaacccccccc

SEQ ID NO: 72340 - DNA, 463 bp, Triticum aestivum
  Clone ID: PAT_TA_72340
gcagttaacccaaaaataaagggaatgcccaataccctcaatacaatggtccaaaaaaaacaattaccgggggttccaaagaaaaaatcaactggggcaacaaaaactccatcgcaaaaccaaatttacacctaccaacctaccatcgcaactcgatgggctaattatgttacagggcaaaactgggcaaaaataatcacccccccctgggagcaacccgtttggagatttcccaaaaacaaaaaatgaaccaaatttcctgaaaaaagaataactggcccaaatatgggggtaaacgctactcaatcaactggccggccttgggtcgtttaaacgaccgggattatttgacggggggtttatgtacccccctatgggtttttgcccaaccctcttcttcattctctggaacttggctttgggctggtggttcctccggtccttttcctggtggcggatgggc

SEQ ID NO: 72341 - DNA, 419 bp, Triticum aestivum
  Clone ID: PAT_TA_72341
gaaaaaaaacccctttttttttttttttcccccccaacccccccccaatttggggcccaagggcccccccaaaaaaatttcccgaaaaaaggggggggcccttggaaaatttttaaaccggggaccccttttccccaaaaaggccccccacgtttttcggggggcccttttcccccaaactacccaaagttttttccctggggtaaagggggcccccttccctaatgggtgggaaaagggggcccccccatgggcggggtccaaaaaaaaattccccctttttgcccccccccggggggtttttttcccccaaaaacccccccaattttaacccccttggggggggtttttacggtccctttcccccaaaccctccccggggggcccgcccccttgaaaaaaaccccggggttccttgg

SEQ ID NO: 72342 - DNA, 432 bp, Triticum aestivum
  Clone ID: PAT_TA_72342
ggtaacaaaaaaaaactttggttgggttttattcccaaacttgaactaacactgggggggggcatacatgagggggccccccccttttttttttatcggtacaacgattgggggcttaacttaacaacgatgaaccctttaccttttaacataaggggtggatttttcattgggccccaatggggggaactttgctgggaaaaggggccctggggggggggcccccaggggggacaaataccttggacatgggggggaaaattcccaatacccatggcccggtcacccccaattgaaccgggtgttgagggtggatgaagcccccaccccggatgaaccggaaaaaggggcccatgaactggctgccctggtggtgggggtggtcttggcgcctgaagaaggaatgccccaccccctgggtgggtgccccct

SEQ ID NO: 72343 - DNA, 359 bp, Triticum aestivum
  Clone ID: PAT_TA_72343
aaaaaaaaaaaggggttgggtttttttccccagggtgaaaccaatatagggggggtttttacaggaaccgggggggcccttttttttttccccgctccaccccccaacccgggggctaaaaaaccgggggttcatttggcccccccaaaagtccttcttttcccatttagccccaaaaaaccccccggggccaggggggcaattggggggggtttaaaccttgccctttggggggggcgtctttaccccgggggccctttttccccaaaccgggggcatttgggggggggggacaaaccccggggccggggggttttcctgaaagggggggaagggcccccgccccgagggattttgtt

SEQ ID NO: 72344 - DNA, 402 bp, Triticum aestivum
  Clone ID: PAT_TA_72344
gggaaaaaaaaactttttttggtttttattcccaaacttgaactaacactgggcgggggcacacatgaaggggccccccactttttttggcattggtacatccattgggggcttaacttaacaaccaagaacccttttcccattaatataaccctttaattttttattgggccccaatgcccccgaattttctgggaaaaggggcccccattaagggacccccaggggggacatacaccttgcacatgggtgggaaaatttgccacacccaagatctgatcccccccaaattaaccgggttttgggggtggaaaaaaccccggcctttgaataaaaaaacctgacccacctggtggtggtgaaaaaatgggaaaaaaaaatccctgcccttgtggtggtgtt

SEQ ID NO: 72345 - DNA, 468 bp, Triticum aestivum
  Clone ID: PAT_TA_72345
aaccgggaaaaaccctttttttggggggggaaccccctgttttttaataaccctgggggcccccgggggggccccatttttaccccccaatcccggaccttttttttttaacccccccccaccaaattgaccaaaggggaattgcttttggggggcccccccccaaattactaactttccaaaaccccccacattttctaaatttcggaccccagggaattcattggcattgggccccttttgccctttttttccaaaatcaaccgggtgggggtttccccaagggttttaaaatcccctgaaaacccccaaaggctttattcccccccagttttcatcaggaccctaaaaccctaatcttgccgccaacaagggccgcccttgggggcctttggggcccaaagggaaaggatttcccccccccaattttggttgccaccccccaaatcattttcccttttgggggcc

SEQ ID NO: 72346 - DNA, 439 bp, Triticum aestivum
  Clone ID: PAT_TA_72346
ggctaagggcggcctttgggtaatttaattcttaaaaaacagtcaaaaagggggaatgtaacccccaaaccctttggaaacaaaaaaagggaaaaaaaaaaaaaaaaaaaaaaaaaaaggtttccttttttcaaagttggggaaaaaaaaaaaaaaggggaattccaatgtccaaccccggggggatccttgccaacccgccccctaaaaaaaaaacaaaaaaagtttttatgttggcacctagggggaccataaaccccttaggggggcaacccttgcttgtacaaaaaaggcaacacctgggtcggttttggaacccaaaaatttttttaaaaactttccaattaacctccttttattccccggattttgttgcaaaaaaaacggggccggggggggggggttttcaaccccccacaccatgatccccaggcaatgg

SEQ ID NO: 72347 - DNA, 508 bp, Triticum aestivum
  Clone ID: PAT_TA_72347
aaaaaaaacctgggtttgttttttattcccaagtttgaactaatttagttcgggttcttacatgaaagggcattggcacatttttttttcaccggtacaacaaccaaaccatgggctgaaaaaacggggtttcatatttttagtactaaagtttttttcttctcaattaatatcaaaaatgccaaagggggggatggggcaatatgggggggtgtaaactttgcacattgcagggagcgtttgtacccctagggtccttatttcctcaaactggggcaattgttgagggtggacaaaaccctgggcctgggggttttgctgaaatggccggaaggacccctggcctaatggattttgttccaaaggctgttggaaggaaacccggctcaaagggtggtggtggtgtttttgttggtgacgcaaaataatagcatgaacaactttggggatggcctggcactggaactggtaagggatctgccataggggctgacaacacaatttttgc

SEQ ID NO: 72348 - DNA, 627 bp, Triticum aestivum
  Clone ID: PAT_TA_72348
gtttttttaacacgggaacagcaattatccattaactaaaccaagccattacatcctccctaaaccatggccgggacaaaaaaccatgcgatggggacctccagcttacaaaaaccaacttcaagcatacccatgcttttggaggcttccctggctgggaatgctttaaaatcttcctcaacagtttgatccttcaaacaatttgccattgccatgacaaaaactctcaacattccatcagcttcgacagacaaaacacagcgtgaaagctgtatcgtgccatcagctgcaactggcagtttatcgaaagcaagcaacttgatttccatgtcactgatactggcggtacgggcaaaaattaaacctccaaagccttttggccattccccatcgacaactttgacactgatgggggcctccacaaattcagccatgtcagccaatgtcaattccactgtgctaagcttgctagtttcaacacgtttaaacatgtacgattcacgacagccagaatcacgacaactaacaactagatagctcaaagctctatcctcaaattcagttttgcccttcactcgcaagtcaacctcaaagaacacaggatccacaaccacaacagcacgggta

SEQ ID NO: 72349 - DNA, 257 bp, Triticum aestivum
  Clone ID: PAT_TA_72349
aaccaaaaaaacttttcattttccattattaccgggctttcctctaattccataaaaaactggaaaccccccccacatttattgtataactaaaggccctccctccctaaaccccatcccacctgcaaaaatttttatccctggctggcccaaaatgcctcccccccctccaccccgcacattgcccgcacctgccccccaaccttctgccccttttccccctttaagctggccccctgggcccccaccctaacatg

SEQ ID NO: 72350 - DNA, 496 bp, Triticum aestivum
  Clone ID: PAT_TA_72350
agcttcaactcaccatatcactgaatggtctgaaaccacagcaaattacactggtcacgggaattggcaaaacagctgactcaccatattatttcgagcattcaccactcactacctgaaacaatctggcaacaaattcttttacaaaccgatcaaattaaatgcctttgggctactccccaactttacatgatcagtcaacataaatgcattcgacaccgagcccccgactttgcagttacccccccgcccacaaattctcgtccttttcaccaaaaacgcacatttcccctggtggtggtgggtcacaaaagcaacatgttagtctacatcaaatcagcgtcttaatcttgggcaaactctgccctttggggcaatgcttcaggatgtaacttgggcaattctactctttctaaaaaataataaccaagaagcgcaacaactttcttgcaatataaggggggcccgcaaatttgcattaatttcctcatataaa

SEQ ID NO: 72351 - DNA, 440 bp, Triticum aestivum
  Clone ID: PAT_TA_72351
ggatactttggcatggatgcttaaacctttaatgcaggcaggatgcccctgacaggatgaaaggcaggctcatgtccatttttacaaattataacactaaacctaataaattgcaccctttgcttgacaaaaatgactgggtttgggaagaaaaaatatgggagctattctacacaagggtctgtaaaaatttttttaccgaaaccaaaacttaaaaaaaaaaaattttcccctcgcttgtttgggggaaaacaatctgccggatcaattttgataactctgggattggaaaaaccacaggaaacccatttgtgggacaaccaatgaaactgaaatctccctttttttttacaagcattacaaaaaatggcctgacacctctcgcgggatttctcgggaaactttttaacaaccaacaacccattaagcatgccaaaata

SEQ ID NO: 72352 - DNA, 428 bp, Triticum aestivum
  Clone ID: PAT_TA_72352
ggaaaaaaaacccggggttggttttttttcccaaggttgaaccaatttttttgggggttttacatgaaagggccggggaaattttttttttccccggccaaaaaccaaaccctgggggggaaaaacgggggtttatttttttaaccccaaaggtttttttttttccctttacccccaaaatcccaaaggggcccagggggccatttgggggggggtgaacctttcccctttgggggaccccttgggggggtagggtccttttttccccaaacggggggattttttggggggggaaaaaaccccgggcccgggggtttttcttaaaaggcccgaagggcccccgccccaatggatttttttcccaagggtgttggaaggaaacccccccccaggggggggggcggtgtttttggggggggccccaaaaa

SEQ ID NO: 72353 - DNA, 374 bp, Triticum aestivum
  Clone ID: PAT_TA_72353
atccaaacccaattttttttttggggaccgacaaatccaaaccccaaaaggaaaaactgataaaaaatttcccccctttcccaaagtcccgaacaaaaacaacatccattttgaaatacatgtccttggggggtaatttaaagggcccaaacttaaataaaccccacccattcctttaaggggccttggcggccttggaaaaaaagggggaaccctggcctttaaaaaaaccaatcctccgggaaaaaaaaaaaccaaccttttggccagggggggcatcccgggggacaggggaacccggaccaatttgggggggggtcccccccccggggggatcccccaaagggtttagggccccccccccccccttaggc

SEQ ID NO: 72354 - DNA, 364 bp, Triticum aestivum
  Clone ID: PAT_TA_72354
aaaaaaaccccccccaacccctatttttcaaacctaaaaggccggggtaaaaaaaccccccccccggggggggttttaaaacccccaaaaaacaaaggacccccctttccaaacctatttgggcccaaaacccccctctgactttccccccccccccccttttttttattcccccacccctgaaaagggttcaacaccaaaaccaaaccccgatcccccccaaagcgattcccccgggcaggggaaccccagccccttaaccccttttcccacggatccccctaaccaactaaatgccctggggcataagggccccccccttggcatgggtggcccccaggtgggggtccccaaaaaaaccccc

SEQ ID NO: 72355 - DNA, 384 bp, Triticum aestivum
  Clone ID: PAT_TA_72355
gaccggcattgaaaaaaactggactttgacatcacaaaacgatttttcaacaaccaacaaatagggaaaatctggggtggaactttggaaaaacatggtgactagtacccataatgcccctacccaaaattttagggcatccaactccttgggaactttataccacacaaaccggttggcataccataccggaaaacccaacaattccaactccaaagttttttatggcctaagcaatttatgcaacaccacaactaccgggcttaaaaagcgggattttcgcatttaaaaaaccggtttacccacgaacacgttcgcctttggtggcacctttactttcaattccgcccctttcacgggcaccggctttggcattattttggc

SEQ ID NO: 72356 - DNA, 527 bp, Triticum aestivum
  Clone ID: PAT_TA_72356
atgtaaacaaaacatgtgtttgtcttttattcccatgtttgaactaatatagttcgggttcttacatgatagtgcatgtcactttattttttcaccgctacaacgaccaaaccatggactaaaaaaacggggtatcatatatctactactaaagttcttctcttctcagttagtaccgaaaatgccaactggagcaatggtgcaatatggagggatataaacattgcacattgcaggtagcgtctctagcgctaggttccttatttcctcaaactggggcagttgttgaggctggacaaaaccctgggcctgtgggttttgctgaaatggctggaaggacccctggcctgatggatattgttgttgaggctgttggaaggaaacctggctcaatggttgtttttgttgttgttgttgttgttgttgttgctgttgatgcaaaataatagcatgaacaacattgtggatggcttggcaccgcgactgctcggggatctgccacagctgctgacaacacaattgttgca

SEQ ID NO: 72357 - DNA, 330 bp, Triticum aestivum
  Clone ID: PAT_TA_72357
gccaacaaaaaatggggttggttttttttccccaatttgaaccaaaatttttcggggttttccctgaaagggcctgacccttttttttttccccccccccaaggtcaaaccgggcattaaaaaaacgggggttcctttttttaaaaccaaagttttttttttttcaattaaacccccaaaagcccaatggccccatggggggccacccatttgggggggtttaaacctttcccctttgtgggcccgcccggccccccaaattcctttttttctggaaccgggggcatttttggggggggacaaaaccccgggcccgggggttttggtgaa

SEQ ID NO: 72358 - DNA, 440 bp, Triticum aestivum
  Clone ID: PAT_TA_72358
ccccaaaatttcatttgcattcaaatttaattccatgaaaaacaaggagttggaaaaaactttgaaatacctgcccttaaacgggggggtaccttaaaaaacattttttttcctaaaataaggaaggaccaaaacacaaaccccccttttttatggaaaaaaaaaaaacaaagggcagggagtacccaaactaccaaataaactcaaactaggggaccaattacggacctaacactcgttaactaatcccccacccgttttattgcacggccaaaaccttcccgcaaatttcccccgttgttcaattgaaaaacctccaagtcccgtcccccccctcgccggggcctttgggcaccgtaaaaaaaagctgcccgtaaacttacccggccataaccagttccgggcaaaatttttaaggcagccggtacctccacctataa

SEQ ID NO: 72359 - DNA, 463 bp, Triticum aestivum
  Clone ID: PAT_TA_72359
cccaaatttaaaataattttgttgggggttttaaatgaaagggggtggaaaatttttttttccccggtaaaaaaaccaaaccatgggctgaaaaaaggggggttaatttttttaaaacaaaaatttttttttttttaattaaacccaaaaaatccaaagggggccagggggcaatttgggggggtttaaaaattggccattgggggggcggttgggacccccagggtccttttttccccctacgggggggatttttgagggtgaaaaaaacccggggcctgggggtttttctaaaaaggccgaaaggaaccccggcctaagggaattttttgaaaagggtgttgaaaagaaaaccggcccaaagggggggggtggtgttttttttgggggggcaaaaaaattgcctgaaaaaaattgggggggggctggcactggaaatggtaagggatttcccaaagggggt

SEQ ID NO: 72360 - DNA, 393 bp, Triticum aestivum
  Clone ID: PAT_TA_72360
aaaccaaaaaagcttttaatttggcattattagggggctttactttagttccatgaaaaacggggaaccccccttactttttttggttaactaaagggcctgcttgcctaaaccccatgcgagctgaaaaaagttttttttttggggggccaaaaatgggtcccccccctccacccggaaaattgccgggatttgggcccaaagctggtgcccctttgccacctttaggggggccccctggggctccaccctaacaggggttgaactggaatacccttggggcccttgacctgattggtgcccttgccctgtttggggcaaaaaaaggggggatcccccttgtggcccttggcctggttgcacccattggccaaattggtgcccttgccctgg

SEQ ID NO: 72361 - DNA, 399 bp, Triticum aestivum
  Clone ID: PAT_TA_72361
gaaaaaccccagggtactaataaaagggcaaccttgtttatcacatactaattcaacattggggggacaacatccaaaaaccgtctcacccttttaagaacaacccctaatcatgttaggggctttgaaaaacaccatgttacatattttcccccccccattgccgggcaaatttggagtaaaaaaacttaaccctctcccggggcaagggttcccccccacaaaggggggccccaatcaaccccccttttaggcccccttggggaaacccaccccccacttgccctaatcaaaaacggggggggaggggcccctgaaaacccctcccaagatccaaaaaggaccccggggggggggggtgtccatgggtgggaaaccactggtgccctggggaacaac

SEQ ID NO: 72362 - DNA, 275 bp, Triticum aestivum
  Clone ID: PAT_TA_72362
gaaaaaaacttatttggcttttattcccatgtttggactaatacagggcgggggtacacatgaaggggcccatcactttatttatcatcgttacattatgcccccttgactaacaaccatgattcacccctctagtattacatcttttcatttcataggccacaaattcttataacgtccctcccaaatgggtgttggtggggatattggtgggatggggaaaggtcttgtgattgctggggggggtatgggattggaaattgttgttgggggaa

SEQ ID NO: 72363 - DNA, 423 bp, Triticum aestivum
  Clone ID: PAT_TA_72363
aaaccgggaaaaaattgggtttatttaaaaaaaaaaaagccaaatttttccatacagttccctcttttgacttacaaggggaaaaaatatttttttattaacccccggccttgggggaaaaaaaatatatcccggggggattttaaccccatccggaaatcctttaggggccccactttttaaaaaagttgggggccccccgtttcaaaaatttccagcgggggggtgtaaatctccggttcaaaaggggggaccccccttttctttgggaccttgtttggaaaaaaaaacggggttctttttgttgcgggtcccccaagggggggggccagggggggggccaacctgcctttttgggtttttcaaaacccaaaaaagggggttgggggcttttgggggggccccccgggggggtcccccccc

SEQ ID NO: 72364 - DNA, 448 bp, Triticum aestivum
  Clone ID: PAT_TA_72364
aaacccacaaaaaactgttcctttaaacataaaaaaaaaaaaaacccccaaaccaaaaaagggttcttttgaccttttaaaaaaattttacgggcccttcaactgacataggaagtcaactaacaggggccaaatttcaccaacaatttgggcaaaacccatccaaaactcaggaacttggaccaacttaaaagggcatttcggggggcttggccccctccctgaaaaaaaacccccccccaaaattttttttaggggcagggacccccccaatacctttgatcaacccaacatcgagggcctttggaacatttttttaaaattcgggcaaattttgggggggctccttttaaatctaaaacaaccccccttaaattttttttgccctggtttttttgcccctggcaaaatacttgtaataaaacttttccacgttaaccccaaaaat

SEQ ID NO: 72365 - DNA, 485 bp, Triticum aestivum
  Clone ID: PAT_TA_72365
aaaaaaaaatgctatggactgcttaaagaggactctgccctgcgtcaataacactcaaacctgccccaaaaaccctccgcactgcaacagtgcgttacccgccccgcacctatccactatccaaacctgcaatggttttggtgcagggaaaaacaaaaaatgggactcccacaaaaaccaaaagggggaccaccttgaataagtctgcagctgggcgggtcacctggctcctctcttttttaaaaagtcttttcccgttggctaccttcaacaataatctggacaaaaaatcctaacatttacccacagcagccgcaagccaacccaaaagtgctgcagggttgaaaaaatctcgtctttgactgaaattaaaagtgcaatcacccccaaaaactagtccttcctgagtaacaatattcagtaactaatctgaaattttgaatcagcgcatatcaaactaaatgtttgatcacctgcccacggaa

SEQ ID NO: 72366 - DNA, 384 bp, Triticum aestivum
  Clone ID: PAT_TA_72366
ggaaaaaaaaaaaattgggggggaaaaaaaaaaaaaaaacccttccccccaaacataaaaattttgggggcccttttaatccttccccccacactattttttcccaaggtttggcttccttttccaaaaaacccccgggaaaaaccggcccccccaaaaggggggcgcccgaacccctccctttaagggggggaaaaaaaccaaaaggggaacctttccccccccttttgggaaggcccccttcccaaaaaccaaaaatttttttccccgggggggacggggcgcccccccccggtttccaaaaaaaagggggccccacccccgggggtccgggggaacctttttttaaaaaactgggttgaaggccccccccggttttttaaa

SEQ ID NO: 72367 - DNA, 279 bp, Triticum aestivum
  Clone ID: PAT_TA_72367
ggaaacaaaattaaactttttcctccaatttcatataaaaaaaccttcataaatcattaccccttttttcataacaggacaagtaccccccactaaggatcattaccttgatacaattaacaatccttcaaccccaataaccaaattctttaactttaaactactcaccaactccatggcaacacattatttaaaaaaatactacacttaactttatctaaaatgttccaccataacacaattcttatttattaaacaaaaatttttaccccttcacat

SEQ ID NO: 72368 - DNA, 321 bp, Triticum aestivum
  Clone ID: PAT_TA_72368
aaaaaaaacaaactttttttccttaccaaaacaaactggctaaaccccccacaacaaaattcaatacaaacccagggaaagggcctaaccattttttaaatacccccctccctaaaccattaccattttcaccttttgggggggccgcattattacatgccctaagacatacattcaccttaacataatcaaaacctcccttaaattggaatttaatcccccgaaacaaaaaacctaaaaccgatctatcatacccccgacttggtataacccgcttcaactccatccagtccatttcaaaaattaccccattggctccca

SEQ ID NO: 72369 - DNA, 330 bp, Triticum aestivum
  Clone ID: PAT_TA_72369
ccaaaaaaaaacctttttttttttttttttccaaatttaaaaaaatctaattcgggtttttacattaaaatgcatttcacttttttttttaccccttcaacaaccaaacccttttttaaaaaaaccgggtttcatttttttaaaaaaaggggtcttttttttttaattaatccccattaaccccaatggcccaatggggggccaccaattttgagggatttaaacctttcacatttgtgggaacccctttaaccctaaggtccttatttcctccaaccgccggaatttcttaggtttaacaaaaccccgggcccttgggtttttcttaaa

SEQ ID NO: 72370 - DNA, 380 bp, Triticum aestivum
  Clone ID: PAT_TA_72370
gcaaaaaatttgggctcataacccttccaaatttttttaatcaatcaaaccccaaattggataatggaaaccaggggtaaaattcctcccctgggtgcctccaatgcctgccccatgcttaacctttcaaatgttaccccccaatttccttttatttttttgcccccctcccaaatttttaaaaagccccatttaatccctttcccccacaaaaacctttggcccccaaaaaatacaaaaaaaaggggccaattttaggccgcccccctttgcaattcaactaagccccccttttacaaggtttaaggccccttttttctttgggccttacaaaccccggatttaaagggggaagcccccctttttttttaatgaacccc

SEQ ID NO: 72371 - DNA, 248 bp, Triticum aestivum
  Clone ID: PAT_TA_72371
gggctttttttaacccaaaaaacttttcatttttcattattactgggctttaccctaattacataaaaaactttgaacacaccttacatttattgtataactaaaatgcattccttcctaaaccccattccaaccgcaaaaaattcttttacttgcttgcccacaattccttccccccctccaacccgcacatttcccgcaacttttcccccaacttcttccccttttccacctttaagctggccccc

SEQ ID NO: 72372 - DNA, 469 bp, Triticum aestivum
  Clone ID: PAT_TA_72372
aaaacagaacatgtgtttgtcttttattcccatgtttaaactaatataattcgggttcttacatgatactgcatgtcactttattttttcaccgctacaacgaccaaaccatggactaaaaaaacggggtatcatatgtctactactaaaattcttttcttttcaattaatacccaaaaacccaactggaacaatggtgcaatatggagggatataaacattgcacattgcaggtagcgtctctaaccctaggttccttatttcctcaaactggggcaattgttgaggctggacaaaaccctgggcctgtgggttttgctgaaatggctggaaagaaccctggcctgatggatattgttgttgaggctgttggaaagaaacctggctcaacgggtgttgttgttgttgttgttgttgttgttgttgctgatgcaaaataataccatgaacaacattggggatggcttgg

SEQ ID NO: 72373 - DNA, 437 bp, Triticum aestivum
  Clone ID: PAT_TA_72373
aaaagtttacaaatctttctgcaaccccatttttttgatatacagttgaaaaactgacaaacaacccataatttaatggtctcattctcatcccacaaaaacccccctaaaccttttttgcaccccaaagggaatgaaatgtcatgatatacaggtctttacctggaagggttatcaacccctggatccttcaagggaggactttccaacccacaacaacccaaaatcgttccttttaaataccaaaaagggctccccccccccaattttatccaaaacaaaatccttgcaaaaaccaatcaactcgaggacccccatcgcaactttgtaattccccaccctcctttgaaaatgaagattggttttacccaatcttttataccaaaaatcggtgggattctctatcacattcttgaaaattttaaaaaatgtttgga

SEQ ID NO: 72374 - DNA, 272 bp, Triticum aestivum
  Clone ID: PAT_TA_72374
ggtttttttaaccgaaaaacttttcattttccattattattgggttttactctaattacataaaaaactgggaacccccctcacgtttattggatacctaaggggcatgcatccccaacccccatccaagctgcaaaaagttctatcactggctacccaacaatgcctcccccccctccatccaacacactgtcggcagctttttcccgggcttctccccctttcccaccattgggctggccccttgctgctttgccctaacatgggatggg

SEQ ID NO: 72375 - DNA, 446 bp, Triticum aestivum
  Clone ID: PAT_TA_72375
aaaatggaaaacaaaaattattttttgaaacccaaaaaaaagggagccctccacctccatttttttaaaaaaaaaaactgcttttcccaaaaaaaaaaaaaaaaaatgaaccattgccaaaccatttctaaaaaaaaagggttttttcttttttaaaaaagggcttttttaaaaaaaactgggggaaaaaaattttcccccccaaaaaaactgaaaaaaacaaactaaactgtttcaaaaaaaaccccaaaaataaataaaaaacccaatttgccgggaacaccccatttggcccggaaaaacccttacaggggaaccccgaaaacccccttttgaaaaaacactgccccccattaagcataaaggcccggggaaaaaaaccctcgaaggccaaaaccccttaaaacccaccccctttaaaacggagaacccccattttttccata

SEQ ID NO: 72376 - DNA, 393 bp, Triticum aestivum
  Clone ID: PAT_TA_72376
catgggaaccaaaaaaaatccaatcccctttaaaccaaaaacattctgctcaccaaatgttttccaggggattcaccctcaaaatttacctttaagtaaaaccttattttattaaaaccaaggattgatttttaaaaatttcaaaactttaaacccaaccaaatcctcctccgtccaaaaataagtgccaaaccctttttttcaaacggaggtattaaccagaattccccaacccttccagcggggggcaaatcattccttgtattccttaacatggaggctctccaaggccccctcggcaagggtggcgtcccccttgtaggtcccaagggggccctaaaagttgcccttccacctaaccaaaaacccccccctggccttctcctaattctc

SEQ ID NO: 72377 - DNA, 361 bp, Triticum aestivum
  Clone ID: PAT_TA_72377
ggagacaaaaaatgtgtttgtcttttattcccatgtttgaactaatataattcgggttcttacatgaaactgcatgtcactttattttttcaccggtaccaccaccaaaccatggactaaaaaaacgggggattatatgtctactactaaaattctttttttttcaattaatacccaaaaaacccactggagcaatggggcaatatggagggatataaacattgcacattgcagggagcggctttaaccctagggtccttatttcctcaaactggggcaattgttgaggctggacaaaaccctgggcctgtgggttttgctgaaaagggtggaaagaaccctggcctgaaggatattgtta

SEQ ID NO: 72378 - DNA, 507 bp, Triticum aestivum
  Clone ID: PAT_TA_72378
gttgaagacccccaaaaaattaaactgcattacccaattgaaatccacaacaaactgggaaaaaactaacccaatgcggtacaaaatcccaatgggcacccctctttatttacaaacttatttaaggacaaaaacctccacaatacaactaactaccaattccttggactttattatttttccccaacacgttccatacaccaagcgaacaattttacaaaaccaaactttttttttggcaacctattgaaagaccgtttttaccacctttctgtccaccccaaaaaaatccaaaccgcagtcattgacatatacattttttaacaattcggatgtatcccgcattgggctttcctttgctttggcaattgcaagggcaacttccttcctgaattccttctccatgtccttgaactcctgggctgttgccaaatcatgggtcaataataactttctgaccccctcaatcggatcaccctcctggcttattcctgcaatctcattttt

SEQ ID NO: 72379 - DNA, 337 bp, Triticum aestivum
  Clone ID: PAT_TA_72379
acgcgaaaagctgtgaacagacgttacgtttattgtataactaaggtgcatgcatgcccaaacaccatgcaagctgcaaaaagttctatcactgcctggtcgacaatgcatcactgccctccagccggcacattgccggcaactgtgccgcgagctgctgcacctttgccacctttaggcgggccgcctggtactccccgctaacatggtatgggctggcgtaaccttgttgcccttgacctggttgttgcccttgacctggttgccacaaaaaaattgggtactacccttgttgcccttgtcctgattgatgcccttgccctgactgctggcaaaa

SEQ ID NO: 72380 - DNA, 452 bp, Triticum aestivum
  Clone ID: PAT_TA_72380
cacgggtataaaaaactgattttactccacataataaatgtttccccattacaaaccgctcaccatttcaactatttaaaggtaccaaactttcaaaaccagggcttcactcaaaaacaaaaccattaccttttttgtaaaaggggtaactaaatgggacaacataatgttttccaaatcaaccaatcccattcccaaaaatccaccggggggaaaaacaaaaattctaaattttgttaaaggcaacaatttcacacaactggacattttctttgatgggcccctcccaaaccacttcctaaataaaagtgtcaacggacacaaggccatcaataatcgtcaacataatctggacctttttgatcccataacccacaggcttaaccttaaatcccccccaggtaaaaccctccttttaaacactgcggacagcctcctccaactttttaatg

SEQ ID NO: 72381 - DNA, 419 bp, Triticum aestivum
  Clone ID: PAT_TA_72381
gggacctaaaacatcgcatggtattggggtacagttctacacacaaaacaccacgggtgaaaagggcaccccgacccggacacacggccaatttgtttgtctgatgcaatgtaaccaccccccaagcgggggctgccgtgccggtatttcatatatcaacgttgcaagaggggttgcccaacagcggcacctcaggaacaacggcggggcccacgttgcccggggccttccaaacgccgacgaacatgtttcaacgcgcgtacatggaacgccacccgctccggaacggcccggacaccaaccgcacgcggccgaacagcaccacccgcagcgacaccacgccgtaggacacgtcgttggccaaggccgccgcggcctccggcgacacgggcacgggggccgccccgccgcccccgatc

SEQ ID NO: 72382 - DNA, 388 bp, Triticum aestivum
  Clone ID: PAT_TA_72382
agaaaaccaaataccattcattttaaccaaggggcaaaacaggttcaaaaatacaaggttcttacaacacaacaggttgtaaaacaaacaccacaaaacaaacgttcaaacaaacaaataacaaataaaccccctcgggcaaatcataagataacaataccaacccttgggaaaaccccaagaggcaggcttaatactcatcgcccttatcaccgtcctcacccttgttaaactcaacaccaactttttcataatccttctccaaggcaacaaaatcctcacgggccttaaaaaacttttccttctccatgccctcaccgacgtaccaatggacaaaagcacccttggcgtacattaagtcaaacttgtggtcgatgcgggaaaaaac

SEQ ID NO: 72383 - DNA, 351 bp, Triticum aestivum
  Clone ID: PAT_TA_72383
aaaaaaaaaattttttttttttttattcccatttttaaactaatttttttcgggtttttacataaaaatgcttttcctttttttttttcacccctccaaccaccaaaccctggactaaaaaaacggggttttatttttttactcctaaaattttttttttttcatttaaccccaaaaatccccactggaccaatggtccaatttggagggatttaaacttttcccattgcaggtaccctttttacccctaggttccttttttccccaaactggggcaatttttaaggctgaacaaacccctggccctttgggtttttctaaaaaggctgaaaagacccctgccccaaagga

SEQ ID NO: 72384 - DNA, 387 bp, Triticum aestivum
  Clone ID: PAT_TA_72384
ggaaaacaaaaaatttaaaaaaccaaccaagggaaaaaaagggaaaaacccaaacccccccccccttttccccccaaaagggaaaatttaaaaataaaacccccacaaaaaaccccaaaaaaattgtttacaccaaaatcaatgggaaaaatttcccaccttctggtcccgggggggtttttccgaaaaaggcaaagtttttaaaaaccctggaaaacctgggaaaccccccccgaaaaggggccaacccccccccccaagggggggttttcccctttccaaggggtaatgaacctaaaccccttcaaaaaaagctttttgactttaaaccccaaaccaaaccttttttgcaaaaacttgggggccccccgaaaccccccctgggcc

SEQ ID NO: 72385 - DNA, 333 bp, Triticum aestivum
  Clone ID: PAT_TA_72385
actgaaaacatcctttagaaaccaaaaaaacaaagggaaaacaggcttcccttcaaaacattgtcacttaaaaaaaggcttttttggaacagcgtatttattcccctaaggggttaaaatttccctggaatacatacctaaaaaaaatgttcaactaaaacacggaacttccatttaaaaaaaagggttttcaacccaatgcagttggaaaaaatcaacccttacctgttaaaaaaaaaaaatctggtgaaaaaaaagggcttgggtaaaaaaaattcttcaaaaaactttgcttttaaaactggacccccaccatttaccatccaaaaacct

SEQ ID NO: 72386 - DNA, 327 bp, Triticum aestivum
  Clone ID: PAT_TA_72386
gtttaaaacaaccttatttttattttatttcaaaatttaaaccactattttgggccggtcacacattaaattttgtgaccctttatttttcaccccttcatccacctttccatccactaaacaaccgggaccccatttttttttactaaaaatctttccttatcaataagccccaactcccgggccaaccttaaatggcacactattgggggttttttacaaccgcacattaacccttcccatttttggcaagataccgaccccaatggaaatcatcacctcaaacttaactttttggtgtggcttcaaaaaaggaccccttcccaa

SEQ ID NO: 72387 - DNA, 404 bp, Triticum aestivum
  Clone ID: PAT_TA_72387
ccaaaccaaaaattgatctaacttttttgaaaacccaaaccgaccatcccccccaatcatgatgtgcccttccctaacccttgaaaaatccacttggttattcaaaacatcacccccatcggccctttgcttttttaaaaatttttccccccaatataaccaaaccaccttcaaggattcgaaatgcgggcccacaaattcccctaaaattccacatccaccccttgaaaaaaaaaataacattttttttttagggaatttttaccccaccccctccaaaaaaattaaaaaaaatcatgaggaccttggacccaaccaaactaatcaaagttttttatgaaaggaaaaccctttcaccctactacggggaatcaagccacctttatttccggtaaaaattaacc

SEQ ID NO: 72388 - DNA, 460 bp, Triticum aestivum
  Clone ID: PAT_TA_72388
gttttgcaaacaaacaacgggttttattctgggctgaaaaccccaaacttcctttattacaaaagactcgggatggcgcatatttggcacatataaccggactcgacccccaccatcaccttttatttatctttctatataatagggaacctcaacaaagtccaaaccaaaatctcaagtctgcacaatttgacaatattgctactactaacaataacaggaatattacaaggacctccgtacacgggtctgatcaaacgttgatatggggcttatttgttatctttggcaggggaccccaaaacaaaattaattcccttcttgctggaatcacctcctgtaaacccctttttggaaccaaaaatcgccttaccatctgctgcgtctttgacaccaatgggttcaacatcgatgtacccaagaacagctttgccccaaaaaacaactccttcatccttaa

SEQ ID NO: 72389 - DNA, 384 bp, Triticum aestivum
  Clone ID: PAT_TA_72389
aaacaaaaaatgtgttcgttttttattcccatgttagaactaatcttattcgggttcttacatgatactgcatgtcactttattttttcaccgttacaacgaccaaaccatggactaaaaaaacggggtatcatatatctactactaaagtttttttattctcaattactaccaaaaatgccaactggagcaatggggcaatatggagggatataaacattgcacattgcagggaccgtctttagcgctaggttccttatttcctcaaactggggcaattgttgagggtggacaaaaccctgggcctgggggttttgctcaaatgggtggaaggacccctggcctgatggatattgttgttgaaactgttggaaacaaacctgg

SEQ ID NO: 72390 - DNA, 173 bp, Triticum aestivum
  Clone ID: PAT_TA_72390
gatccaaacaaaagattctaccatacataattaacttttctcaacaaaacttaatttaaactaaattaacataaaagcattacacaaaaacttttgtccattaaaaggtaaggtaagtaaaccatggactgaaaaaactcgcttatcacagggataaactaaactttttttct

SEQ ID NO: 72391 - DNA, 457 bp, Triticum aestivum
  Clone ID: PAT_TA_72391
ggaaaaaaaccaaaaaaaatcccatttatttaaaaaaaacccatcgaaaaaaaccaaaaagttaaccccattcacccccaaaaaaaaggggcaaattcaaaagggggggggaaaaacttgacaaagggtttttaaaataggaaaggaaaaaaggggggggaccaaaattttttggttaggggggaaaaaaatttaaaagcttcccgccgccaccggaaatttttgggcccttggaaaccttttggagggggcccttgccccccggggaatttggggaatggggcacccttgccttttggggccttttttaaacctggggcttttggaggccccccttgatctcaagggaagaaatttttgggggaaaataaaggaattaagggttttaaacccttttttttgggataacttccaaagggggcccaaaaatccaccgggagtacgggtttttgggggg

SEQ ID NO: 72392 - DNA, 386 bp, Triticum aestivum
  Clone ID: PAT_TA_72392
gacccccacacaaagccaatttgaacattggcttgaaacaactttatttttattttatttcaaaatttaaacaaattggtggggcggggaacaaacgaaattgggggaaactttttttgtaacccgtggattaacatttccatcgactaaacaacggggacccaatttttttttaccaaaaatctttccttatcaagagggaccaactccggggccaacggcaaaggggacactaggggggggtttgtacaacgggacattaacactggacattgttggcaggaaaccggccccaatggaaatcatcaccccaagccgaactttttggggggggtgcaaaaagggaccctgggccaattgttgttgttgagggtgttgccccaatt

SEQ ID NO: 72393 - DNA, 228 bp, Triticum aestivum
  Clone ID: PAT_TA_72393
gcaaaaaaaaacatttttcaacccttttgttaaaaaaatgtggggccccccagggttcaaccggcaaaaaaaatttaaaaaaaacccccccctggaaaaaaccctttccccccaaggaaaaaaaccaaaaaaattgtcccccagggtttatgggaaacccccccttttcccaaaatttcccccgggaccccttttttcaaacccttttgcttaaaaccccaaccttgc

SEQ ID NO: 72394 - DNA, 480 bp, Triticum aestivum
  unsure (1)..(480): unsure at all n locations
  Clone ID: PAT_TA_72394
gaacccaaacagggaatccctttttttcaatatatataaaacaggggtccaacccagggtggggagggaacccatccctactatccatggggtggggggtggggggggattnncacccctncatccacatatccatcaactaaacaaccgtgatccaactatatattactaaaaacctttccttatcaataagcaccaactccccccccaacccccaatggcacactaatggtgggtctatacaacggcacattgacccggcacatcgctggtacgggaccgaccccaatggaagccctcacctcaacccgaactatctggtgtggctagaaaaaagtaccctgtgccaattgttgttgttgaggttgttgccccaattgctgctgcgactgctgttggggttgggaaacacattggcccaactgttggggttgctgctgctgaaattggatggaaccctgaacctgttgttgttcttgc

SEQ ID NO: 72395 - DNA, 358 bp, Triticum aestivum
  Clone ID: PAT_TA_72395
attcaggcaaatgctttattcaggaacgtttattcatcattcccatattgcaactattttttcccccccaggaaaaccctgggcatttttttttttcggcccctacattgatcatttaccatgccccactagggcaggtaccccccatgggaatgttgtaggcggggggggcggggcattgccccggtttgtaaatgttgcacatccaccgcagggcctgaaccaacatccaaatgccctcatgttgggctggctgctgcgggtggaacataccctgccattgttgtgggggttgttgttccctgaaacccccacccactttttggatggcttggcaacaaaattgccccgggatctg

SEQ ID NO: 72396 - DNA, 443 bp, Triticum aestivum
  Clone ID: PAT_TA_72396
gctaacatgccaaagggcctaaattggtcaaagggggaaacccaaatttcccaacaatcataccacaaaacaaaaaccggtgctcaacaatttacaacaaaaatcgagcccccgaggtccccaatcaaaagggcccaacatttttagggccagggggtccctttttaacccttgggaaaaacaaatagcccccactgggaaaaattccccatgaatgcttgggaaatttgaaacccaaaacccttggaacatattgctgggaagggctctgggggttcagggggggggttgtcctcaaaaaaaaaagaggggatggcctacccaaagatgccccatcaaaggtgccctgggacctggaccctggataagggaaaacttcacattttggaaaaaaaaccctcactgggcttgacccaagaaagtctgattgtcccgctggaaaa

SEQ ID NO: 72397 - DNA, 470 bp, Triticum aestivum
  Clone ID: PAT_TA_72397
gacaaggaaatccaaacttactttataccaaacgggaaaaacataaaagggtcaaaaaaaaggaaaacccgaccccaaaaaaacccgggacttttttcaaaccggtgccatttgctttgctcaaagggatttttgctgccatgggaccccccaactcatgcaggcccttttcccctttttatttggtttccactctaaaccaccaagggtttaaccttttttacatgaaggaacaagcgttcgggttctcgtccctgaaaaactgcggggggtaccgggggtaagcccgcggcggagggtaagcggggtaccccggcctcggggggtaataccccccccggaaaggcaaccgggggtaatgcatgtaaagggtggctgcggcaaaggcccccggggctttttccttttccttttcctcgccggcggggccggcaacctccttggctttctcccctttcttttcccctggg

SEQ ID NO: 72398 - DNA, 241 bp, Triticum aestivum
  Clone ID: PAT_TA_72398
aaccgggaaagcttttatttttgcattattatggggtttaactctatttacataaaaaactggaaacccccctcacgtttattggatacctaaggggcatccctgcccaacccccttgcaaccggcaaaaagttttatcactggctacccaaaaatgggtcccccccctccatccaaaaaactgtgggaacctgtgacccgggctggtgcccctttcccaccatggggcgggccgcttgct

SEQ ID NO: 72399 - DNA, 417 bp, Triticum aestivum
  Clone ID: PAT_TA_72399
ggaaaaaaaaaaaggggttggtttttattcccagggttgaactaatatagttcggggttttacatgaaaggggctggcactttttttttttaccggttcaacgaccaaaccatgggctaaaaaaacgggggtttatatttttactactaaaggtctttttttttcaattagtacccaaaaagcccactggggcaagggggcaatatgggggggtttaaacattggccattggagggggcggttttaacgctagggtccttttttccccaaaccgggggaattgttgggggtggaaaaaaccccgggcccgggggttttgctgaaaagggtggaagggaccccggcccgatggatattggtggtgaaaatggtggaaacaaacccggctcaacgggtggtggtggtggtggtggtggt

SEQ ID NO: 72400 - DNA, 468 bp, Triticum aestivum
  Clone ID: PAT_TA_72400
ggtttttttgcaatctaataacttgcatttcacaacaaatcaatctcaaggcacaggagtttaacccaaacaggaataaaaatacagtaattaaaccacaaacaggatcattgctcgcccgggataaaaatctgcagcaacaaaagcaatgaccatgaacaaaaaccttctgctaaataaatgcctatttcttcttgatggcaaccttggtaaccttggcgccggggggggcctttttctccacccccttgatgacaccaacagcaaccgtttgtctcatgtcacccacaacgaaacggccaaaaagagggtaggtggcgaaagtctccacaaccatgggcttggggggaatcattttcacgataccaacgtcaccgttcttcaagaacttgggcagcgcctccaactccttaccaaatcgcctgtcaatcttaatcaccaactcaacaaacttcacaacaatgtggg

SEQ ID NO: 72401 - DNA, 357 bp, Triticum aestivum
  Clone ID: PAT_TA_72401
aaaaaaaaaccggggtttgtttttttttcccaagtttgaactattttagtgggggtttttacatgaaagggcttgggcacatttttttttccccgctccaacaaccaaacctggggcggaaaaaacggggtttcatttttttagccctaaagtttttttttttccaattaatttcaaaaatcccaaaggggggggggggccaatttgggggggtgtaaactttgcccattggggggaccgtttggacccctaggtcccttttttccccaaacgggggcaattgttggggggggacaaaccccggggcctgggggttttgctaaaagggccggaaggacccccgccctaagggatttt

SEQ ID NO: 72402 - DNA, 214 bp, Triticum aestivum
  Clone ID: PAT_TA_72402
gggaaaaaaaacccggggtgggcttttattcccaaggtggaaccaaaaaaagggggggtcctacatgaaagggcattggccaaatattttttccccggtccaaccaccaaacccggggcgggaaaaacgggggttcaaaaatccaggaccaaaggtatttccctcccaagtagaatccaaaaaccccaagggggggggggggccaaatgggggg

SEQ ID NO: 72403 - DNA, 473 bp, Triticum aestivum
  Clone ID: PAT_TA_72403
ggttgcaaacccctttaaacaactaggggacacttgacaaaaaaacttattggttggagggcggcctttttaaacaattaagggacactggccgcccaactttggcctgaaacttattaaaaaaagggccgggatatgtttttaacattacaaggggcaaaggggcaataccaacttttggacaaaaaaacctattaacctaacttacctcaaaaggggtgaaaccctacaggggggggggggaaacaaaaaatttaatctgcccatggaatatacaaaacatggggacctactccccaacatgggggacttcctggcgcccttttttaaaaattcaacactggacaaaaaactttaaccgggcatgaacccgcattaaaaaaaggttcctgggaaaactgaggatgctgcaatccattttcagggatgttaaattcaaacaatttctttaactggtccctgacgggattttg

SEQ ID NO: 72404 - DNA, 218 bp, Triticum aestivum
  Clone ID: PAT_TA_72404
ggcaaacaaaaccggggtttgttttttatttccaagttggaaaaaatctaattggggttctaacaggaaagggcctgtcactttatttttaaccgttccaacaaccaaaccatgttttaaaaaaccggggtttaatatttccaggaagagggtttttcctttttcagttagaccccaggatcccaaagggggcaagggggggcaagcaaattgggggg

SEQ ID NO: 72405 - DNA, 503 bp, Triticum aestivum
  Clone ID: PAT_TA_72405
attaaaaaaccatttctctcccattaattaaaacttactcgtagttgttattacaaaggggggacagataaaggggtccttttataacaaaaagctttagtctagcacaacattccttgaggctttatgggggatttgggcaagtttttcggacctaaactaatccttcatattaccctttaaaagaccgggggggtcaaaaaaaatctatggcctcctacagggggggggatctgtacaacgggtcattggtttgatatatactggcatgaaaaaaagcttgcgccaacccacgggatgtttctagagcgggaatgggtatcccttgggacacatcctttgtttccctttattgggggggggggggtcgtcgtcgtcctccgttgcttcccaccggaccaaatagccgtcccacgaagagctaacgagcgtcggggggggcgggtgccaaaaacaatttttgacgatcgattcatgccattggagggtttcaacaacgtttc

SEQ ID NO: 72406 - DNA, 365 bp, Triticum aestivum
  Clone ID: PAT_TA_72406
gaaaacactagggcaatcaccccatttgcctgccggggggggtttttatttttgttccccaagcggaaaaaggtgccgtttttttacattacacaaaccattggtacataaggggtggtttattaaaaacacacccgtaccattggtaaaataaggggtggctcctcgcgaaaactaaaatttgagcccgcccatttttaagggaactccttggggaaatccccatgatccaccaaaaccacttttcaaccatttggggcaaggaaaaaggggattttggggttcaaccccgggaggggccctgggtgccttaaaaattttccacccaattttttgggaaccaacttaaatggtttaacgctttt

SEQ ID NO: 72407 - DNA, 276 bp, Triticum aestivum
  Clone ID: PAT_TA_72407
gtgtgttttttaattatttgtgacaaaaaatttctttggtttttatttccaagtttgaaataatatagggcgggggttcacattatggggcacatcactttatttattatcggtacattgaacactcattggctaaacaacaatgatccattcgttttgtattacagggcttcatttcattggccaccgatgcttggaaaactactcccatatgggtgttgttggggatatgggtggtgagggtggtgtggtttctgggggaaaggatgatggggt

SEQ ID NO: 72408 - DNA, 355 bp, Triticum aestivum
  Clone ID: PAT_TA_72408
aaaaaaaaacctgggtttgtttttttttcccaagtttgaactattttagttcgggtttttacatgaaagggcctggcaaatttttttttccccgttccaacaacctttcctggggttaaaaaaacggggtttcatttttttagtcctaaagttttttttttttcttttaacccccaaaatcccaaaggggcccaggggccaatttgggggggtttaaaccttgccctttgcaggggggggctgtacccctaggttccttttttcctcaaacgggggcattttttgggggtggaaaaaaccctgggcctgtgattttttctgaaatggccggaaggacccctggcctaatggattt

SEQ ID NO: 72409 - DNA, 352 bp, Triticum aestivum
  Clone ID: PAT_TA_72409
aaaatttttgggggttttttttaataaagccacaccccttaaattattatccacacaccaactcatatacatatgtccatacacaatgaaaaagccacacccacacccattaaaatgggcatttgtaaagggcccatatctcgacacactgtaaaaacccatccaacctgtaaacgtgaccaacttccactgtggcttcagcaacttgccccccataatgcaaccgtaaacctaaattgtttctgttgttaaaccacaacactgcttcctgaacctcccctttctcccaaaaaatgctgacagtggtgtcaccccgggccctcaaccctttgacacacccttcaggccactt

SEQ ID NO: 72410 - DNA, 377 bp, Triticum aestivum
  Clone ID: PAT_TA_72410
ggggtttaaaacaaaacccaaggttttttttttcccggggaaaaattgaccggggtcttaaaaaaaaaatgggccccccaaaaattttttgggcacccaaaaaaaagggaccccgggttggttaaatttggaaaaggggttactttcaaaattttttaaatcccaccccccccgcttgggggcccgggggaaattggcccttttttctttaaccataaaacaagcccccaaagaaaacgggggggtttaattggtggtcccccaaaaccccaatgcccccttttccaaaaacttaaagttttttttaaccatcccaaaaacccaaaacaaaataaaggccccttttgaaaagttttttggcaaccccccaaattaaa

SEQ ID NO: 72411 - DNA, 414 bp, Triticum aestivum
  Clone ID: PAT_TA_72411
gacagcgccatcattttcacctgaaactactggtggaataaaaatttggggggcggggcccaacgagcaatacaacaacagggtcttatctcacaaatcgatcaatgggggtttatttttccatccactggcgggacaaattggaatcgcctccaatccaatccaataataacaacaaccaccccttcagaggggcccgacaaaatgaacaaaacgccccggggaccgaaccccttatttttggagggctatgtccaccgtcgtcgtgtcggaacggaaccttttgggctcccgctcgcccaagtgcaacgagaaacaaatgtcctccgccgaactctccaagttggtgttttccaactcgccgttgcctccttgctcgtcgcgcattggggacatgcccattaggttcgggat

SEQ ID NO: 72412 - DNA, 187 bp, Triticum aestivum
  Clone ID: PAT_TA_72412
gggggaaggatccgcatgtttttttttttgcacaaagcctaaaaaaatatttgcttggttggggaaaatttgcacaatgctctgttcatgggggccactgaacgacaccaacccattccgacctggaaaaaaacaatggattcctgtcttaaatgaaaccacacattcctgggggacactgaatttt

SEQ ID NO: 72413 - DNA, 419 bp, Triticum aestivum
  Clone ID: PAT_TA_72413
aattttttttgggggtttttttttttttttttttttaaaaaaaactttttttggttttttttccaaaatttaactactagttggggggccccacaggacgtttgggtgaccctttttttggcaccgctccatcgacttttccatcgactaaacaacggggatctaacgacttttttttactaaaaatttttttttttcagtagcccccaactccagtgccaatgctgaatggcataatagggggcgagctgtacaacgggcccttgaccccccccatttttggcaaggtgcggagtgcaatggaagtcatcccctcaagttgaaatttttggggggggtgcaaaaatatcccctggggtatctgttgttgttgaggctgctgacccaattgttgtatttgttgaggttgttggaaaaaa

SEQ ID NO: 72414 - DNA, 260 bp, Triticum aestivum
  Clone ID: PAT_TA_72414
gggcttttttgggccggaaaaaccttttattttgggttatttccggggctttcttttttttcctgaaaaaacggggacaccccggaaattttttggtttactaaaaggggtggctgcctaaaaacccttccagccggaaaaaattttttttttgggggggccaaaattggtttccccccccccaccgggacatttgcgggaactttgcccaaaacttgttgcccttttccccctttttggggggcccctgggggcccccc

SEQ ID NO: 72415 - DNA, 392 bp, Triticum aestivum
  Clone ID: PAT_TA_72415
acaaaaaatttgattcccccctggctttccaaatttatgggtcctggacccattcccaaaaaaaattttgccggaaccgggttcatgaagatctttatcccataaaaacccattttaccccaactaaatctgaaaccggccagtgataaccaagcccttttgaaatcccgatcacgatctcaaacatccccccttcaaagggaaaaaaacccgggacccctgccttacagggggttttttggaggaacataaacccgggggaaaaccaaacaaccaccccctcggccggggccctgaccccatggggaggggatcaatcctccccccttttgaacttgtcaaccccctgctggaggggggccaccttgaccaccaggggggggaccgaaaaa

SEQ ID NO: 72416 - DNA, 356 bp, Triticum aestivum
  Clone ID: PAT_TA_72416
aaaaaaaaacctgggtttttttttttttcccaaatttaaactaaattatttggggtttttacatgaaagggccttgcaaatttttttttccccgtttaaaggaccaaaccttgggctgaaaaaacggggtttcatttttttaatcctaaagttttttttttttcatttaacccccaaaatcccaaatggccccatggggcaatttggggggatgtaaacttttccctttgcagggacccttttgagggctaggttccttttttcctcaaactggggcattttttgagggtggacaaaaccctgggccttggggtttttctaaaatggcccaaaggacccctgccctaatggatttt

SEQ ID NO: 72417 - DNA, 363 bp, Triticum aestivum
  Clone ID: PAT_TA_72417
aaaaaaaaaaatgggtttgtttttttttcccaagtttgaacttttttatttggggtttttacatgataggggttgttatttttttttttaacgggtccaacaaccaaaccttgggctaaaaaaacggggtttcatttttttagtactaaagttttttttttttcagtggggcccaaaaatgccaaatgggccaagggggggccaccaatgggggggggtttaaactttgccctttggggggaccgtttgtacccctaggttccttttttccccaaactggggcattttttggggttggacggacccctgaccctgggggtttaactgaaatgggtggaaggaaacccggcttgagggattttg

SEQ ID NO: 72418 - DNA, 445 bp, Triticum aestivum
  Clone ID: PAT_TA_72418
ggtggggtgggaaatatttgggttgtattaaccacccgtttacatttgtttgcatgatggtcaaaatctatttactacacagactccgtcaactatgctcttcatggtatatattgcatatgttcaaacagagtcatacaatttcctgtactggagaattcaccaagaaatgacataattgggctaagctgacgaaccccaggctgctgcggcctctgcttggagcgcctcatggagctcctgtgctacagcgacaaggaaacggtcaccgccatgccctgcaagcagtgaaaccgacaccgggacgccgtcaggggtgcccagagggatgctaacctggcaaaaccccgacaggccggcgatggacaacagcgacaaggccctcgcccggaagtcctccagcagcgctgcgtccatgcatagcttcggtggcgcgccggggact

SEQ ID NO: 72419 - DNA, 287 bp, Triticum aestivum
  Clone ID: PAT_TA_72419
ggggcccaaaaaacaaaaaaaaacccttacttaatacccttaccgggtgggaatggtaaaaaaaaaaaaaaaacccgggggggaaaaacaatacattacaaaagggttaccaaaaagggaaaaccacaatacccgtcccgtttccccgcgccaaaaaaccaccataaataaagctttccccacatatccaaaaagggaaaccgttggaactgggggttccccccaagggcctgggccatgcattaaaaatggccaacaacttaaaatggcaaaacccaccttatgaa

SEQ ID NO: 72420 - DNA, 334 bp, Triticum aestivum
  Clone ID: PAT_TA_72420
atttttgggggagggattccccccccccccaaacttgattttaaataaaggggggaaaacccatggacatcaccgggcaattttaggaattgaactcgggtcgttagggggcaaaaccggttgcccaaccaaaaaaccaagggttgggttcagggtatgtttggtttggcccactactaaaaccaaaaatttttttttttccaaaaaaagccgattcaaggggtcctttgcagcaaaatacaaatcaaaatccaaatttgccctcgaatccggatcctttaaagggttaaagccatccattccatttccaccggaacctcccccaactgggggg

SEQ ID NO: 72421 - DNA, 221 bp, Triticum aestivum
  Clone ID: PAT_TA_72421
aaaaaaataacccgggaccccataatttttgaaacattttataccctacaaggaaaccaacaaattccccatccaaaaattcccccctgtattatatttaaaaacaaaaattcccattttaaaatggaccggctccacatcaaaaatttttgggaacactaacctgaaacctgttcaaacccaaactatttaggaacatccgggggtttattcaacccaag

SEQ ID NO: 72422 - DNA, 409 bp, Triticum aestivum
  Clone ID: PAT_TA_72422
ggaagggtcttttaaaaaaaaaaaatttattatccaaccatctcattaagggttttcaaaaaaaatgggccccacctgaatagtaataccccccgattacccccttacctgtggaccaccccctgtcccatctgactgatgtaccggcatacccccgacccctcgtcaacctttgccctcccgcccctacctaccccccccccaaaatcgaaccaaaaaaaccgcgacttgatttgattaatccaccccccccaaccttaatcccccggggatccaaaccttgattaattcttggcttggacctcgggggccgcttttttgcttgcccggggcgggggccgcaactggtttccctccgaatccaaagccatgtgccccgaaaactggaaccgcccgcacttgtccccca

SEQ ID NO: 72423 - DNA, 222 bp, Triticum aestivum
  Clone ID: PAT_TA_72423
gacaaagaaaggggggaaaaaaaaaacttggttggcttttattcccaaacctgaaataacaccgggcggggggacacatgagggggcccccccctttatttggcaaccgtacattgaatggggcctcaacttaacaaccaagaaccctttacccattaagatagcccttcaggttttcattggcccccaatgcccccgactatgctgggaaaaggggccccc

SEQ ID NO: 72424 - DNA, 343 bp, Triticum aestivum
  Clone ID: PAT_TA_72424
aggaaaaaaaaacctttggggggtttttttccccaagttggaactaatttagtgggggttcttacatgaaaggggggggcattttttttttcacctttacaaggaccaaaccgggggctaaaaaaaggggggtaaatatttctagccccaaagtttttcttttttcaattaaccccaaaaatcccaaaggggccaaaagggcaattggggggggggtaaactttgcccattggggggggcgctgggaccactagggtccttttttcctcaaacggggggaattgggggggggggaaaaaacccggggcctgggggttttgctgaaagggccaaaagggccccc

SEQ ID NO: 72425 - DNA, 333 bp, Triticum aestivum
  Clone ID: PAT_TA_72425
ggaaaaaaaaacaagggttgggttttattcccaaatttgaaataaaataattgggggtcttaaatgaaaggggctgggaaattttttttttaccggttcaaaaaccaaaacatgggctgggaaaaagggggtttatatttttaggaccaaaggtattttttttttaatttgtacccaaaaagccaaatggggcgaaggggcaatatggggggggggaaacattggacattggagggaacggttggaaccctagggtccttattttctcaaaacgggggaattgttgagggtggaaaaaaccctggggctggggggtttggttaaaagggcgga

SEQ ID NO: 72426 - DNA, 429 bp, Triticum aestivum
  Clone ID: PAT_TA_72426
cacctcaagggcccacatgttcaactttataaaaacaaaacgggtccttccaaaggcatcacacgggtcctgggggggaaaaactcaaaaaacaacccagggcatttccatacttaaccctcatccaaaagggtggggacccctgaatttttttcccaagcaagggggttaaaacccaaattaattccgggtttccccttttttggggacaggggcccccaaaacaacgggctaaacacaataccggcaatcggaaccttcttttcttttaagggacctgacaaactttttgacttgccaaggggcaaagggcaccccaagtcaccttcccgggggcggcccccctaacctttcgggggccaaaccttggggtcttgagttgggcccatggcagtggggggcaaccagggccacatcccctttccaggg

SEQ ID NO: 72427 - DNA, 315 bp, Triticum aestivum
  Clone ID: PAT_TA_72427
cccccaaaaacccacttccacacgggctttttacaaaattcaaaaatcgcaggaagttttggtaaaccaggaaaacaggaaaaacctaaacccacaacctgtttgtccttcggggaagtttaaatggccccaggggcgtctttaatgctgatattcaggcggtttctaatggttcttcccccccccccaattttgccctgggtcatcagggcaacaaattttccatagccaatgcccccataattggccgggtcagcttttttaaggacatcatcaaaaaaacccttgggcttgttatgctttgggcaagctggc

SEQ ID NO: 72428 - DNA, 470 bp, Triticum aestivum
  Clone ID: PAT_TA_72428
ggttaccacacattagttgtgcaggcaaccatttttattgcacaaaaaaactccatgacggctcaatggttaggtaccaagtgtggtggggaaccaactgtcatgcacacagccgaccacatcgcggtattccctatggatggtgaaggaatcgtaaaccttgccttcgctgctctttttgtactcaaacaaaaccgacaagtggttgaaggcagtgaccttggtgaacccgtattctttatccctgaacacactccacttggggatcgcgctagtgtacctcgaaaggtggctgccgttgccgcctgccacaacaaatatgatcccgttcatggtgcccgagtagttgctccgctcgttggtgacccactgactctgataaagcgggcaggtacgctcgtagttgtggacgtggccgaaaaaggcaatgtcaacccggtaccgccacagcttttgcaggctctcccggc

SEQ ID NO: 72429 - DNA, 340 bp, Triticum aestivum
  Clone ID: PAT_TA_72429
aaaaaaaaaaagggggtgggtttttttcccccgggtggaacaaaataattggggggttttacaggaaccgggggggcccttttttttttccccgctccaccccccaaccctggggctaaaaaaacgggggttcatttggcccccccaaaagttcttctttttccagttagcccccaaaaaccccccggggccaagggggcaattggggggggtttaaaccttgccccttggggggggggcttttacccccggggcccttttttccccaaacgggggcaattgttggggggggacaaaccccggggcccgggggttttgctaaaagggcgggaaggacccc

SEQ ID NO: 72430 - DNA, 357 bp, Triticum aestivum
  Clone ID: PAT_TA_72430
aattcactaccaaaccatccatacaaaatgcctttggtaggtaccacaaaaaaggtaaccaaagtcacatattacaacatgttaaacggaaaaggggctataattgaatagggcgcccggccaaaattatacatctttaactaaaaaagcaaaagggctatggttgtaacaaaaaaagttgtcgccgcctccaacaccaaggaggtcacaaaaaaacttggaaaacccgatcccatcagcgaccccggtggacggccggggcccccactaaatcccaccggaaaaaatgtgggtgaacacaccaaacccgggcacccgccctgcggcccggtctgcccctgaggggctccactggcc

SEQ ID NO: 72431 - DNA, 336 bp, Triticum aestivum
  Clone ID: PAT_TA_72431
ggatttaaccctggaagggggttaaccccccaattgggggggatttccaaaaaaacccaattttttaaggggcccccgggggggaaaagggcccgggccgaagggggttttaaccctccaagggccccttttcaagggaaatgggccccggcccctccttaagaaaccctttcaaaaaaaaaattggaagggaaaaaccccccaattttaaaccggggtggtccccggttcctcccccgtaataagggaaaacctggaaaattcttttcccccccttatttaaaagcccaaaaccaacgggggatccccccctaaccgggggggcgggcaaaaaaa

SEQ ID NO: 72432 - DNA, 404 bp, Triticum aestivum
  Clone ID: PAT_TA_72432
gaaacccattcaacattgccccagggctttgctaatacaaaacccctcaaagttcacccccatgacccccaaacggtacaacccatggtttcccatggaaacaagggaaaaccggccaaatttcccagggggggcccgggtaattccccaattccctgaaaaccccgactatgtcccccgcaacaaatttgaaccccttcacaaccttgggcccaagcaccccggcccggggcatcaccaattcaatggccttagggtcaactccaatttcatcaaaaaccttgtaatccccctgaacaactggaaaaaccccaggggttgaaaaaacccctctaaaaacaggccccttgaattgctccgcaccccgggaccggaactgggaacccaaaaccccaattttaacc

SEQ ID NO: 72433 - DNA, 343 bp, Triticum aestivum
  Clone ID: PAT_TA_72433
ccgggaacaaacagtttttgaaaaaaaacagttttgggaaccaaggggcccctccatttttattttgggaggggcaaaaaaattgaaaaaaggcccccttcccccaatttctaaaactaacccaaaataattccgggaaaatttttggtacaaaaaaaaaccttcttggcccttgaaggaaaaaaccccctgaaccctgaaaccctgggggcggggccctgggggggggcattaaagggggtcatttccccaggggaccaataatcaaacaaacccctggggggttttggcccataaactttccaaaaaccaaaatttttttgggcccaacctttttcaaaaa

SEQ ID NO: 72434 - DNA, 389 bp, Triticum aestivum
  Clone ID: PAT_TA_72434
attcagggaaacccggaaatcccccccttttgctttaacaaaacataaaaccattcccagggcccacaaattgatcccacccccccccttttccaaatgaaatcaaaaaacaaaaaaaccctccctttttttcaaaggaaactcaaccccccctttgtttcaattcaacccccccacaatgcattttattttcagggaacctggacctggaggggcttgggctttttgggctcgggggggggaatttttttaacggggacggggaaccccccctcggggaaaacgggggaaattttttccatgtgggggttttttgggaaaaaaaacttgcgcataaatttgcccatgcggggctccatccgaagggaccgggggtcctctttttcctc

SEQ ID NO: 72435 - DNA, 320 bp, Triticum aestivum
  Clone ID: PAT_TA_72435
aaaaaaacaaccgcggggccctttattgaagcctatttttgacatttatttgggggggtggggcccccccctttatttttcagtttaaaaaaaacaactttcacatttaaaaccagctcataccctacccttttactggggtcttaattatgccccccctcgaaaactggggtcttaattatgggcctcccccccaaaaagcttggccaggaagggcagtttttcaaagttcaccctttcggcctggttttggggggggaaaggggggccttcaatgggggaaacctcaagggggggaacattggacttgaaacccccgc

SEQ ID NO: 72436 - DNA, 382 bp, Triticum aestivum
  Clone ID: PAT_TA_72436
aaccgaaagttcacttattcattacttaaaaagaaactggtgtactaacaatttcccaaaccaacccgtaacagggattcggtagttcattaaacccaacattggactgacccaaacaaaaaactgttcaaatgagcggacccaacggacaaccaaggataaaccagcgggtccaacgccagggcatttactgaccaccacggggggggagcacaaggggggggggggaccccttctgaatgttgtaacccgcgagggggcggccatcctccagttgtttgccaacaaaaatcaaaccctgttggtccggggggatcccctccttgtcctggatcttggccttgacattggcgagggggtcaaagctctcaacctccaaagg

SEQ ID NO: 72437 - DNA, 356 bp, Triticum aestivum
  Clone ID: PAT_TA_72437
aatatttaaagggccaaaaatttaaacttgggccccttttttggcctttttaataaaccttcctacccccaaatattaaaaaaacctttgttttgggaatccttggataccccaattacccaaaacctcacccaaaactttgggatcaaaaaaatttaaaggggaaactttcaggggtgggtttttcggggggtttaatccccggggtcctaaaaaacaacttttttccaaaaaacccgggggaaaactgaaaaaaaggtccccaccttgttttcagggggggggccccccttggggcccaaaaaaatttggagaacctgggccccatccaaagggtttttgaccccctcccccaa

SEQ ID NO: 72438 - DNA, 426 bp, Triticum aestivum
  Clone ID: PAT_TA_72438
aaaaaaaaaccggggttgggttttttttcccaagtttgaactaatttagttggggtttttacatgaaagggggtggaaaatttttttttccccggtacaagggccaaaccttgggctaaaaaaacggggttttatttttttaaaactaaagttttttttttttcaattaacccccaaaatgccaaagggggcgagggggcaatttgggggggtgtaaactttgccctttggggggaacgtttgtacccctggggtccttttttcctcaaacgggggcaattgttgggggtggacaaaacccggggcctgggggttttgctgaaagggccggaaggacccccggcctaagggattttgttgctaaggctgttgaaaggaaacccggcccaaaagggggggggggggtttttggggggggggcaaaat

SEQ ID NO: 72439 - DNA, 375 bp, Triticum aestivum
  Clone ID: PAT_TA_72439
gggggcaaagaaaaaaagggcaaaacaattggggcaacccggacccaaagaataggggggtcacctactaaccccgggcctgataaccccacaaggtttacaaatccttaattcaaaaaaccaaaaaacgttaaccaatcccccaataaaaaaaaccttccaacccataaaggtttctcccccaccccacaaaaaccggacctaagaaccctttggccccccaaattttgctttttttggttcacaaaccatgcgggtttttctttcaaagggggggggggcttcaaaacgggccccggggaactttcaggggcccaccaacttggatctggccccctccaatgaggggcccatggtttttgaaacggggggtta

SEQ ID NO: 72440 - DNA, 448 bp, Triticum aestivum
  Clone ID: PAT_TA_72440
aggcaaaagaaacaacatatcccattttttttcaatcaggggaatacatcagggcaaaaacaatgcaacatgggatccaaaatgaagactttttttcaaacaaggaagggaaatccccccccataacacagggggacccccggggttggataccctcgaggggacccaattttattgaacccaaaggggaaaccccaccttgccctgggaaatctcaaaccatggatcccccttattacccattaagggatgggaggcccccatcaccgttacaaaaattgacacaagcctcaccacactggtccaaataaaatttaatttttttatcgtaaacaactgggttgaccatgttttcccatagggaaaacctacctcccaagttgcaaaaccccaggggggcggggtcatctgagtgggacccaaggaccaatttagggaaatccttagg

SEQ ID NO: 72441 - DNA, 407 bp, Triticum aestivum
  Clone ID: PAT_TA_72441
gttaaacaaaacatgtgtttgtcttttattcccatgtttgaactaatatagttcgggttcttacatgatagtgcatgtcactttattttttcaccgctacaacgaccaaaccatggactaaaaaaacggggtatcatatatctactactaaagttcttctcttctcagttagtaccgaaaatgccaactggagcaatggtgcaatatggagggatatagacattgcacattgcaggtagcgtctctagcgctaggttccttatttcctcaaactggggcaattgttgaggctggacagagccctgggcctgtgggttttgctgaaatggctggaaggacccctggcctgatggatattgttgttgaggctgttggaaggaaacctggctcaatggttgcttttgttg

SEQ ID NO: 72442 - DNA, 308 bp, Triticum aestivum
  Clone ID: PAT_TA_72442
gccaaaatacataaaccattatttaacaaaggggggcaacaaccaggggatgaaaaaatcaccctcaacacggaaacaatctggtggggaaaataccaaggcccccggggagtaacatttgccgtacaaaaaaaaaaaaacccggcccacaaaatactcattaaacatttggccatgccaaactggaaaaaattaaaacccaaatacataacttgactggaacaacagggcactaataacgggcgtcaaaacgtcctcctcccctggggggggcatacggggcaagcctttccctggaaccccctccc

SEQ ID NO: 72443 - DNA, 194 bp, Triticum aestivum
  Clone ID: PAT_TA_72443
gaaaacaaaagggcttcctgaataaatcaatgcgaaggaacactttgcttcccagggcaattccaatggggaacataaaccggaggagggagtgtggctgcccatgcttttctcgcatgaacatctcccgccttcgctcctacaacaataaacatgccccgcttcccgcgcgggggcaggggatccgatccgcc

SEQ ID NO: 72444 - DNA, 418 bp, Triticum aestivum
  Clone ID: PAT_TA_72444
ggaaaaaaaaaccggggttggttttttttccccaagttgaaccaatataagtgggggttttacatgaaaggggcgggcacatttttttttccccggttccaccaccaaaccctgggggggaaaaacgggggtttattttttttaacccaaaggtttttttttttccatttacccccaaaaaccccaatggggccagggggccatttgggggggggttaacctttcccattgcaggggccccttgggggggtagggtccttttttcccccaaccgggggcatttttgaggggggacaaaaccccgggcccggggggttttcctaaaagggcggaaggggccccggcccaatggaattttttgcaaaagctgttggaaaggaacccggccccaagggggggggggggggttttggggggg

SEQ ID NO: 72445 - DNA, 289 bp, Triticum aestivum
  Clone ID: PAT_TA_72445
aaccgaaaaaacctttcatcttgcattattatggggctttactctaattccccaaaaagctggaaacccccctcactttttttgtatagctaaggggcatccctccccaaaccccatgcaagctgcaaaaagttttttccccgcctggtcaaaaatgcgtccttgccctccacccggcacatttccggcaactgggccccaagctgctgcccctttgccacctttaggggggccccctggcccccccccccaacatggtttgggccggcgtacccttgttgcccttgcc

SEQ ID NO: 72446 - DNA, 346 bp, Triticum aestivum
  Clone ID: PAT_TA_72446
ggaaaaaaaaaccggggttggtttttattcccaaatttgaaccaatataattcggggttttacatgaaaaggccttggcacattttttttttaccggtacaaccaccaaaccatgggctggaaaaacgggggttcatttttttaatactaaaggtattttcttttcaattaatatccaaaaagcccaagggggggatgatgccatttggggggggggtaacattggccattggagggaacggctggaaccctagggtccttattttcttaaaccggggccattgttgagggtggacaaaaccctgggcccggggggtttgccgaaaagggccgaaggggccccggc

SEQ ID NO: 72447 - DNA, 434 bp, Triticum aestivum
  Clone ID: PAT_TA_72447
gggttcaaacggaattcaggctcacttattcattgttcaccaaagctgctgcccaccaccaaaatttcaaaaatacaaatggtaacactgcatcaatgtccggtccaaaaacaaaaacaggatcaggcaaccgcaaacacaaacgaaactcaatgaaggacaccaaagaccaaacttgcggacccaaaaaccaaaccaaagctccttggccagaacctttactggccaccacggaaacggaccaccaagtgaagggtggactccttctggatgttgtagtccgccagggtgcggccatcctcaagctgcttaccagcaaaaatcaggccctgctggtccggggggatcccctccttgtcctgaatcttcgccttcacgttgtcaatggtgtcaaatgactccacctccagggtgatggtcttgcccgtgagggt

SEQ ID NO: 72448 - DNA, 408 bp, Triticum aestivum
  Clone ID: PAT_TA_72448
atctaaatccacttattcattacttaaggataccgcagggccaccaacggtttcaaccaacataacaaggggactcaatttttttcaaaccaacccataggactgcccccaaccaaaaaacctttcaaatgaacgggggggccccccccaccaaacaacccaaaataaacccacaggttgaacccccgggcaattactgacccccgggggggcggacccccaggggggggggggaccccttctggatgttataacccccaagggggcggccatcctccaactgtttgccaaaaaaaaaaaggcccttctggtccgggggaatcccccccttgtcctggatcttaacctttacgttatcgaggggggcggaaccctcaacccccaaaatgatggtcttgcccgggaggg

SEQ ID NO: 72449 - DNA, 398 bp, Triticum aestivum
  Clone ID: PAT_TA_72449
gaaaaataaattcccattttttccccaaatcatttcacataaatttggttcacaacttgccaccccccattcaaattttttaccggggaggaattcccttttttcaaaaaagtaatttcataaacctcagtctttttcaaaaaactataccgcatgccctttggcacaaacaaaaaagggtcaaatcaaggtgccaatttttgaaaatgaaatccccgggggggccccccatctgggaaaaaaacaaaaaatggtcaacaaatttttgaaactgaagtccccggggggggccatgatctaataaaaaaaccaaaaatggtcaacaaatatttgaaactgaaatacccgggggggccccccataaaattcgggggggggcaggcttggaatccccggat

SEQ ID NO: 72450 - DNA, 255 bp, Triticum aestivum
  Clone ID: PAT_TA_72450
ggacaaactttgcaataactggccttcaacagggggggagcttatgaaacaattctcttcctcaaatcaggaaggggccaaacaccaaacccccctttttatggaaaaaaaaaaaacaaatgggaaggggtaacccaactacccaattaactcaaactaggggagcaattacggggctcacactccctcactaataccccacccgttttattggacgggcacaaactttcccccaatttccccccctggtccatt

SEQ ID NO: 72451 - DNA, 426 bp, Triticum aestivum
  Clone ID: PAT_TA_72451
aacccgccacaatttttattgcccatgtttttaaggggatttacccccctcatacccaatccaaacaactgaacctatgacaaaaaccccccgggcatttgggaactttctgtatttatccaatttcacaaaacccccccttgcctgtattttctcaaaagggcgggaaagggaaataaaaatccaaagtttgaaaaaaccctccaaaaatgcctcaggaaggacaaggaaaacctttgctttgcctgaaatgtcattaattgtcccaacattttctgaaatatccaccaattcaaaacccaaaaaatttgtaaccccaaggagtaaaaccttaaaggggacccctcctaaagtggggcaaacaacaccgtttcccatgggtttaaaaaggatcattaaacgggaaattgtttttttgataccccc

SEQ ID NO: 72452 - DNA, 307 bp, Triticum aestivum
  Clone ID: PAT_TA_72452
gacaacaaaaaaccgggtcaaaaatttaaggggccccttcattgggtcaactatttcattttataaattaaaaattggtctgtcaaaaccccattagggacattttgccccctccagggataatgcaaaattaccactgggaatcaatggaatttcccaccctggtggcactgggggaacccccaaaaccaatggggggaaccattgtcgggcccctgttttttttaacttttcaaagggggcaaaaggcgtttattttgaaccctttgtttaccccttttttgtggaaaaaatgggggcaaagaaa

SEQ ID NO: 72453 - DNA, 371 bp, Triticum aestivum
  Clone ID: PAT_TA_72453
aggaaacccaacaaacatagggggaactgaccctgggaaacaaaccaataaaaaactggaactaaacaaacccccccccccccgggggcccggaaaaagggcaccccactgggtccctccctccctccttgcccgtaaccaaaactgggggttaactggccccaaaaacacttttatttaacccgggtaacccaaccccccccataaaactcccactccacacctaataaaaaagaaaacccccccccactgggtgactggcccggccaaataaaaacaaacgggccccgccggggaaccttacccaaccaaccccttttttgtttttgggcccccctaaaacccttaacctggccaccggggggggcggt

SEQ ID NO: 72454 - DNA, 358 bp, Triticum aestivum
  Clone ID: PAT_TA_72454
aacagaaaagggcctgggcacatttttttttccccgctccaacacccaaaccgggggcggaaaaaaggggggttaatatttctagccccaaagtttttttcttcccagttaaaaccaaaaaccccaaaggggggggggggccaaatggggggggtgaaaaccttgcccattgcggggaccgttgggacccctggggcccttattcccccaaacgggggcatttgggggggggggaaaaaccccggggccggggggttttgctaaaagggccgaaaggacccccggccaaagggattttggcccaaaggcgggggaaaggaaacccgccccaagggggggggggggggtttttgggggg

SEQ ID NO: 72455 - DNA, 434 bp, Triticum aestivum
  Clone ID: PAT_TA_72455
gaaaccactttttttttattttttttcaaaatttaaaccacttgttgggggggggcccacatgaaattgggggaccctttttttggccccgggggatcgacatttccctcgactaaacaaggggggccccatttttttttaccaaaaatctttccttatcaaaagggcccaaccccggggcccacggtaaaggggccccttggggggggtttggacaacgggccattaaccctggccattgttgggggggtaccgggcccaaggggagtcatccccccaagctgggctttttgggggggggggaaaaagggcccccgggcccattgttgttgttgagggtgttcccccaattgctggtgcaactggtggtgggggggggaaacacattggcccaactggtgggggtgccgctgctgaaattggatggaaccccg

SEQ ID NO: 72456 - DNA, 245 bp, Triticum aestivum
  Clone ID: PAT_TA_72456
acccaaaaaaacttttcattttgcattattacggggctttaccttatttacataaaaaactgggaacccccctcacattttttgtatacctaaagggcttgcctccctaacccccatgccaactggaaaaaattttatcactggctggccaaaaatgcctcccccccctccaaccggaaaattgccggaaattgggccccaaactgctgcccctttgccacctttaggggggccccctggggccc

SEQ ID NO: 72457 - DNA, 427 bp, Triticum aestivum
  Clone ID: PAT_TA_72457
ggggaactctagggaattaatcttgcctgccccctaataaatataactaaccttgaattgggagtacaaaaatatacccatgcctgcgtacgtgcgaaccaaaaaataaaaaaaccgacttattatttattcactccatccccatatatatatatatatatgtacctacaattggataagggaagggacctaacgacttcttttttcctttggatttttacttactcacatgcgggacgtatacacatatgcgaaattactaatactatatataaataccggtgttcttgtttggactcccaaccggcgtgtttattaacaaaaaccttggatttttttgggaaccggggcgggattttcgacggggaaccttttgccaccgtcgcgctcggggtttaaacccaaatggatgtttggataatgggcc

SEQ ID NO: 72458 - DNA, 274 bp, Triticum aestivum
  Clone ID: PAT_TA_72458
aaaaaccaaagggcccccccttttttggtgggatggagggcaattttttttgtctccccaaaacccctttgggggggaaaccttttaactccttttttaaaatttacaaaaattcgaccaccctgaattcaaaacagaaaacttccaaacgggttttaccaaagcttccaaccaggacggggtttaattgggaaaacccacccttttttttggaaccccctttttgcacccgcttttttgcaacgggtaaaaaacgggcggggggtttttaaag

SEQ ID NO: 72459 - DNA, 462 bp, Triticum aestivum
  Clone ID: PAT_TA_72459
caaaccaaaactgattgcaaaaataaaatttccttggttaacacaacccatcccatgacccaaccccttttgcaacaaaaaacaaccttttatttctacctactttacagcaaccccaacggcaataatgaatttaataatttgtgggccctaggcttattatgttgggatccccttgacccaacaactaaaaaactgcccccgtcataacaaatcgacgttttttaacaatctgttctgagttgcccccccaactctggagtcacaaagtttaaatacccctgaacaaccaaacaattccacggatccctggatcgtcccctgagggaaacattcaaaatccatttgctgctaaagttgcccccctcaatgccctccaaaatgccagcaaccccaacttcaaccccaacaacgttctaaatggggatgtggcttataagggggaaacctttcctgccataa

SEQ ID NO: 72460 - DNA, 395 bp, Triticum aestivum
  Clone ID: PAT_TA_72460
aaaaaaaaaagggggtgggttttttttcccagggttgaaccaaaatagttggggtttttacatgaaagggggtggcacttttttttttcaccggtccaacaaccaaaccgggggctaaaaaaaggggggtttatttttttaccactaaagttttttttttttcaattaacccccaaaatgccaacgggggcaagggggcaattggggggggtttaaactttgcccattggggggggggtttttagcgctggggtccttttttcctcaaacgggggcagttgttggggggggacaaaaccctgggcctgggggttttgctgaaagggggggaaggacccccggcctgagggattttggggttgaaactgggggaaacaaacctggctcaacggggg

SEQ ID NO: 72461 - DNA, 380 bp, Triticum aestivum
  Clone ID: PAT_TA_72461
aaaaaattgccctccttttattggtgcattccccccctcttttccccccctttttaaaaaacttcaaaaaatcttccccctaaatccaatggaaacaaaatgacattttaaccgggcaacgggcaaagctgacccttaaaaaaaaccattttttgaacctcaaatccttggggtctgtttaaacccccacccactgcacattttttgcaaaaacttgtttgcaatgcaatgattctggtaaatctcggccttttcccaacaaatatcgaaaaccccctggtacggcctaaggctgatgcttcatgttgcccacctgggggatctaccacactggggaacaagcccccccacattcccccttgcctattgcaactccccta

SEQ ID NO: 72462 - DNA, 479 bp, Triticum aestivum
  Clone ID: PAT_TA_72462
gttttttggaccaccaactggtcaattatttatttattatatccaagtacaaacctcactttggtctcgtttgcaacagtacattaggatcaaaccgacggggatgcaaaaaacgtggcttggggaaatacaggagctcaggcgtaatacttgatcaaactgctgtaattggtctgcttggccaaatatcggtcccaaaacatgatgccgccgtaattgtcctttttttgcgccaccggggcgacgccgtaataaacgttcttggggggtacccactggggggacttgtcgtcccccgtgagcccgacgtaaaaccgggtgggcgggtaccccgccgtccacttgtcccacgaaccctcccacccaagggtctgggtgcaccacttggcgctctcgtagggcctcacgtggacgcgctcgaaaatccccgtcgccagcgcccgccccacgtgcgccggcggggggtacccgcaccggac

SEQ ID NO: 72463 - DNA, 482 bp, Triticum aestivum
  Clone ID: PAT_TA_72463
gtgttttttggctcaacattcattgcattattaataactattcaaccataccaaacaacatagggcacatacactcaaataccataacatcacgcttatgaccacacaatgacaaacatatatagggcacatactcagggaccacaccatcacacagctttttaatgaaaacaaactcgcgcttagtaaacaccacaactgatcgaacgaaacgggagctaattgggggcgtggatctgcttgaccaatcccagggtgatgatgccccaagcggagcgcggccattggttctccttggctttatccctcatcaccctcccccatgacacccaccccttccatgacattcttttggcccaactggtggcccactccaccaccaacctaaaccccttcttcggcgggggcttcggcttcttccaccttccttcggcgtttaacaacacctgagccaacaccagccacgggttccccacgtacgg

SEQ ID NO: 72464 - DNA, 241 bp, Triticum aestivum
  Clone ID: PAT_TA_72464
aaaccacatttacatttttacacaggtgccatttgccccaaacggatctacaattttaaaaaaaatccggttttcctacccaaacaccaaaccacatacaccttatacaaggatcaaccccacaccaccgcaaaccctttttccctgacctaaataaggctccccacattttatttttaccactcgtgtaacccccccataggatccaaggaaaattttgctgcaaggggaacaaaccccc

SEQ ID NO: 72465 - DNA, 373 bp, Triticum aestivum
  Clone ID: PAT_TA_72465
gagcctagggtcataatttaaatgcccaaaactttaacattggtcacgttcattgccatctttattaaacttcctaaccccaaatagttaacaaaactttgtttctggaatacattggttgcccaactaaccaaaacctcaacccaaacatttggatcaaaaaaatttgaaatgggaacattcaaggggtggatttttaggggggttcaatcccaggggactcaaaaacaacgtttttcccacaaaacccgggggaaactgcaaaaaagggctccaacttggattcaggggtggtgcccccctttggggccaaataaaacttgatgaccttggcaccatccaaacgggatttgacacccttccccacaatttt

SEQ ID NO: 72466 - DNA, 310 bp, Triticum aestivum
  Clone ID: PAT_TA_72466
aacccaaaaagcttttcattttgcatcattacggggccttacattatttacaagaaaaacttgaaccccccccccatttattgtataactaaggggcatgcctgcctaaaccccaagcgagccggaaaaagttttatcactggggggccaaaaaggggtcccccccctttacccggcacattgccgggaactgggccccaagccgctgggcctttgccacctttaggggggccccctggggcccccccccaaaaggggatggggtggcaaaaccttgtggcccttgtcccgacggggggggaaaaatggg

SEQ ID NO: 72467 - DNA, 404 bp, Triticum aestivum
  Clone ID: PAT_TA_72467
cttccccaaaaaaaaccttgctttgcttcctttcaaaggggccaaaccacattttccaaaacccctttttggttacccccccccggcaaaccaacaacggggaccaaaccttctaccgctccaaatcatcatcctcaccgccatcatccaaagtttcggattctggggaaccggctaaaaaggcaagggccggggtgttcggccacgtcggaaacttattatcatcatcatcctcccccaggcccatgggcagtagggaagtaaaacccggggggggacggaaacgggcaaatcattcaacaacctcctccgttttttggggcttcgacggggggtaccaccccagggcccttaggccggccagggggccacccaccccggggtatttcctgtttttgcgggcc

SEQ ID NO: 72468 - DNA, 241 bp, Triticum aestivum
  Clone ID: PAT_TA_72468
aacatgaccaaacactcacttttattaactcaactcacggggctattgtccggtttcatgatcaagcctcgtcgattcgctatgagggtttcggacacccaccacactgttcaacatttgtcaccaacaagttgagtccaaagacgcacaaacatcagactagacgacgaccattttcatcatcacgaccagcagtcacagtcaattaagtacatgaccaaatcgtttgagaatgaagggc

SEQ ID NO: 72469 - DNA, 238 bp, Triticum aestivum
  Clone ID: PAT_TA_72469
gaaaaaaaatacccgggcgaaaaaaaaaacccggaagggaaaagggccccttttttttcccatcctttaaaaaccacccttttttggcccaaacccaattccatttgaatctcacaaaccttttgaccaccgactgaccccaaaaaaaatttgccccccaccccccttaaccattttccaaacccccctgcctgcctggggggcctttttactggcccccggggtcccggagggggcc

SEQ ID NO: 72470 - DNA, 375 bp, Triticum aestivum
  Clone ID: PAT_TA_72470
caaacaaacaatcatatgtagacaaaacatgtgtttgtcttttattcccatgtttgaactagtatagttcgggttcttacatgatactgcatgtcactttattttttcaccgctacaacgaccaaaccatggactaaaaaaacggggtatcatatgtctactactaaagttcttctcttctcagttagtaccgaaaaagccaactggagcaatggtgcaatatggagggatataaacattgcacattgcaggtagcgtctctagcgctaggttccttatttcctcaaactggggcagttgttgaggctggacaaagccctgggcctgtgggttttgctgaaatggctggaaggacccctgccctgatggatattg

SEQ ID NO: 72471 - DNA, 272 bp, Triticum aestivum
  Clone ID: PAT_TA_72471
gtttttaacacactactatcttcttcttcccacaaagggcacacaaacttacatacatacagacggacgactctctttttcctggttttgacaacacaaacaactacaaacagtccggattttcttcccccctactacatttacaacaaacaaaccgacggacacattcttgccctgggggttggttcatgctctcgcataccctgcaaacccggtttctttcggtcgctcgctccctcatagccccatcaggtggtcgaggcccccgtgag

SEQ ID NO: 72472 - DNA, 379 bp, Triticum aestivum
  Clone ID: PAT_TA_72472
aaaaaaaactttatttggtttttattccaaaatttaactactagttgggggggggcacacatgacattgggggacactttatttttcaccggttcctcgacatgtccatcgaaaaaaggacggggggccaacttttttttactaaaaatcttttcttatcagtaggcaccaacttgggtgccaacccctaagggggcactagggatggggctgtacaacgggacattgaccctgcacattgttggccgggtccggagtgcaatggaaatcttcacctcagggggagctttctggggggggtgcaaaaagggacccttttggccctgttggtgttgagggtgttgacccaattgttgttgagggtgttggaaaaaacatt

SEQ ID NO: 72473 - DNA, 427 bp, Triticum aestivum
  Clone ID: PAT_TA_72473
ggaaaaaaaaaatggggttggttttttttcccctggttgaaccaatataattgggggttttacatgaaaccgggtgggactttttttttttaccggttcaaccaccaaaccctgggcttaaaaaacggggggttatatggttaccaccaaaggtcttttttttttaatttatacccaaaaaacccactggggccatggggccatttgggggggttttaaacttggccattggggggggcgctctaacgcctgggtcctttttttctcaaaccgggggaattgttgggggggggcaaaaccccggggccggggggttttctgaaaaggggggaaagggccccggcccgaagggaatttttgttgagggtgttggaaaggaaaccggctcaaccgggggtggtggtggtggtggtggtggtggtggtgg

SEQ ID NO: 72474 - DNA, 423 bp, Triticum aestivum
  Clone ID: PAT_TA_72474
aatttaaaaacattttaaaaccagatggggcacacacaaaattaagcaaaaaactttttttatttgggaaccgggggacacaaagggagtataacacaaaacttgacacattttgaaaagaaataaaaatcccttcaaccaattaaatctaaaaatccccagggtgccccggggaaaccccaaacctccattttgaggggggggtggggccctcaaccctcccattccaaaaagggaacctttgacaacgggggggggtgggatcccccaccgacccaaaatgggtggtaaccccttgccccattccggccttttttggggggggcaaggttgaatttcccaactccgacagctccatgggctaatttttggcacgttggaggggtcctttatccacacctcgccagcaaaaggaacaaaata

SEQ ID NO: 72475 - DNA, 489 bp, Triticum aestivum
  Clone ID: PAT_TA_72475
gttttttttggccacatacatgatcttgtttgcggaatgggcaaaaacaggaactacattccacaggggtgggtcaccgaaccgggacctccccaccccgatctacaagccttttaataaccaaaaaaatgaaccaatgaaacaatgacccacttaaggcaatacacatttactatttccactggtcaacaacactccgatcaaaacaaccgcgcccatgatcgcattaaccaaaaaaaaaaccatgtcctttcttccttttatccctggagcgtttaccaaggagggaaaaaaccggtgaaggtgaatggcaagctgtaaaactcctcgttcctgctggcccccttgaaggagcggaagggcacccaccacgggattccgcgggccctgccaacgttctttaccttcaacgtgttgtccaagaacacgggcaccattaaccccaccgttgggggggaacaaaaaaaggggttgatgtaatccttgaac

SEQ ID NO: 72476 - DNA, 464 bp, Triticum aestivum
  Clone ID: PAT_TA_72476
gcaaaggaatatgactgacttactggaaacatatactctctatacacattttcaggacaaacttcggacaaaattaccacagataccggaaacacggggacatcacattcacatataccttggtggcactactcccaatcccatatacagcaccacacaagggtcaaattttggggacaaaaaattgaacaccatactgggggtggaggggcattacctttattggggcatgaacataggacggggggacattaaacccaaaccggtggaggaccattgcaagcgccaactttgccttaaccattgcgagattctgcccaacacaaatagcagggcccataccaaaggggaaatactcgccgaggggataactcttgccatttgcaaacctcgatggatcgaactcctctggattaactccccatatgtcgacatcatggggaatctcaataataggcaaattg

SEQ ID NO: 72477 - DNA, 438 bp, Triticum aestivum
  Clone ID: PAT_TA_72477
ggttgcaagtatgcccatgacccccaaaggggtgattattatgtgcctgaaaaagggatcatatattcactcgacagggtcatgggtgcaattatcatttttggatttacccggtataatgctaactaaaaaaagagggggacaaactgatggaacaatgggcaacattatttggacactgggggaaaacaaaagaatttggtactccatttttaatccaatttggtatgtgccggggccaatggcttcttctttcaccgacacttcaaattgaatttaattgcaaatgatgatttcaaaactggtgcagggaaaaaaatgacctgcaaacacttttaagggtcaaattataagggaaattgaacgggtttataaataagggattaaattaaccatgggtgggaaaaaattggaacaaaacatgccaataaattaaaa

SEQ ID NO: 72478 - DNA, 454 bp, Triticum aestivum
  Clone ID: PAT_TA_72478
ctgggaatgggcttttgctaatatgctggccgtatttatatgatccccaaacaaggcataaattattgtaagttcaaacatcattaaaatacatactgggggcaaaaaaaaaaaaaaatccttcccagctttaatttaccttaacttgaaagcaaggggcaaaggaacaaaaaaaggcaaactaatttacaaaggggaactgccacagtggggatcaacctaccaaaaccggcaaaagggcactagttcaatttgtttttcgcctaaacaacccaagtagcacccctatttcaaaggtttgtatagggggggtttcatgggtcaatccaaaccgtttttgaacacttttagttcagggcgttcagtcactcaagccataaactcgttgggctgaatcaagcgtgttgccaaaaaccattgcgagggggactggtcccactccgcctggaactgg

SEQ ID NO: 72479 - DNA, 216 bp, Triticum aestivum
  Clone ID: PAT_TA_72479
cctaaaacccccttttttggttttttttttaaaaattaaaacaactggttggggggggccacacatgacgtggggggacatttttttgggccccgttacttggacttttccatcgactaaacaggggggacccaactaaattttcctaaaaatttttttttataaggaaaccccaactccgaggccaacccctaggggcccactagggggggtttc

SEQ ID NO: 72480 - DNA, 320 bp, Triticum aestivum
  Clone ID: PAT_TA_72480
ggaaccacctttttttttttttttttcaaaatttaaacaacccggggggggggggcacacaccaaattgggggacactttatttggcccccgggggttaaaatttccctcgactaaacaacgggggacccacttttttttaccaaaaacccttcctttttaaaaggaaccaactccggggccaacacccaaggggcccccaggggggggtttttacaacgggccattgaaccgggacatttttggcgggggcccggccccaagggaaatcatccccccaagcggaactttttgggggggggggaaaaagggaccctgggc

SEQ ID NO: 72481 - DNA, 385 bp, Triticum aestivum
  Clone ID: PAT_TA_72481
ggggcattaaaaaaccttcccccccttatttattcatccccgggggggggggggggtttacccttccaaaaatttttcccccggcccccccctgaaaaaacccttccttcctttgggggcaaaaccccctggccccaccccagggggcccttccattggaaccaaaccaaggggttccccttgccttttggcccccccaagggggagggtttaggggcgggcccaaaaaaatttaatggccccaaaaaccctacatgggggaatccctgggggcccccaaaaaaattttattttcccttgaaaaaaacaatcgggggtttattcttaaaaaatttgccgggaaaacccctttttccaattaaaaccccaaaatttttaatttttt

SEQ ID NO: 72482 - DNA, 337 bp, Triticum aestivum
  Clone ID: PAT_TA_72482
atggaaaaaaaacctgggtttgtcttttattcccaagtttgaactaatatagttcgggtttttacatgaaagggcatggaacatttttttttcaccggtacaacgaccaaaccatggactgaaaaaacggggtttcatttttttagtactaaagttttttttttttcacttagtccccaaaatgccaaatggcgccatggggcaatttggggggatgtaaacattgcacattgcaggtaccgtctgtagggctaggttccttatttcctcaaactggggcaattgttgagggtggacaaaaccctgggcctgggggttttgctgaaatggccggaag

SEQ ID NO: 72483 - DNA, 331 bp, Triticum aestivum
  Clone ID: PAT_TA_72483
gaaaggaatacttgggaaatttatgaaaatcaaactaacattccccacttaactcaaaaacccaccccaagttcccagggcaatatacgggaaaatgcctgaacttccattggaacccatccaagccttgaaacaacatgacttaaacttttgcccccttaaaaaaccaacccaaaacaaaaattcttaaaccccctttctgcccctattgagttcaactatcgcaaataacaaacaaacgtgacattgggtccacataatcaaaacactggcctaaaaacccattattttaaatttgataggctgcgccctccttaaaaagcttcacggg

SEQ ID NO: 72484 - DNA, 629 bp, Triticum aestivum
  Clone ID: PAT_TA_72484
aaattgtactattgagaccataccaccatattttcatttagtttctttggaaatctaaaggtctaaaaggatcatacatgtgaaaagctgtgaatccacaacaaaaacctaaactaacttccaaacagctcaaatctctcgttgtagtgtggggacatgtccttaatcatctccgaaaacttcttggcatacttctgcaggttggacacagcaatcctcgctgcgagctgctgaaaaaccacacatgcaccttccttcaccttgcccttggggaggaggggggcaacacttgcagcgccacgacaaggctttgcaaacgccgccggcgaaagcgcgcaacaaagggtgttgagagtggcagcggccttcgcctcggcgcgggcatggtggccatgcgactcgaggcagcacacgaagcggtcgcgctggagcaccacgccagccataaaatcagatgcttcttgattaacaaaatgaacacacaattaagcggggcatagaaggtgtacaattatgtactgaaaaaaatcagaggggttagattatgttcaaatgaaataaatcatcaaggttccaatgataaaaaactttgggcccgatgcactgattaatgttacagcacacaggca

SEQ ID NO: 72485 - DNA, 341 bp, Triticum aestivum
  Clone ID: PAT_TA_72485
gcgaaaaaaaacttattttgccttttattcccaaatttgaactaaggcccatctaatccacacatgaaaatgcgttggactttatttttcaccgctacatgggtcggaccattgactaaaaattggggggccatttttcggatactaaaactcttgttttttcaataaccccccatgtcgggagggacctcactggatggggatatggggggggaacaatatgggggaacatgcccctctcacattggcggggtgggctgaatcacccatgtgcctatcaccggaatccaaccctgatccaattgggtttggtgttgtgggtggctaaaacccaaaccctg

SEQ ID NO: 72486 - DNA, 299 bp, Triticum aestivum
  Clone ID: PAT_TA_72486
ggaaccctcaaaaaaaccctttggccccccattggacctggtcccaattttggccgacgaacccccccttaaaccacaattccccctggattttttggaaaaaaaaaagaaaaaaaagcccccccccctgggtcccttggttgggccaaaaccctttggcccccctaccttttattggtaggagccattggtccccacggggggaacttacccagccacaaccaccgagggggttttgcctttaatttttcaaaaaagggggctttttttttgccccccaaccaggggggggggggggc

SEQ ID NO: 72487 - DNA, 395 bp, Triticum aestivum
  Clone ID: PAT_TA_72487
atggaaacaaaacatgtggttgtctttgattcccatgtttgaactattatagttcgggttcttacatgatagggcatgtcactttattttttcaccggtacaacgaccaaaccatggactaaaaaaacggggtatcatatatctactactaaagttcttttcttctcagttaatcccgaagatgccaactggagcaatggtgcaatatggagggatatagacattggacattggaggtagcgtctttagcgctaggttccttatttcctcaaactggggcagttgttgagggtggacaaaaccctgggcctgtgggttttgctgaaatggctggaaggaaccctggcctgatggatattgttgctaaggctggtggaaggaaacctggctcaacg

SEQ ID NO: 72488 - DNA, 280 bp, Triticum aestivum
  Clone ID: PAT_TA_72488
gggtttttttattttatttttttttcttttttggttccaaaaccccaaaacgacaaacccccttgttttacaggctttcaccggccattggaaaaatttgaaccttcagggggtcaccccaaaccaaaggaaccccccacctttgaaaaaaacggggggccccgaccctaaattgttccaaagctggaaaaaaccccaaacgggaaaccgggaccctttcaatggaaaactttttttcaggaaagggggggccttgaaatcgaaccgggccccccccccc

SEQ ID NO: 72489 - DNA, 328 bp, Triticum aestivum
  Clone ID: PAT_TA_72489
ggcaaaaaaaaacttaattggcctttttttccccaagttggaactagggccagtctatcccacacatgaaaaggcggggccctttttttttccccgctccagggatcggaccattgactaaacaaggcgggcccgtttttgggatcctaaacctttaaatacccccccttgccgggagggaccccaagggggggggattgggggggggaccaattggggggaacatgcccgtcccacattgccggaaggggctgaatcccccagggccctttcaccgaaatccacccctgatccaattgggtttgtggtgggggctggctaaaaccct

SEQ ID NO: 72490 - DNA, 333 bp, Triticum aestivum
  Clone ID: PAT_TA_72490
ggccaccctaatcccatctttctaaaacccaaaaaaaatgggggtcaaacccccattggccacacatttaaccctttaaaaccccccaacaccacctggttatttcccttccaaaaaaaaccacccggcccgatacttactcacttaaaaaaaggggctttttcctgtcacataccccccccttcttttttttgggccggggttttttttcacaatatttaaaaagggaaccctgaatttttgaaacctcccacccctttgtttttttaagaaacactttttcaaaccccttaaacccttttggcaatgttgttggaaaacccatcaaatccc

SEQ ID NO: 72491 - DNA, 384 bp, Triticum aestivum
  Clone ID: PAT_TA_72491
aaaaaaaccctttgtttttgggaaaatccccccccaaaaggcaaccccagttcaaccccctttaacaagcccaccccctaactttttttttgtttgaaaaaaagggcggcggcccaacaaaagttaagcccttaaaagcctattttttatttttttgggccctttttcgttaaaaaaagggggtttttccccataaaaaaaccctggaaacggggggggccccccttgccccaaaacttccttttttttccctcttggggggggggggactttttcctgggggaggggggcaatttcctcgccgatgaccccggggttgttccccttaacccccagttccaaaaacccgcccccccagttttgggggggccccttccaaaaaaa

SEQ ID NO: 72492 - DNA, 318 bp, Triticum aestivum
  Clone ID: PAT_TA_72492
aaaccacccccgggggtttttatttaataccatgacctgattttaaatttaacccatgccctgggagggggactttttttccccctgaggaaaactttcaaaaaaccttggccggaatttaggaaaaaaaccccccacctccttttcccgggaaaattggggggcccaacctttggcccaaaaaagcccaaaggcttggggaaggacctaaaggggcaggggcccaaaaatgggtttttttccggggaggggacaaaccagggggttttcgttagcctagaattaaagggactggcttccatcacggggggccttttt

SEQ ID NO: 72493 - DNA, 435 bp, Triticum aestivum
  Clone ID: PAT_TA_72493
ggaagaaaacccacccttttaaaaaccagggaaaaaaaggtttcctcaaaatatccattgggtggttttttttccacaattcaacaccccaaattttccccttttaacaaaaacccaaaatggggccaaaaaaaaaccctttttccacttaactcaaaaagacccgcctatgcctctcctttttttggtcccggtaacaaaaatccttgctgggaggaactttttttctgttgctgaacccgaaaaccaactttatttttataacccccaacttgggcccttaatacctgaaaaactacgggattgccaccggcttcattcctttttttggctgggaagcctggcacccaaaattttttgcgggccccaccctgttaacacccaacatgtggggcttggattttttttgggggtcccaatttattaccctccccc

SEQ ID NO: 72494 - DNA, 305 bp, Triticum aestivum
  Clone ID: PAT_TA_72494
aaaaaaaaagggcccaagtgggattacaatccccccttcccccaatacataaatttacctttcccttacccaaatccctcccggggctccctccggacccaaaataaaaaaaaaccccccctaatgcaaaaaacccctgacccccccgacggggccccccttctggtcgaaggggaaacaaaacccccccccgaacccgatctttttcgaccccccccttaagctggggggcatcccctggccggggaacatcggcccccgcaactgaaaccccccagggaaaaaaaaccactccctgaaaaaaa

SEQ ID NO: 72495 - DNA, 470 bp, Triticum aestivum
  Clone ID: PAT_TA_72495
gacacccacaaaactaacattttaccaacaggggcattttacaatttcacaacatatgcatatgccggtcccaaaattgtaaaacattgtctaaacggaaaaaacaccgaaactggaccccaagaaactattatgccacacataaaaaacacaagcctgggaatacaaatttttaaacaatgacaagctggctctggtctaattctggaacatgggtcaactgccatcaccaaaaacttggacttttttttcaaacccaaggttgttggcccccacaaacttgtcaaactgctggccgtttttgaagaaaaaaaacctcgggggtgcacggatgtcccatgttgaaccgaaatccattagggcatcaacatcaattggcaaaaacatgaattgaggggaaatcttggacatttcaacataaacaggggcaatgacaccggatggcccacaccacaaaacgctgaaatttg

SEQ ID NO: 72496 - DNA, 277 bp, Triticum aestivum
  Clone ID: PAT_TA_72496
ggccctaaaacccatgccctttattttgcaaaaaagggtcaacaatacatgggaaactacatttttttaccccttcaaagggcggggcccaaatttatcctgatgggacaaaacccaattttttaaaccggggctttgtaccctccccacggggcattaaaagtgtacccccggacccgcttgatgcccaaggaattggcgaacccccctttttcgaactcacccccaaaacccctgggcttggtccccccccacggggcttgggaaaaacaagggt

SEQ ID NO: 72497 - DNA, 224 bp, Triticum aestivum
  Clone ID: PAT_TA_72497
gaaaaaaaccccccacgcccattggttttatttatgtattgacatggacatgccttgggaatagggagggtgggaacttggattattataccgagcccgggccacttttatttattttactcccgcattcgtacgaaccacttcacagtacccacaaactccattcaagtccagcttttaaacgggacggggttcaacaccccacacccacttaaaagggggca

SEQ ID NO: 72498 - DNA, 428 bp, Triticum aestivum
  Clone ID: PAT_TA_72498
aaaaacccaacggttcatgctaccattggaactggacatttacaacctactcacaacccccctgtttttcctcctaaacggggcaaaaaaaggaaccccaaatgcttcccacaaaaaaactttgcagttagtacaaaatgaattacaaaaattgctggccgaaaaactgctcattcttgtttacaaaaaatccctctaaattgatgggttggcccataatattgttccttacattccacattgctaaaatgtttataacaacttgtataacccaccattttttttccttgcaatcaacattgttcccaacaatttgcatttgggcaacataaacaaaacactggtgaagggtttatcctgttggtccccttaacccccaccaaacggaataccccccgaatggttcaaatttgcccaaatacattttc

SEQ ID NO: 72499 - DNA, 263 bp, Triticum aestivum
  Clone ID: PAT_TA_72499
ggcccaataaacccaactttttttatttggaaatacccttacacataagaaataccccttccccttcctacctgctgcaatacaaaaccaagaaaccccccctaaattccattccacaaggaacccccacccaaaaattattggcagtcacttgggggaacttatttttaatttatcaccctcaccctttcataaaattttttccccggggaaccccccaccccaaaacggaccccatttcctaacttcactttaaggaactt

SEQ ID NO: 72500 - DNA, 459 bp, Triticum aestivum
  Clone ID: PAT_TA_72500
aaaaaaaccttttttttcacttaaaatttcaaaaaatccccaatccccccaaggacaaaccttcctttcaactttttttaaaaaaattaaccactgcacaaaagccattcattttttcaaatggccaatgaaccccttcttttaccacaaccctggatgaaaataatccaatgcttacaaaaaatgacccggacaaccctggttaaaaccacccctaataaccacccccccttaaatccctttttaaccggaaaggaacctttttttttttaaaaacatttttgaagaaacatttgcctcccttttcccttcctggcccatataaacaaccactttcaaacccccccaaaccccacttattaaataaaacctccgcaaacctttttaccctttgggaaaggaaaaaaactttcttacaggacaacaatccaaatggggaccgctttttacctttcaatt

SEQ ID NO: 72501 - DNA, 429 bp, Triticum aestivum
  Clone ID: PAT_TA_72501
aacccaaaaaactttttatttttcattattactgggctttacattatttacaaaaaaaacttaaacccccccccaattttttttataactaaggggcatccctccctaaaccccaaacaacctgcaaaaatttttatcactggctggccaaaaatgcctcccccccctttaaccggcaaatttcccgcaattttccccaaaacttttttccctttcccacctttaagctggccccctggggcccccccctaaaatgggttgggctgtccaaccctttttccccttttcccaactggtggaaaaaaattgggtaatatccttgtcccccttgtccaaattggtccccttgtcctaactgctgagaaaaaattgggtaaaatccttttgcccctttttttggttaaaaccattgttttggtttttcccctt

SEQ ID NO: 72502 - DNA, 378 bp, Triticum aestivum
  Clone ID: PAT_TA_72502
cccccaaaaaaacccatttaattattcattcccttttaattaacactgtctttcccccatggaggattggaattcccggcccccctttttatcaaaccccaccctttgcatcaaccaatcacctaccctaatattaatccggggcggggaaaaaaaccctcccccccgggggctcaacccggcccccggccggaacccccccctttttaaacctaacccaaccggcctggggtttttgctgccccccctccccaaaaaacccttttccctgttgccgttggggccttttgaaaaaaaacccctgtccttgccgttggcccccacccccaacgggccccccgggggacccccccccctggggggggggggggcttcccc

SEQ ID NO: 72503 - DNA, 347 bp, Triticum aestivum
  Clone ID: PAT_TA_72503
gcaaaaaaaaaatttgttttttttttattcccaaatttgaactaatataatttgggttcttacatgaaaaggcatgacactttatttttttacccctacaaccaacaaactgttgattaaaaaaaccgggtttcatttatttaaaaccaaaattctttttttttcaattaatacccaaaatgcccaatggccccatgggggtccaaccatttggagggatttaaacatttcacattttttgcaacctttgcaaccctaaattccttatttcctggaactggggcaattttttaagctgaacaaaaccctgggcctgtgggttttgcttaaaaaaatggaaagaaccc

SEQ ID NO: 72504 - DNA, 243 bp, Triticum aestivum
  Clone ID: PAT_TA_72504
aaaaaatgtaaacaaaacctgggtttgtcttttattcccaagtttgaactaatttagttcgggttcttacatgaaagcgcatgtcaaattattttttcaccgctacaacaaccaaaccatggactgaaaaaacggggtttcatttatctattactaaagttattttcttttcatttagaaccaaaaatcccaaatggcccaatggtccaatatggagggatttaaactttgcccattgcaggt

SEQ ID NO: 72505 - DNA, 551 bp, Triticum aestivum
  Clone ID: PAT_TA_72505
aaataaaaacaccaagttctattatgggtacataggctgagttacaaactaaaggggcaaacctttatttatagggctttgggaagccatcacatttcaacttttacttatagctaaaaaactctaaaaaacattattaagggtcagcttctactcatagctaaaaaactcgaaaaacattatttataggataaaaaagcaaatgcaacctatgaattaaggaccaacttatctaaaatggagtaaaagcgtgtaaaataactcaaaacaaatttgacttctgatttctggattattcctcgtcacccatgaccccacctccgtgtttggggccttccttcccaacgacggggtgccctcggtgcatccactcaccaacagcacatacggtacccccatctttagcggggtaatcgccacccacccgcctaccagcagcagcaaccgcaaatcactgccccctttgtcgttttcacaaccccacctgccaacttcacacgccgttatgaccgcacccccttcgcaacccatttatggatccaccctgccca

SEQ ID NO: 72506 - DNA, 417 bp, Triticum aestivum
  Clone ID: PAT_TA_72506
ggaaaaaaaaaccggggttggttttttttccccaatttgaaccaatatatttcggggttttacctgaaaaggcctggcccattttttttttactggtccaaccaccaaaccctgggctggaaaaacgggggtttatttttttaatcccaaaaccttttttttttcaatttatccccaaaaagcccaaagggcccaaggggccatttgggggggggtaaacctttcccattgcagggggcccctgtaacccctgggtccttttttccccaaaccggggccatttttgaggggggaaaaaaccccgggcccggggggttttctgaaaaggcccgaaagaaccccggcccaaaggatttttttccaaaagccgttggaaagaaaccccgccccaaggggggggggggtgttttttgtggg

SEQ ID NO: 72507 - DNA, 330 bp, Triticum aestivum
  Clone ID: PAT_TA_72507
gaaaaatgccacacatactatttaacccccattttgttctttttttaaacggaaaaacttttcattttgcattattattgggctttactttaattacacaaaaaactgtgaacacacctcacctttattgtataactaaagggcatgcatgcccaaacaccattcaaactgcaaaaaattttattactgcctgggcaaaaatgcgttgcttccctccaacccgcacatttcccgcaactttgccccaaacttctgccccttttccacctttaagggggccccctggtactcccccctaacatgggatgggctggcgtaacctttttgccc

SEQ ID NO: 72508 - DNA, 504 bp, Triticum aestivum
  Clone ID: PAT_TA_72508
ggggccctggcccaaaaaacccctttattatttattggttttttaataaaaacggcatttccccaagggggaatgggggttccaggcccacctttttttaaaacccccacaaaacatccccccaacaacttaccccaaaaaaccgggccggggggaaaaacccccacccctgggggcccaacccgcaccccggggggaaccccaccttttttaaacccaacccaaccggccgggggttttttttgccccccccccccgaaaaacccttttccttgtggcccttggggcctttttgaaaaaaaaacctttctttgccctgggcccccccccccaaggggacccccggggaaccccccccccgggggggggccccccccgggttaatggcaaaacgaaccccctggaccccccggcccttgtcccggttccgggaaccccccgaaaaccccctgtttttttgaacccccccccaaaaaaccgggggccccttttccaaagggggga

SEQ ID NO: 72509 - DNA, 245 bp, Triticum aestivum
  Clone ID: PAT_TA_72509
ggaacctgcaaacctgggaatcaaaatgacctcccccccaagcccaaataaacattggcttgaaacaaccttatttttattttatttcaaaaattaaacaaccattttgggcggggcacacaaaaaattgggggacactttatttttcacccctggattcacatatccctcgactaaaaaacggggaccccatttttttttaccaaaaaactttccttatcaaaaagcccccacccccgggccca

SEQ ID NO: 72510 - DNA, 405 bp, Triticum aestivum
  Clone ID: PAT_TA_72510
gaccccaaaaaaaaaactttttaactttcaaacctgggaattaaattggccttccccccatgcccaatttaacctttgttttaaacaaacttttttggttttttttttaaaaattaaaccacttatttgggccgggcaccccccaactttggggaacctttttttttcaccccttgattcgcattttccttcacttaacaaccgggaacccaccttttttttcttaaaacccttcctttttaataaggcccaaattccgggcccacccccaatgggacacttttggggggttttttccaccggccatttaccccggacattttttgttagggtccgaaccccattgaaattattaccccaaacctaaccttttggggggggttcaaaaaaggaccccttgcccaa

SEQ ID NO: 72511 - DNA, 453 bp, Triticum aestivum
  Clone ID: PAT_TA_72511
gggatgccaaaactcccttgcccctaaaaaccaaaggggttatttttcatttattcctcccccaaactggtggggaattccccaaaaccttccccggtggggaaaaaaacccccccccaaaatgtttcattaaaccccgccaaaccaaaaccccaccttttccttccttccgggtgccaaacccccccccctttacccaactgggtcccaccccgatgaacattcccaaaaaccccttcaccccacccgaaaactgggtgggcctcaccccgggcctttttacccccgcccttggccccgggaccgggaacaccccctttttcaacccgggccttaccctcttcaccttgggggccccccgcaacccgaaccccctgaccaaattgcccctggtgggccccaccccgggccccctggcggtcctggcccccctttccctggggcccccccccc

SEQ ID NO: 72512 - DNA, 425 bp, Triticum aestivum
  Clone ID: PAT_TA_72512
ccatcaaaaccttaaaacttttttgggatttatcgcttgggtaccataattaattgcccaacccctccctttacttgtaacacctgaggcaaatgacaaaacccttaaaaccaacccctttacaaaaatggggggggattgcccccttgcccgataaataaaccccccccggaagtttctccccggataaggaaaaggaagggggaacccccaataaaacccaaaaccgggggcgggggtccttgacaaagaactactttaccaatagttgtgcctccacccccatttcctgtttaattcacttaaacaaatcctttggaaaaaatggataaaatgcaaaggttctggcccattgggaaaccccccttttccaaaaaacctgtttcacccccgaagggaatttgcaaacccaaccctttgaccaa

SEQ ID NO: 72513 - DNA, 428 bp, Triticum aestivum
  Clone ID: PAT_TA_72513
agggaggggacctaccttgtataaatctctctctctctctctctcacgagtagcaatacaaagtaccgattacaaaggaattaccccatggaggaaaaaaacaaaggaagcttgcaacgaggggaaaaaaaaaggtaggaaaaaggacccccccccggttcgtccgtgatccactggatgccctccttcatcgcctcctcttgcgtatttgtaccctggaggttctcaagcgggccaccccatgacctggatggggcaagcccatataggtaaggagggctcctaacatcccccctcaatgaaatgcggcttgaccccaaaccgcctccgccgacaaccacccgggtcccattgcactcaatgttgcttggcatggccaaaatcacagtggtagctgtagttgatgtaaacttcaaccccctaaaggt

SEQ ID NO: 72514 - DNA, 465 bp, Triticum aestivum
  Clone ID: PAT_TA_72514
ccagccaaaatctcctcaaataaaaaaatgggtaaaaatttaaaaccataatcccttgtcccacaatttcccagcgtccaataccatagggctacctacccaaccggcgggggtcataattaaacataaaacaaccggggcggccattttgggttctaattttcccacctcgtcttcacacttttcccttggaaacggcctgggctacccttttacccccctgccaaaaaaagcattaccaccacccacttccccaactgtccccttgaaaaacccataaaccaaccttttcaccccccggccaagggatttcatcccctgctaaaaaaccctgggtttttttttttttgaaaccccgcccaccctttttaccgtttaattaacccccccccaccagtcttcctttttttttggaatgttccaaccttcccccccgaaaacctggcggaaccccataaggctccc

SEQ ID NO: 72515 - DNA, 359 bp, Triticum aestivum
  Clone ID: PAT_TA_72515
ggaaaaaaaaaaaggggttggttttttttccccaggttgaaccaaaaaaattcggggttttacaaaaaaagggctggcactttatttttttcccggttcaacaacccaaccatgggcttaaaaaacgggggtttatattttttcccccaaaggtcttttctttttaatttatacccaaaaaccccactggggcaatggggccatttgggggggatttaaacttgccccttggggggggcggttcttacgccaggggccttttttccccaaaccggggccagttttgggggttgaaaaaaccccgggcccggggggttttcctaaaaggggggaaaggaccccccccccaaggaattttt

SEQ ID NO: 72516 - DNA, 396 bp, Triticum aestivum
  Clone ID: PAT_TA_72516
ggaaaaaaaaaatggggttggcttttattcccatgtttgaaccaccataattcgggttcttacctgaaagggcatggcactttattttttcaccggttccacgaccaaaccctgggctaaaaaaacgggggttcatatatctactactaaaggtcttcttttttcaattaatacccaaaatgcccactggaacaacggggccatttggggggatataaaaattgcacattggggggtgcctctttaacccctgggtccttaattccccaaactggggcaattgttgaaggtggacaaaaccctgggcccggggggtttgctgaaaaggctggaaagaaccccggcccgaggggtattggtgttgagggtcccggaaagaaacccggcttaaccggg

SEQ ID NO: 72517 - DNA, 356 bp, Triticum aestivum
  Clone ID: PAT_TA_72517
aaaaaaaaaaaagggttttttttttttcccccggtttaaacaaatatatttggggtttttaaataaaagggctggtcttttttttttttcccccctccaacccccaaacctggggctaaaaaaaggggggtttatttttttcccccaaaagtttttttttttccatttaaccccaaaaatccccccgggaccaagggggcaattgggggggattaaaactttgcccattggggggggcctctttacccccggggtccttttttcccaaaacgggggcattttttgggggggaaaaaacccccgggcctgggggttttcccaaaaggggggaaaggaccccccccccgagggatttt

SEQ ID NO: 72518 - DNA, 392 bp, Triticum aestivum
  Clone ID: PAT_TA_72518
ggaaaacccgaaaatttatttaattaacgggtttttacccggggtaatacaaattaccaccccttgggtacaaccttaaaccccattttggggttccattttttccaatggaaaaacccccccccttttaaaattgcccaaattttaagggaaagggggcctgggtggccctttttttacccgggaaccaaaagggggggggaaaaaactttttttttttaaaaaaaaaaaaaattttttgggattgacccaggggggggccattttaaccaggggtttgggaccccccttttttattgtttgggggcccatgggccaaattggaccccccaaaattttactggtgggggggggcttttccaataaaaactgaaaaaaggggcccccccttt

SEQ ID NO: 72519 - DNA, 618 bp, Triticum aestivum
  Clone ID: PAT_TA_72519
ggacgcaaacgaacagctggggtattttccaatgacttaatgccacaatgatgtaaacaaatggaggcaaaaggataggtcagtagccgattgtacaacaccatgtgggtacgcctggactgtctttacaattaagccattagtaacttcaggatgcagatttcgaaccacaaaaaaagagatgatgagactggaccaaggatttaaaagtcgatcgttcgcttgaagtttagtcttactactgcacaaaagccaactgccaatttcccgttatttgttttcctccactatctcacacacctctttttaaccaactgttggagctgcatctcaattctcacagctcctcccttcactctcacaattgtttgtcgttgcttcacacaacacatacgcaccaagagagagacactcagagatttgctttggccaaaggtatttctccttggtggcactagagactagtacattgtttttcctgccctcgcagcgttctcctattctcactacttcttttatatagcaaacttgatcacatgaataggctgttagactcggctaaacacacgcctcgcaccaccaatcctggaataacttcaataacccatgactcgacca

SEQ ID NO: 72520 - DNA, 465 bp, Triticum aestivum
  Clone ID: PAT_TA_72520
attttattcaaaaattaaaacacctatttggggcgggccacacataactttggggaaccctttttttgccccccttgcttcaacttttccatcaactaaacaacggggacccaatttttttttactaaaaatttttctttataaaaaggccccaactccgggcccaacgtcaaagggccccctagggggggttttgtacaacggcccattaaccctgcacattttgggcagaatccggaccccaatgaaagtcttcccctaaacctgaccttttggggggggctgaaaaaaggccccctggcccaattgtttttgttaaggtttttccccaatttcctcctccaactgctgttggggttggaaaacacattgccccacctgtgggggttcctcctcctaaaattgaatgaacccctaaccctgttgtttttcttccaggataatggattaaataataccccggtt

SEQ ID NO: 72521 - DNA, 479 bp, Triticum aestivum
  Clone ID: PAT_TA_72521
ggaaaaaggccagccccaaaggggtaaaaccccaaataaaaaattccccggccgggattatcactggttttttggaaaaaaaaacaggaattggggggggggcggggataaaaaaggggggcccaattgggaaaaaagggattttgggcccaaaaagccaaaaaaaaaaaaaaaaaaagcatcccccccgggctttcaattcaactatcgccaaaggggccccgggggcaaaaccattgaatcccctttgggccaaaactcccccccccccggtggggcttaaaccaaacctaaaaacccgggggaaccttatttccgggggggccctggaaaaattttgttcccaaggaacctaggcccggcctaaaaaaaagggggggggcacccacccccttttttagcacccaacgggaaataaaaatttaaagttggctttggggcacaggaaaccttaggccccggggaaacccggggaaacc

SEQ ID NO: 72522 - DNA, 434 bp, Triticum aestivum
  Clone ID: PAT_TA_72522
cacaaaaggggcccatattaaacataaaaatgaatcaaatcatgatgggacacaagggcagcgtatttgcaaacccgacaaacacaacacatgcttgacaacactggacaaaaaccacgatacttgaatactgcagcaattacaagcaatgggaccgtcaacaaaagcgaggggacaaaaccaataaaaaaataataaccccccaaaggcccagtccaacaaaagcaacaaacaccaggggctaaaaatgttcccctatggagctcatttgaacccaccaaactgatacttgtgggaatttgccaaactctcaatgcccccgccttgcgtaaacggaggaattccaaacattcctaggccaaatccccctgcacccatgttccatgaggggtggccaaatcccccggcacccatgttccatgaggggtggctaa

SEQ ID NO: 72523 - DNA, 514 bp, Triticum aestivum
  Clone ID: PAT_TA_72523
ggaaaaacccccaggggtttattcaaaaagaaaaaaaaacccaaaaatccaagggaatttgggtcccattaaaaatggcctttggggcatttattggttttaaacaacactattggggggggccccacaaaaaaaaaaaaaaccggggggggggaaccaaaaaactttgcccagggggaaaaagggcccaaaacaaaacaaaagtccctggttttttcccagggccaaacaattttttaacataaaggcttaaggcggccccaaaaaaaggggggcccaagggggcccaaaaaaccgacaccgggggccgggttaaccataaaaaatccagggggggccccgggaaaaaagaaaccatttgggcccctttgaccccataaaaatttaaccccggcaacggccggagcgacagttttaaaaagggccttttgggttacaaaaggcccttgggccgaggctttaaagtttggacccacagattttttcataaaaattttgccccccgggggggggg

SEQ ID NO: 72524 - DNA, 459 bp, Triticum aestivum
  Clone ID: PAT_TA_72524
ggctgaaaaaggctaacatcacaccccacaaacaaaaatttattctcaggtctgtttccacttgacaaagttaacacaaaaagaatacccactggatgaattcccacgaaaaacactgagccccgaaacataaaaacccggacaatgttcggatgatgccctcaacaaaaataccataacctaaagtaaaaagttcacctggatcctccctggctccctgcttgactttcttgtatgttaaataacaacacttcactcctcgtcatcgccggccaccttcttgaggcgaggggttccgccgaccttgtcgaagggcaccttcatgttgccaaagggtgtgtcaacattgatcttgccctagatgctttacccaattcccctgcccctgatcatgtcccaaacggcaaatcccaggcccttgggcctgaaggggaacgggatctgcatcttggggatccc

SEQ ID NO: 72525 - DNA, 459 bp, Triticum aestivum
  Clone ID: PAT_TA_72525
ggagggaaaaaatcaaaaatccttttgttttcaaatcaccaccttttaattccaaactttggggcgggggggggggggtttacaaggggaacaaacccccttttgtttcccagggaaccaagcaccttcttttacctagctagaaaccaggggagggggggggggaaaattttcggccccgggtcttgtcccgggggggcccctcgggggggccaaaaaagggggcgtgttggctggccgaaatgcagggtcggctttccgggctttccgctccagttgctcccaggggacccttaaaccctcctccggggggggtcgttttttttcgcccgttggaaagttgcttgggcaacccagaaccaattttttgcccttgtaaaaaaacatttttctcactttcatagaaccgttgaaaaccgatgggttccagggcaaacggccttttttttccaaagcggg

SEQ ID NO: 72526 - DNA, 357 bp, Triticum aestivum
  Clone ID: PAT_TA_72526
gggaaaaaaaaccaggggggggtttttttccccaagttggaacaaaaaaggggggggttcttacaggaaggggcggggcaaatttttttttccccggcccaacacccaacccgggggcggaaaaaagggggtttaatttttcaagcccaaagggttttttcttcccatttagccccaaaaaccccaaaggggccgggggggcaatagggggggggggaaacttggcccattgggggggcggcggggacccctgggctccttattcccccaaacgggggcaagtggggggggggaaaaaaccccggggcccgggggttttggggaaagggccgaaaggacccccgccctaagggattt

SEQ ID NO: 72527 - DNA, 379 bp, Triticum aestivum
  Clone ID: PAT_TA_72527
gggcaaacaaaaactttggtgggctttttttcccaaccttgaactaccccgggccgggggcccccatgggggggcccccccctttttttggcaccgttccctcgaggggggccccacctaaccaacgatgacccctctccctattagtttagcccttcagtttttcattggcccccaaggcccccaactttgcgggcaaagggggcccccatgaggggccccccgggggggacatcccccttgcccagggggggaaaaatttgcacccccaaggatctggccccccccaattgacccggttgttggggggggataaacccccggccttggactaaaaaaccttgacccccctgtggctgctgaaaaaggggcaaaaaaa

SEQ ID NO: 72528 - DNA, 415 bp, Triticum aestivum
  Clone ID: PAT_TA_72528
ggaaaaaaccggggttggtttttttttcccaagttggaactaatatagtgggggtttttacatgaaagggcggggcaaatttttttttcaccggtccaacgaccatcccggggactaaaaaaagggggtttaatatttttagacctaaagttttttttttttcatttagccccaaaaatcccaaagggggaaagggggcaattggggggggggtaaactttgcccattggaggggggggctggacccctgggttccttatttccccaaacgggggcagttgtgggggggggaaaaaccccggggcctgggatttttgctgaaagggccggaaggaccccgggcctaagggattttgttgctgaggctgtggaaaggaaacccggcccaaaagtgggggggggggcttttgggggg

SEQ ID NO: 72529 - DNA, 356 bp, Triticum aestivum
  Clone ID: PAT_TA_72529
aaaaaaaaaccggggtttgtttttttttcccaagttggaaccaatatagggggggttcttacaggaaagggccgggcaaatttttttttccccgctccaaccaccaaaccaggggcggaaaaaaggggggttaatatttttagacctaaagttttttttttttcagttagccccaaaaatcccaaaggggccgagggggcaattggggggggggtaaaccttgcccattggggggggcgtcgggacccctgggttccttttttccccaaacgggggcagttgttggggggggaaaaaacccggggccggggggttttgctaaaagggccggaagggcccccggcccaagggatttt

SEQ ID NO: 72530 - DNA, 346 bp, Triticum aestivum
  Clone ID: PAT_TA_72530
agggccaacgggaaacatcacccattaccccaggggggaatcaaatttatccttacccattacattagtacaacatcaaattatgtttgattagggcttcccccaatttttacattcagcaacgactaccaaaggaaccaaaaaaggggggttgaccattagctttggggacccaaaaccttttatttaacttattccccccgctactatggggggggaaaaaaaagggttgcctactaccctaacgctactacgggggaacttattcactttaaaaggccgggcacacccccctggttaaccgaaaaccaacccagggtttttttgacgggtggtgcccctgaac

SEQ ID NO: 72531 - DNA, 406 bp, Triticum aestivum
  Clone ID: PAT_TA_72531
agctggaccccaaagcttttttattcacgggcgggggggcaaccccaggcaaaaatccattttttccggtttatgaaaacactcatacaaaaacacaaggggtgggtctttcgcaccccgcttaaaaaatgttaccaggccgcgccgggggggggggtaccacctttacttggacggggggggcaactcgcctttcttgaaaaaggaattctccggggggaaacccccccccttgaagaacctatccaaaagggtctttactccagccggggacctaaggggggcataaatgggagttccaaaaaagggggggggcattgggggattaggcatgtaccccccggggggaaccttggggggggggggggggaaccaaaaattacctccatatccaaaaaggggaccg

SEQ ID NO: 72532 - DNA, 298 bp, Triticum aestivum
  Clone ID: PAT_TA_72532
ggcccgaacgaaaaaaacccaatccagctccataattttcacccccccgggaattaatccccccaggggtaggggatatataatcgcccggggggatactacgggcggaaacgcttgggttacgtacgtgggatcctacggggtttttggggggggggcctcgtccccggggtttcaatggggggccccctcctggggggggaaccccccccggagggggggcaattcctcccggagcccggcgttgtcccgggccacctgggcgggcctggcctgggggggggtgaaccccaaaaaa

SEQ ID NO: 72533 - DNA, 306 bp, Triticum aestivum
  Clone ID: PAT_TA_72533
aaccccagcattaaccattttttttaattccatcgaaacaacgggtttatttttttggacaataaaacggggaataaatccctcaccaacagttaaacaggagcaaaacacattttagtgggagtaaccaacactaaattcttttttcctttttaaaaaatatacccctggacgctaacatttattaccaccatgtcccacccccgggccttaaaccttgacaatccttttggggaaagcgcacgcgcgcgcgccacccgaaaaaaacctaccttgtccccgtcgacgggccaaagggggaaaagg

SEQ ID NO: 72534 - DNA, 403 bp, Triticum aestivum
  Clone ID: PAT_TA_72534
aaaaccaaaccgcctaaggatccaattttgggggcgggaccgggaacccaaaaaaaaacccggaccccaaaccggggtggaaaaaccttcttcacccccaccaaacccccccaggggtcaaaggaccccaaattaacagggggggcccgggcccaatttccggcccccccttaatccccacaagtccttaacgggggggggggccccaaagggggggggaaaaagggtttttacaaggggcaaaaaaccccctttagggaccccccttccctttttttttggccccccaactgggccccggcgtttttaaccctgaaaaagaggaccccgacaaaaacgggaaaaaattcgggaaaaagggggcccccccccctaatgaaacccagggccccggggggccccc

SEQ ID NO: 72535 - DNA, 156 bp, Triticum aestivum
  Clone ID: PAT_TA_72535
gacaaaaaaaccccctgaaaatttcaaaggcctagataaagctttatttacacaaacttcccccgggagtttgttggctcgctgccacttatttacctaaaaacaaagcctgttattttttacgggggaaaaacaaacaaattttactttggccca

SEQ ID NO: 72536 - DNA, 368 bp, Triticum aestivum
  Clone ID: PAT_TA_72536
ggccaccaaacaaaaacttgggtggtcttttatccccaacctggacccaccccgggggggggccccccatgaggggcccccccccttttttggccccccctccaacgatgggggcctcacctaaccaacgaagacccccctcccttttaccaaaaccctggcttttttaatgggcccccaaggcccacaactttgtgggcaaagggggccttggggggggaccccccaggggaaacatcccccttcccccgggggggaaaagttcccaatcccaaggaccggaccccccccaattgacccggttgtgggggggggaaaatcccctgcccctgaacaacctgaaacaggggcccccggatccgcccccc

SEQ ID NO: 72537 - DNA, 376 bp, Triticum aestivum
  Clone ID: PAT_TA_72537
aaaaagggcataaatctattaaaaattccgggttatccatctgaagggacatttacatttggggactaacaaaaccaactcgtacgttggaagggactggctggaatttttatctcctggccttggggttaaacttggcctttgcaagcaaacatcaaagcattccctcccctgaaactgcacaatcatcaccctggtcttggatgggggcttcctacccatgaaagttgcaaatgttgccaaatcccatgttttcgggccccccccttttgggagtcgtcttggaaatgcccactccacctaaaaaaatcgccctgaccaaaatcatgggggacaatttgaaaatgataaatgatgccccccctaaccaattgac

SEQ ID NO: 72538 - DNA, 302 bp, Triticum aestivum
  Clone ID: PAT_TA_72538
ccccctgaaaacattcccatccaaaaaactttaggttgggaccccttatttcccaaacggcccctaaacgggtaaaccttctgctccccaaagtaagggcaacaaacaacatgattaattttcggacttccccccaaaaaaaaaaaacatgggggccctagaaaccctgctttttacagggaaaaccccccctttacaaccaaaaaagtttccaaccctgtatttgggcaaaaccgggagggggccaaaaacaaccaggataccttcccccccccaggcctgtttccccagcccgggggaaa

SEQ ID NO: 72539 - DNA, 244 bp, Triticum aestivum
  Clone ID: PAT_TA_72539
aaaacaaaaccttcccacggttttcaaatttctaaaaataaagggcaccgggccccaaacagaggcctcagggctagccccctgggttttttccgggggccctgggatttcaccccttgggaaaatttaaagggcggggtaaataccccgatggggggggttaaaagtttaaccccaaagggggcagggggcaagcggggcccccagttcgcccataaccccggggcaacggcccctggggggg

SEQ ID NO: 72540 - DNA, 365 bp, Triticum aestivum
  Clone ID: PAT_TA_72540
ccaccgctacaatgaccaaaccttggactaaaaaaacggggtttaatatttctagtcctaaagtttttttcttctcaattactaccaaaaatcccaatgggcccaagggggcaatatggggggatgtaaactttgcacattgcaggtaacgtctgaacccctaggttccttatttcctcaaacgggggcagtttttgaggctggacaaaccccgggccctggggtttttgctgaaatggccgaaaggacccctgccctaagggattttgttgctgaggctgttgaaaggaaacctgcctcaatagtggtggtggtggtttttgtggtggagccaaaataataccatgaccaactttggggatggc

SEQ ID NO: 72541 - DNA, 314 bp, Triticum aestivum
  Clone ID: PAT_TA_72541
aaaaacccaacccctcaatttattaaccttaacaaaaaaaatgaaccgccctatgttcaaatgtataaaccccaaaaggaaacataacttaaaaattattattatcaccatccggcaggaccatcctaaggttgccgagggcttcatcatcggcacaaacaaagggggcccaataccttggtggttgcctccaggcccaggctttaacaccccttgagggggggataccccttggcccccttgcaaacataacctttaaaattcccgtaatcgttataaagggggttgccggccaccaccacccatggaaaaaa

SEQ ID NO: 72542 - DNA, 449 bp, Triticum aestivum
  Clone ID: PAT_TA_72542
aaaaacacaaaatcttgggtttttgcatcacccccaccagtttggggcgcaccttacaaaatcaaaaaagggtcaccacaagctattgaccatacataagttttatttataacaaccaactaaccttttgggggcttgaaacaggacaagtcactcaaacaaacccggttttttgtcagggactgggtaaaccgaaaatgaaacccccaaccttttttcttgcccaccgtaacttattcaccgttgcaacgatgaatccccccacaggggacagtcttttgttttgcttttcaccactcaatcaaaacaagccctagctataaaaccctaagggtggtaaggaaggccacacaaaattccaggaaaaggagctgaggtccaataactctttgcatatttagcaagtacttgccatccctggtcttggaaagctgaatttcaaacatgat

SEQ ID NO: 72543 - DNA, 388 bp, Triticum aestivum
  Clone ID: PAT_TA_72543
aaacaaaaaaaacccccacgagcatccaagagtagtcaaaacgacaaacaaagctggaagggggaggccccccacacatgggcactaaaaaagggcaggggaaaggcagcacaggggggcacaaccaatcatcacaggggttggatttgaaaaacagggggtctaaaacaggacaccttccttttttaacacggggggggaaccctatcccctcgcatgggctcaaggggggtcgtacggggggagtataaaaaccctcacctgaaagcaaaaagggggccaacctcaaagccggaagcagcctcaaagcgaccttgattggggcacaccgggccgacagcaccatgggtggccaaaaacgaccaagggggacgggaaagcttccagg

SEQ ID NO: 72544 - DNA, 171 bp, Triticum aestivum
  Clone ID: PAT_TA_72544
ggtttttctttttctcacccaaaaaaacttcccattttgcattaaaacggggctttactctaattaccttaaaaactgggaacacacctcccatttattgtataacaaaagtgcatgcattcctaaccaccatgcgaactgcaaaaagatatatcactggctggcccacaa

SEQ ID NO: 72545 - DNA, 486 bp, Triticum aestivum
  Clone ID: PAT_TA_72545
ggatcgcagaggaaaaattcaaagttcaaagtatcaacacacacgtgatccaccacggccacaggcggccattttaacaccacccacgcacaccacttgtttggccagctggctgggcccaccaaccacaggttaggggttacaaaaagttggagccttgtcgagtgtaccccttctcgaaaatacttgatatgcaaaaagtccatcaatatttctgggctggaaaagcctagtaacatgtggcctaactcctcagccttccttttaggaattgagtaatggaaagctattgtcatctttttttagcactgctgcccaattgaataacaatttcacaagagcaacttcatgttcagttcctccaaacccattgatttctatttctgggaggcaatttaatatgagttcctcgcttttccagtttaggggttgatcacaaatgcaacctgatgggcatgtggcttgtgcctgaaatgaggggcatgc

SEQ ID NO: 72546 - DNA, 427 bp, Triticum aestivum
  Clone ID: PAT_TA_72546
aaaaaaaaaggcaggggtccacctttccaaaccagggggggggacaaaaacaaaagggggcccctccaaaaatcccccccccttatttgggggccttcatgaggcatcaaaacagtttcccccgtttttgggggttcccccgctgagggggggcatccggccctacaaatccttaaatttgaaaaaaaacatccccctccccaaaattacggacagacgggccccacaaaaacggggtcaaatttttaaaggcctactttttccaaataccaagtccttttggggggaaaggcaacccccaaccaacagtttgggctttttgggacaaaggacggaacaaatctttggaaaaaccttttccaaaacttaagggggggattttttctaaaaaaaaccccagagcacccccaccctttttccaaaacca

SEQ ID NO: 72547 - DNA, 263 bp, Triticum aestivum
  Clone ID: PAT_TA_72547
gggaccaaaaccccaaaaacttttaaaaaaaaaaaaaattaactttttcccccgggaaaaaaccctttaaaaaaaaaacaaacttttccaaaaaaaaaacaacggtttcaaacctgaatttaaagccctaaaaagtttttttgcccccgccctaaaaaacccaggccctggtcttttatttaaaacccttggggccaaaaaggggcggcccctaaaaggggtaaggggccctaaaaagggcccaaaaccccttttttggggcc

SEQ ID NO: 72548 - DNA, 462 bp, Triticum aestivum
  Clone ID: PAT_TA_72548
ggaaaaaaactaaaatcttttttgaggacggatggtttacccggggcccttaaaacaatggccctccccttccaacaatttccgggaaagcgtttgaatgctaataaaaacaatttagtccccacaaaacagggacaaatcctaaaaaccctggcatgaacccctttccgggatgaaattttcgggaacccccacaaagcaaacttttccccaccctatgaatccggcccataaaggcctaaacaaaaggccccccaaagtaatgcccaaagggaacccctttgggcgggggggaaaacctttcatacaaaaaaaaattccccaaaagcaaaagatattccccaggggcctccccagcaccgatcccaaaacatagagcgggggagtaatccaaatttgtcccttggggctgggaccatgcccctaaatttccacaggtgccaacttccaactaccaaaagg

SEQ ID NO: 72549 - DNA, 445 bp, Triticum aestivum
  Clone ID: PAT_TA_72549
ggaaaaaaaaacccccccctttttttttgaaaaaattataacaaacgggtttttttttttttgggatcatccaaccttttttaaactttaaaaatttccccccactttttttggttccccaaaaacaaccccccctaaaaattaaaacgttttggggtttttccccccccccgggggaaaccttttcccccttttaaaaaccaaattttaattttcccataacaaaaaacgggttgggggccccccaaaaatttttcccccaaaacccaaaaaggcccccgggaaaaaaaaatttccttggccgaaaaccccttaatcccctggggaacccccccctcaccaattttaaaaattttttgtttgggggtaaaaaaaaattttttccccccaaggaaaaaaacaattttaggcttggttcaaattttccccaaacccaaaaaaaatt

SEQ ID NO: 72550 - DNA, 268 bp, Triticum aestivum
  Clone ID: PAT_TA_72550
caattattaatggctctttaataaccacggccattcccccatggaggatgggaataacaggccccccttattataaaacctcacacttggcatcaaccaatcacttacccaagtaaaccgggccggaaaaaaaaaccctaccccccgggggctcaacccggcccccggccggtacccttcccttcgtaaacctaacccaaccggcctggggtttttgttgccccccctcgccgaaaaatccttctccctgctgccgttggggcctttt

SEQ ID NO: 72551 - DNA, 456 bp, Triticum aestivum
  Clone ID: PAT_TA_72551
aaaaaagctttgttaattaccccaatcatgcacgcaggcgggatgccaaacatgaggaaagctcggagcaagcaaaatcacacaccctttttttatttgacgaaattaaacacaactagcaagttaactacatacatcacattcataattccccttgggcacttttctttttgaaacaaaaaacaatctttcggactagctagcaaactgcttacaattgatcttttcatcaggggctcacgcagctcatgcatcactccatgaagttgtaggaggaattcctttccgggatccacccgccgttggggccactggtggtgcctacaactcccctttgctccggggtgtaaagctgcagtttaggcggcctgaggaatttgatctgaggctggtcggaggggtggaggtggttctgcatctggctgaggaaatccaactcccgctgcggcgggttgg

SEQ ID NO: 72552 - DNA, 371 bp, Triticum aestivum
  Clone ID: PAT_TA_72552
caaaaaaacggggcaatcaaccggtcccaacaacaaaaaactttgtccactttttttcccaaaccttcacaaaacccttgtccttcgcaaccttacccaaacccttacccccaaaacccccgacctgaaaaaaactaggataaagccaatttctccataaaaaactttggcgccccctgggacccacccaatctaaaccttttttcccccttgaaaagcccttctccgggggcgggaacataaacttttggaccatgtctggctttggcattaaatcactggggggcaggcccatttgttttgggccctggaaaaacataattttctccagggttggcctagtctcaggacccaaatcaaaaacctggcta

SEQ ID NO: 72553 - DNA, 179 bp, Triticum aestivum
  Clone ID: PAT_TA_72553
gttgacaacaaaggccatgattggagatcctacatatatatccgaccatacaccaggtgtttgtgtttgactacagggttggcccaccggtgtgttaccacagaacattttcaagcccaaccaatccatttctctttgtaaaaacccttaacactggaacaggggaggctcactgccca

SEQ ID NO: 72554 - DNA, 363 bp, Triticum aestivum
  Clone ID: PAT_TA_72554
aattcaaaaaaatgctttattctggaacatttattcgtaatttccatattgcaacttgttcttgccacacatgatgatgcatgacatttttattttgccaccgctacataaatcatttagcaccccccaccagagacggtagccaccaatggaatgctgatcggggggggggcggggcattgaactgggatgcataggctacccatcccccggggggcctgaacccacttcctgatgctttcaagatgccccggctgctggggctggtacataccctgccattgttgtcggggttgttggtgcctgataccctcccccacgttggggatggcttggccccggaattggtttgggatctgtgaa

SEQ ID NO: 72555 - DNA, 160 bp, Triticum aestivum
  Clone ID: PAT_TA_72555
ggcaaaaaataacttaattggcctttttttcccaaatttgaacttgggcccgtctagcccacacatgatattgcattgccctttatttttcaccggtacagggatcggaccattgactaaacatgggggggccatttttgggatactaaaactttcgttt

SEQ ID NO: 72556 - DNA, 308 bp, Triticum aestivum
  Clone ID: PAT_TA_72556
aacccaaaaaccatactagcggttcgccgggaaggggccccgggttacccaaaaaaaaaacccgggggcacgagcgaccccccccgggggggcgggactattaggggccgggttaggggggggtactactacgggggggggggggggcacgggatcaggcaacatcacttcagggggggggggtattccgggattacattatactaggcccactttatctatatcgggggctactggggagcagcgccccagcaaaggggggcgggggggcatcccggggccttttttggggaaaaaaaaaccatcgc

SEQ ID NO: 72557 - DNA, 414 bp, Triticum aestivum
  Clone ID: PAT_TA_72557
atggaaacaaaacaggggttgggcttttattcccctggtggaaccaaaatagttcgggttcttacatgaaagggcctggcacttttttttttccccggtccaacgaccaaaccctgggctaaaaaaacgggggttcatatttctccccctaaaggtcttcttttttcagttagcccccaaaatcccaaaggggccaagggggccatttggggggatttccccattgcccattgcagggagcgtctggacccctagggcccttattgccccaaacgggggcatttgttgaggctggaaaaaaccccgggcccgggggttttgctgaaaaggggggaaaaacccccgccccgagggatattgttcctgaggctgttgaaaggaaacttggcccaacgggggggggtgttgttgttg

SEQ ID NO: 72558 - DNA, 376 bp, Triticum aestivum
  Clone ID: PAT_TA_72558
aaacaaaaaaaaactttggtgggtttttttccccaagcttgaaccaccccggggggggggcatacatggggggccccccccctttttttttcatcgttccaacggggggggcctcacctaaccaacgaggacccctcccccttttaccataaggcttgcttttttcatgggcccccaagggcggcaactttgcgggcaaaggggcccttggggggggaccccccagggggaacaaaacccttgcccagggggggaaaaattcccaataccaaggaccggatcccccccaattgacccggttgttgaggggggataaccccccccccctggatgacccggaaaaggggccccatgacctggaccccttggggggggg

SEQ ID NO: 72559 - DNA, 299 bp, Triticum aestivum
  Clone ID: PAT_TA_72559
aaggggaaaaattgttccactctggcaaaaaaggtcctgccctgaaaatcatcaggcaaagggggacccacaaccctaattcatcccccctggaaaaaccaccaaaaaggaccctccctcccaatggccggttgttcggggggaaaacaaaagtttttaaaaaccggagggtttctttttttaaaaacatccaaaggaccacccccccttcaaagggggattccccccagccttgagtgggccaaccccttttcctttaaaacctccgggggggcccaatccttttttttcctaaaaaa

SEQ ID NO: 72560 - DNA, 492 bp, Triticum aestivum
  Clone ID: PAT_TA_72560
ggcacacaaaacgcccggaacaatcaacaccccacaattatccccgcacatttaaatctaacagccatcattcatttgctgcctggacgggggggacttacaaaatacccttgactgaccgggctccacctccagcaccccccatccaccccctaaaatcaccccgtactccaggtaaataaggaaacaacattaattcgtcatcacaccaccctgatctcctggtaaaataaggaaacaaaattaattcgacatcgcaccggcgcaccatcgccaatggcatcaccattggtgccgaccaacggggaaaccgtccgcaagcagcgtcgtttccttccccgagggccccagggcagcgaccccacaaaacttccaacaagggccccagggcagcgaccccagggaacccccaagatcctgccctcgcaggggggcatccctacgggaaaaccccactggtacagcccgccctgcccgtcgaaaccagccgga

SEQ ID NO: 72561 - DNA, 259 bp, Triticum aestivum
  Clone ID: PAT_TA_72561
aaaaacatgtgggggggttaaaacaggccccacaatccaaaaggggggggcaataatcaacggggggccaggccaacctgcgtaccaaataaaaggggggcaaaacccctcaacatggaatacaaaaaacccccccattgggcatgagggaggggggccccaccccttggaccgaaaatgaggaaaatatttcgcaactccatataaaccacaaagcgggggaactaactcataaaacggggatgtaccccacccttat

SEQ ID NO: 72562 - DNA, 324 bp, Triticum aestivum
  Clone ID: PAT_TA_72562
gccacatgcaaacactacaagccagcaggtcaggtcaaaaaaaaatacatattatacatagcttaatacggagttcacagggccagctaggcatccactctgggctgaaatgatgaaaattatcccatggattcaactggattctcaggcactgatcatgtctcgcccagcaaaccgttttcaacaggggattgggtgccccttattgcagttttctgggcaaaaaatcaaagttgccaatgcaaaggcttcattttttttcataaacatctcaaccactgagctgttaatcatgagggcgttttagggccattgacaggaaaa

SEQ ID NO: 72563 - DNA, 390 bp, Triticum aestivum
  Clone ID: PAT_TA_72563
gcaaacaaaacatgtgtttgcctttaattcccaagtttgacctattatacttcgggttcttacatgatagggcatgtgcactttattttttccacgcggtacaactgaccaaaccatggactaaggaaacggggtttcatatatctaggacaagtccttctcttgtcagttaaccccaaaaatgccaaatggccccctgggggtcgaccaatatggagggatgtaaacattgcacattgccggtagcggctgccctgccaaattccttatttcctcaaactggggaagttgttgaggctggacaaaggcctgggcctgggggtcctgctgaaatggctggaaggatccctgaccccatggatattgttgctgaggctgctggtaggaaac

SEQ ID NO: 72564 - DNA, 341 bp, Triticum aestivum
  Clone ID: PAT_TA_72564
acaggaaagggcagggcactttattttttcaccgctacaacaaccaaaccagggactaaaaaaacgggggatcatatatctactactaaagttcttcttttttcagttagcaccaaaaatgccaacgggagcaagggggcaatatggggggatataaacattgcacattgcagggagcgtctctagccctagggtccttatttcccaaaacgggggcagttgttgaggctggacaaaaccccgggcctgggggttttgctaaaaaggctggaaggacccccggcctgagggatattggtgttgaggctgttgaaaggaaacccggcccaaggggggttttt

SEQ ID NO: 72565 - DNA, 342 bp, Triticum aestivum
  Clone ID: PAT_TA_72565
attaaaaaaaaaaatttttttgctttttattcccaagtttgaactaattttgttcgggtttttacataaaagggcatgtcactttattttttcactggtacaacaaccaaaccatggactaaaaaaacggggtttcatttttttagcactaaaatttttttttttttagttgggaccaaaaatcccaaatggcccaaggggggtccaccaatggggggggatttaaaccttgcacattgcaggtaccgtttgtaaccctaggttccttatttccccaaactggggcaatttttgaggttggacaaaaccctgaacctgggggtttacctaaaaagggtggaa

SEQ ID NO: 72566 - DNA, 385 bp, Triticum aestivum
  Clone ID: PAT_TA_72566
aaaaactaaaataacatgccacattgagctaaaagttttaagtgggatccacaactttatttattattacattttttaacacttgagctccagctagccatactaaatagaggggcatacaagttttcaggaaatacatagctttaaattatatgaggttcattaattccacccccccatttgggccttctagggcatatatatcattctaatattccgaaattcaccatatgggtagtggaagaatagccctcgccggggtacccttttcctcacctattaaaattcacgtataaaaatttttatggggataaaggactgggggacgtaaattaattctcataaaaaaatctttgatttgcataaaatcaagtgggagcatgaa

SEQ ID NO: 72567 - DNA, 463 bp, Triticum aestivum
  Clone ID: PAT_TA_72567
gtaaacaaaacctgtgtttgtcttttattcccaagtttgaactagtatagttcgggttcttacatgatagtgcatgtcacattattttttcaccgctacaacgaccaaaccatggactgagaaaacggggtttcatatatctagtactagagttattttcttctcagttagtaccgaaaatgccaaatggcgcgatggtgcaatatggagggatgtagacattgcacattgcaggtagcgtctgtagcgctaggttccttatttcctcgtactggggcagttgttgaggctggacaaagccctgggcctgtgggttttgctgaaatggccggaaggagccctggcctaatggatattgttgcaaaggctgttggaaggagacctggctcgatggttgttgttgttgtttttgctgctgatgcaaaataatagcatgaacaacattgtggatggcctggcactg

SEQ ID NO: 72568 - DNA, 444 bp, Triticum aestivum
  Clone ID: PAT_TA_72568
gggggaacagcatgaaacacacccagtcaaaagggcagtcacattacaccgaaaaaactggataaaaagggcccgggaggggtgccccatgttaaccttaattgggggggcaacactgatacctcattggacaaacaatctaggactaaaaggaaacatttacatgattaagtggctgcttcttggacaggggcatggaaaaaggccatttttggacccccgtttttttccaaaccccttcaccaaaaaggaaaaactaattgggggccaaaaaaagttcgtccccacgggggactttataatctacagggccatctgaattaacaacttttgggtttggacgaaaccaattttgggcgcaaaccaatccctaaaccggggaaggggccatagtactgaaatactcattcagcacccgggcttcactggccagggggatgaaaa

SEQ ID NO: 72569 - DNA, 405 bp, Triticum aestivum
  Clone ID: PAT_TA_72569
aggggaaccccccccacgtttattggataactaaggggcatgcctgcccaacccccaggcaagcgggaaaaagttctatcacggccggggcaaaaagggggcgctgccccccacccggcaaattgccgggagctgggcccgaagctggtgcccctttgccacctttaggggggcccccggggacccccccccaaaaggggaggggcgggggtaaccttggggcccttggccgggggggggcccttgcccggggggccaaaaaaaaaggggggaaaccccttggggcccttgcccggaaggaggcccttggcccgacgggggggaaaaaatgggatagtccccttggggcccttggccggggggcaaccattgcccgggcgggggcccatggccgggggggggccc

SEQ ID NO: 72570 - DNA, 606 bp, Triticum aestivum
  Clone ID: PAT_TA_72570
gttcactgcatatcatcctgtatcattaataacgctcagcaaggcatgagccaaaaagtgctccaaagagatcaatggtcatcagttaattcagtgctccacaaatacaacaaggttcctacataccacaattcaccctgagcttggaagtagcccatcccttgtcatgccacggaggacatcaaccacagcgtccacgttaccttctttccgattgagatcaataaaagccttcgatgtttctgcatctgctagcgaacagcaattcagcaactcctgaatcacggtatccgcttcgacagtcatcccctcttcaaataggcccctaaccaatgaaatggtgcttgttgaattaggaggaaaaccacactgcagcattttcttatggaagttgagagccttcaaaacatttcctccccgacaatgcccatgaatgagtacaccatacactgaaccatccagcttccaatctctgtccaacattgactggtaaactttgtcagcttcattcatcaagcctttcatggaaaatcccttaagaagagccaccacgctcttaaactcagctttcctgcaacaacgcatcagggcctcatatttaatatt

SEQ ID NO: 72571 - DNA, 438 bp, Triticum aestivum
  Clone ID: PAT_TA_72571
aaataaaggagtttcatcacaatacatagggatccctggcacagggggggccaacccttaattaggggaaaaagtggatggggcgggtataaaaatccccccattcagggaagttctagttatatcccacggatatctatatagcttcaatccccctggaggggaaaggaaaaaccacccagctttgcgggggtgcatccatcaccttccaacggagttaaaactttgggggccccccggcggggagtaaaactgaggctgctgctgcatgaaattaaaccgcaggaaggttctcggatcacaagggaacatatttggctcggactcattcgagggcaaacccgcccccatcatgttcaacggcggggggggccccctttcagtctcagctactttttccctaaaaaaaaagtggttattctgcagctccatttccct

SEQ ID NO: 72572 - DNA, 417 bp, Triticum aestivum
  Clone ID: PAT_TA_72572
aacccaaaaaaggcccaaaaaatttaaaaggccaccaaaattaggggggaggccattttttaaaacataaaaaaaaaaaaacggggccagggaaaaaaagggggaaaaggcttaaaaatggtttttacttccccaaaaaagcaaaaaggggtttataggggcataaaaaaaacggggacaaaaaggggcaaaaccaaaaggggaagccaccttgggtggaaaaaaaaaacttaacgggggggaattatttgggggaaaaaaaccgggaaaaaaaaaggggggccaaggcaaaaacggccaaaaaaagctggttataagctggaggggggatccccttttccagctaaggccggaagggcctgaaaaaaccctgaaaaggccaggggggaaaatcccaggggggcaaaaagggggggc

SEQ ID NO: 72573 - DNA, 347 bp, Triticum aestivum
  Clone ID: PAT_TA_72573
aaaaaaaaaaatgggttggtcttttattcccaggttggaaccaatatagtgggggtttttacatgaaacggggtggcactttattttttccccggtccaacgaccaaacctggggctaaaaaaacgggggttcatatggctaccacaaaagttctttttttttcggttagacccaaaaaacccaacgggggcaagggggcaattgggggggatttaaaccttgcacattgggggggggggctttagccctggggtccttatttcctcaaacgggggcaattgttggggggggaaaaaaccctgggcctgggggttttgctgaaaaggggggaaggacccccggcccg

SEQ ID NO: 72574 - DNA, 543 bp, Triticum aestivum
  Clone ID: PAT_TA_72574
aatccaaacataattaattagtacttaaaggaggaaccaactactacttaacaatgtctattacagttaccatacatattattaattaaattatgattcattcattcattcttcttcttcttccttgcgctccagtccagtccaaaaaatcaccattgtacagtaaagtccaaaaaatcaccattatcttcttcttctcatgatacattccttgtgctcagctcatctcatctcaactaaccacacatttttctgcaaatcccagcttgtcttctccaccctccccctccacaggagcagtccctgctgcaaagctccccagtttcttatcaaattcaaccttctccacattctctgtaccactcgcttctgctgctgcacaaccattcttattaaaagagtcagttgcgtctcctacagcctcgacatgccgaggaggagcactcgctaccttctctgcagcagaagagcccagcttctcagaagaagagtcagttgcacctcctacagcctcgacatgccgatgaggaccactcgctacct

SEQ ID NO: 72575 - DNA, 268 bp, Triticum aestivum
  Clone ID: PAT_TA_72575
aaacaaaaataaagtcctccagggccgagctaaccaagctgcacccccactttatgtttttgccccactgtctatggccgctgacaatgctcagggacacaaaacatccatcgggggtttaacccagccacccccatacttacacaaaaaattacccctagtcaaataaaaaggtgagcccccccacccaaccaaattacaatttggggacggggaccacattcgtgggttggtttttcttctcacataaggcccagcagggcaactt

SEQ ID NO: 72576 - DNA, 353 bp, Triticum aestivum
  Clone ID: PAT_TA_72576
gggaaaaaaaaaagggggtgggtttttttccccgggttgaaacaaataaagggggggttttaacagaaaccgggggggcctttttttttttccccggtccaacccccaacccggggcctaaaaaaaggggggtttatttgccccccccaaaagttttttttttcccagttacccccaaaaaaccccccggggccaggggggcaattgggggggatttaaaccttgcccttgggggggggggcctttacccccggggccctttttccccaaaacgggggcagttgtgggggggggacaaaccccggggccggggggttttgctaaaagggggggaaggacccccgccccgaggg

SEQ ID NO: 72577 - DNA, 470 bp, Triticum aestivum
  Clone ID: PAT_TA_72577
aggaaaccatttgggtattaagggggactttgcatacaacaagggaacaagaaacttattgcccaaaaaaaggtgaattcaccgggcccggacaacaaaaaccaaaacaaattggtcaaatcattttgggatatatggaaacaaaacttcctcgcaaaaggatgattataacgggctggggccgaaagcaaacccaaacgatgcaacataagttaaggcgggttacttggagggccaaacttgccagaaaggtaacgggtcctcaaacttaattcatagtagccatagatgagcccgagcaacactaaacgggatttagtttccaccacaggagccaccccctggcctttttctggaagggaaaccgtttatccaaagaaagctgaagcccatagcgcccctacagggactggattccagttccttggatcaaacccctcatgccggaacatccaaacgttctgggtaca

SEQ ID NO: 72578 - DNA, 422 bp, Triticum aestivum
  Clone ID: PAT_TA_72578
aattttaaaaaaaaaccggggttggttttttattcccaagtttgaactattttagtgggggtttttacatgaaagggcctgtcaaatttttttttccccgctccaaggaccaaacctgggactaaaaaaacggggtttcatttttttagccctaaagttttttttttttcaattaaccccaaaaatcccaaagggcccaagggggcaatttggggggatgtaaactttgcccattgcaggaaacgtttgtacccctgggttccttttttcctcaaacgggggcatttgttgaggggggaaaaacccctgggcctgggggttttgctaaaagggccggaaggacccccgccctaagggattttgttcctaaggctgttgaaaggaaacccggcccaaaagggggggggggggtttttgggggg

SEQ ID NO: 72579 - DNA, 355 bp, Triticum aestivum
  Clone ID: PAT_TA_72579
gggccaaaaaacccttcccttttgaaaaattccggggccccacctttttttctttaaaaacgggaaaccccccccccttttttgggggggcaaaagggcatccgggccaaaccccctttcgaccccgggaaagttcttttcccggcgggcaaaaaagggggcccccccctcaacccgcaaaaatcccggcctttgacccgggacccacccccccttcccccccttaagggcgcccccggggggcccccccccaacggggaataaccccgaaaccccttgggccccttacccggaacagggcccttgcccccctggggcgaaaaaaatggggggggccccaaaaggcccccccccc

SEQ ID NO: 72580 - DNA, 362 bp, Triticum aestivum
  Clone ID: PAT_TA_72580
ggaaacccccaaagggccaaaaaaaacttgggctgaaaaaaacttttttttttttttggtgaaaaataaaaaaaacgatggggggggggcaaaaaaaaaaatggggggaaattttttttggaccggggggataaaataatcccgacaataaaaaggggggccccaatttttattaacaaaaaatctttcttaacaaaggggcacaaacccgggggccaaaggaaaagggcccccttggggggggttggaaaaagggccaattaaaacgggaaattgggggcagaaaacggaccccaggggaatgatccccctaaggcgaaactttggggggggggggaaaaaggggccccgggcccaatggt

SEQ ID NO: 72581 - DNA, 451 bp, Triticum aestivum
  Clone ID: PAT_TA_72581
acaaatgccttttttatttatataatcgtctggtctcaaccggcctgaacggtcccacccatgacctctgaaataaccaagtttccccagaaaacaaactgtcctttaaaccaaaaccccgccctattaccccccttttcccaaaaacccaaaccccacccctgaaattttcaaaagccccccctagccctcgctcttcttttttatatatacctttctgtttttgggtttttcggactgcccatcacccttttttttaatttttttgggggttttcatcccccctttttccaaacaaacgggatcttcattcctcatccaaagtaaaaaagttgaccctcccggaaccaggaaaaacccggcctctctttgtggggtatcaaaaggcatcgcttccgaataaactcctctcgggctgctgcccaaaaataggccccctgccattgctggg

SEQ ID NO: 72582 - DNA, 497 bp, Triticum aestivum
  Clone ID: PAT_TA_72582
gggtatttgcaaactgacaaattatgacatgtaacaacacaaacattatataaactatctacacctctaattcaacactaggaatttgaaaccacaagcctgctacatacaacataaccccatctttatgtgcaacccacagtcccacgcatgactttctgcacctacataagcaagcatctgtttggaaccactttcggtgccatacaacaagaaaaccccgtcaggttcaatgccagtctgatttcttttgttcatagtcaggctcataaagtattttcttgaagatatctgaattgcgaagcttatttctggactcgagagctgaaggttttcttgaattgccccgatgtcccattctgagagattctctcttgtttgcacggaggccatccatttccttcatagcattgggaaagaaaaaattctgtgctttttgaaaaaacatgaatccctcaatatcaccattcctgatgcctgattttacctgaacatgt

SEQ ID NO: 72583 - DNA, 295 bp, Triticum aestivum
  Clone ID: PAT_TA_72583
aacaggcaaacagggagctttatttaaacaagggcctcattcaggaacattgggtaattatttccaggggggaattagtcctaggcccccaggaggaggccggacattttatttggccccgggtttattgaccaactagcagggcccatggggataactagcggcccggggaaggctatagggggggggggggggggctgggcattgaccagggatgtaaattttgcccatcgacggggggggggaaaatgacatccttgggccccaaagtgggccttcctggggggggtgggga

SEQ ID NO: 72584 - DNA, 392 bp, Triticum aestivum
  Clone ID: PAT_TA_72584
ggccaccaaaacattggaggggacggaaaccaaccccccccgaaaacccaaagcgggcgggccaaaacaaaaattttcctttaaggggacccccctaaaatccttccaattccaatgggtcccccccccgggtttcaaaacataaaccaattaattccccccccccggtccaaaatgggggggctgaattatcccccggggacttgggggggaaaaaaaaatatcatgggtggggcccccccctttttcgaaacctttcgttttttttcaaccccccggggatcggcggcccaacccgattatttcccaacttaaatctcggcccttcccaaaaaagttctgggacccttccctggagggggacaaaatacaaccccaatccctttttttgg

SEQ ID NO: 72585 - DNA, 236 bp, Triticum aestivum
  Clone ID: PAT_TA_72585
ggggcaaaacatcattgagtttgacatcgtcccaaaaaatagggcagctttcgatttagggcgcccatgaaaccccaaaacctacccccttgaaattaagttggggcctaaaacccccaacatgagagaggaagtccccagagcgggaacccttaaaaggggaaaaaactccttacccctagcttttaaacatactaataaggggcttcattcagctgccttggcaaccaacttca

SEQ ID NO: 72586 - DNA, 372 bp, Triticum aestivum
  Clone ID: PAT_TA_72586
ggaattgggaccacatcaaattacttactgaataatatctgggtccatatagaggatgaaacaaagggcaaaattttcctgggacaaaaagtttcatgtcatataaaggctttattaacgatatattctggggggcaaaaaaccgatcctttgacaacaatgtagggaaaattcaaaaaccttttagtaccaagttttgggtatagcctactggtccccatacattggcatccattcatgaggcttaaaaggcagtcggacccattcatgataatcccagcttgcccctgatagttcaaattttatcataacattgaaccccaagggggcccagtccatgctcaacggtcgttccaaaaggcttgcaacatt

SEQ ID NO: 72587 - DNA, 408 bp, Triticum aestivum
  Clone ID: PAT_TA_72587
ggcaaacaaaacaggggttggttttttttccccaagttggacccaatttaggcggggttcttccaggaaagggccggccccctttttttttcagggggccaccccccaacccggggcctaaaaacccggggtttaaaaatcaaaaccaaaagttcttcttttttcagttagcccccaaaaccccaaagggcccaggggggggcccccaattggggggggggtaaactttgcccattgggggaacccccggcccccctgggtcccttattcccccgggggggggcaaatgttggggggggacaaaccccgggccctagggattttcctgaaagggggggaagggcccccaccctgggggattttgttgttgaggctcctggaaaaaaacccgcccccccgggggggggg

SEQ ID NO: 72588 - DNA, 430 bp, Triticum aestivum
  Clone ID: PAT_TA_72588
ggcaaaaaaaacaggggttgggtttttttccccaagttggaaccaatttagggggggttcttacatgaaagggccgggcccctttttttttcagggggcccccccccaacccgggggctaaaaacccgggggttaaaaaccaaaacccaaagttctttttttcccagttagcccccaaaatcccaaagggcccaggggggggccaccaattggggggggggtaaactttgccctttggggggaccccctgcacccctgggttccttttttccccgggggggggcaaatgttgggggggaacaaaccctgggccctagggattttgctgaaagggggggaagggccccccccccgggggattttgttgttggggctgctggaaaaaaacccgcccccacgggggggggggtccttcttctggggggggggg

SEQ ID NO: 72589 - DNA, 363 bp, Triticum aestivum
  Clone ID: PAT_TA_72589
aaatttggaaacaaaaccggggtttgtttttttttcccaagtttgaactaatatagtgggggtttttacatgatagggcttgccaaattttttttttcccgttaaaacaacctttccttggactaaaaaaacggggtttcttttttctagtactaaagtttttttctttttttttagtcccgaaaatcccaaagggcgcgatggggcaatttgggggggtgtaaactttgcacattgcagggggggtttttacccctaggttccttatttcctcaaactggggcaattgttggggctggacaaaaccctgggcctgtgatttttgttgaaagggccggaaggacccctggcctaagggatttt

SEQ ID NO: 72590 - DNA, 367 bp, Triticum aestivum
  Clone ID: PAT_TA_72590
ggatcccaaacctttttttttcatgggcgggggcccacccccccccaaacctcctttttttccattctaaaaaaaccctcttccaacaccccaagggttttttttttccccccccgcttaaaatttgttccccccccccccccgggggggggttactacttggacgggcggggaagccccccttccttgacaatgtaattcccccgggggaaacccccccccttgaagtccctatccaacatgtccttcactccacccgggtccctaagctgggcataaattggagccccaaaaatggggggggccattgcatgattaggcctgtaccccccgggggaacccttgggggcgggtggggggaaccaaa

SEQ ID NO: 72591 - DNA, 487 bp, Triticum aestivum
  Clone ID: PAT_TA_72591
aaaaaaccaaaaaaggccattttttattcaaaaaacagtaatcacaaccggccaaaaaaatcaattcggcccggccgaaactcttttgcagggggctacaaactgaaaccatgcctgcaatcattgccccctgacaggctgatttttttgaaaacatgcgggcccaaccataaaaaccccatggccgggggggggccccccccctaatatttcccctcatcttatttcaccatggaccccatggaggacccactgactggaaatatttcaacggtaggaaaaaataacctttacttcacacaggttcccacccccaaagggaaaaaatccaccgaaatcccggtcttatttttgcggggagggaaatggcaaccctcatcccatgaagttgcccaaaaaactggtaaaaaacaagggcccccccaaagttttgtacatttaacatcatcctggcgaggcaaaaaggaaataaaaaccttccaacggc

SEQ ID NO: 72592 - DNA, 387 bp, Triticum aestivum
  Clone ID: PAT_TA_72592
ggaccaacaggcattatttgaattcctttaaaaaacgggcccaacagtggacagaaaacaaaagggacagaaaatagtggaggcaacccccggctaccaacagggttaaaccacaggaatacccaaggcagttaatcgaataatcccccccatatccagggtttaaaaaccgggtacaaccaaaggggggccccattccctccctttagctcccgagtactactaggaaaccccatttatcccccttttccctttaaaattaaaagcccagctgatcaggcatgcaaaaactttcaaaaaagggcatccaccagggtggggatttttcctccccaggccgacttaacggggggggggattaaaaagggccccgaaattcaaattcaa

SEQ ID NO: 72593 - DNA, 551 bp, Triticum aestivum
  Clone ID: PAT_TA_72593
gggggaaaaaaaacctgaattcacaaactggattctttacaaatgacaaaaacaaaaaaaactgaattcctcgacactaacttttgttcccaaaaaacaaaattgccaaaaaaaaaaagaggataacgggatttaacaggcgaatgaacccaaaacttggcccccccctaccataaaacggacaatttcccgcctgggacccctacggggaagcagatgaaaatcgacccatttccaaccttccaaaaacctgccgggcttggattcaacaggaacagaggggacctgaccaatttgaacatgacccctgttttttgttccaccaccaaaggcatgactgtttccaacaattggcagtttcaaacctcccccaatggtaaatgccaaaacggaatcccttttatcggaacaggtaggcattttttccctgggggttcctgcgttttcttcaaaccacctggcaaaacagtttttttttgacaccctacaggcccaaaaggagttctttaggcgtttcaacggtttgatttggggccatttgggaccctcct

SEQ ID NO: 72594 - DNA, 392 bp, Triticum aestivum
  Clone ID: PAT_TA_72594
ggaaaaaaggggtgtaatttttttttttgttaaaaaccttacacatgaccttaaataaaactattttttccaattctttggctacggggccaccaaatttttcataacagttttttttaaaaaaaaaggggccccctgggggaccccctttggggggggacaaaaaaccctggggggaaagggattatccttgcaaaaatcggcatcggtgaaacccccttatttgtaaccaaaattcccacttgggttacgggaatcggtatcatcatccttccttggatagcaaaaaatttctccaatgggaacactgggcccaatatccttttggattccttaaggggggcaccccaaaaagcaaaaccggaaggggtcaaaaaaaccccaattgcaaa

SEQ ID NO: 72595 - DNA, 434 bp, Triticum aestivum
  Clone ID: PAT_TA_72595
gggggaaaaggccccctaagggcctcccactggaacctttaaagggtttatttaacaaaaaacttgccctctgcccccttttttcaaaaaaatcccaacccaaattttaatctcaggaattcccaaaaaatgtttgccatgatggccccttaaatctcaactgaatcattcccctccagctgaacaaatgaacccggaaaaagggaaagggtttctcaaaaaaaggaataacatccggttctgccctccggcctttaaggcgaggggcaaatccaggaatctgcaattttggaaataggggggcccaacctttttttaaccatgtccgagggtataaaatatttttcccccccccaaagtaggatcaaaaccaaacctgatggcaaaagttgaccggaccaaggatgataaatccccccttgacctaggggctg

SEQ ID NO: 72596 - DNA, 492 bp, Triticum aestivum
  Clone ID: PAT_TA_72596
agcggggcaaaatcaatccaaacaaaggtttcaggcctacatacctcgtttcggcaaaacttaatttaaacaaaattaacataacaacattacccaaaaacttttgtccattaaaaagtaaaattggtaaccaagcgttgcatacccctcctttatcacagggataaaaaactagctaggaccaaaatgatgtgacctttcatggtctgcttgctttattgggacttcaaacctcaaccaaagcgggggggcccacctcgtcctcctccttagggggggggatggtgacaaggccaggcagcgggggggtagggccaaccttgcccttggggccccaatcaagcataatcttcaccttgataccaaaaaccccctgtctgaaaaaaacgtgcctaactgcaaaataaatgtactcgttgacgggctgaccaaatgaaaacatgtacccgtccttgaacttcatcaacttggctttttgggccctgagcttgc

SEQ ID NO: 72597 - DNA, 359 bp, Triticum aestivum
  Clone ID: PAT_TA_72597
ccctaaaggccgcccaaaaggctaaagtttttggggggcaacgaattttaacctaaacccaataataaaatggggggaaactacggaaaaaaaggggcccgggtgcccgtttttaacccggcccaaacccaaaaggggcccggaattaagaactcaaacctaatctcgggctcgcccttgccaaccctgggaaaaggggaccccccatgaacaacctttttgccatcccccctccccctgttaaagggctccaaggggctaacttaaaacctggggggggccttttccccggccttgaaaaaaggggttagaaaccaaataagtgggttaacgggacccccacccgtcgggtgggcccc

SEQ ID NO: 72598 - DNA, 528 bp, Triticum aestivum
  Clone ID: PAT_TA_72598
ccccaacgacgtttttccccctttaatactccggccggagggattaagtaaaaaaacatttcacttgttacggctaccctactagtggcccactactactgggcagcacccatccagcgtcccgggcaaaatttgggttacatatactacccactaccattactaaaaatctccaaaggatccaattcccacctaagggaggggggggggtttccctcgaatcgaagccggtcgccaatcaaaccccgccaactccttccgggccagttagtccctgggccgccccagccaaagggagctcaccgcgcggacccgggaaaagtattccttgataacaaacagcgcgcgggcggcctgccgggtcgtaaggatgcggggcatttgctgcagggtctgctgcctaaggaggcccccctgccggaggaagttctccagggggctcagtttccccagggggagggccatctgccccatgtaatgtggaacgttggggggcccggccaggggcccggcccccgccgccggggc

SEQ ID NO: 72599 - DNA, 354 bp, Triticum aestivum
  Clone ID: PAT_TA_72599
acccccaatttttttaaccccccaaaattatgggtttaccccccatcccaaaatgggtttttaaataaaaaagtctttcccaaaaaaataactagggtaaaaaagggaaacaaactgaacttttccggaaaaagggcaaaaaccccgaccaacaaaacccgtaaaaatttccaggcccctgggggcccaaaaaaggggggaaaacaaaaatccccttggccaaaggggccccggcaaaaaaaaaaaaaccaaaaggggggcaacaaggcaaaagggatcccccggggagggcaggaaccttggggggaggtttttactgggggaaggaaaaactgaacgggattcccgttttcc

SEQ ID NO: 72600 - DNA, 148 bp, Triticum aestivum
  Clone ID: PAT_TA_72600
accaaatgtttatttcaaaattacccaccgggtttcaataggcggtgcccttccccactaaaacccccaaatttgggcaaaacaccacaacgggatgggaatggaacaccaacctttttttaggggccgggggcccacccttgacttt

SEQ ID NO: 72601 - DNA, 306 bp, Triticum aestivum
  Clone ID: PAT_TA_72601
aaccaaaggtttatttttaaattaaccaccgggtttccataggctggggccctgctgaaaaaaaaccccaaactaaggcaaaacaacccaacgggatgggaagggaacaccaatctttttttaggggctgggggcccacccttgactttagtataaacctcccaccctaaaatgtccatttttcggcccaaaaaacaaacttgcccctttgctttggaaaggggccaaacaaacaaaccctaactagcatttgtttgccaaaggaaatgcctcaccaggggaaaaggatagggcttccctcccccc

SEQ ID NO: 72602 - DNA, 291 bp, Triticum aestivum
  Clone ID: PAT_TA_72602
aatcatggttagtgttgttttttgtttttttttgtaaacccccaacctttaccttttttttattatgtttatatattaaaaaattggactgggtgggtcttgaaatttataaacccccttacatgaaataatttaattgccatatttaaaaatcattttgggattttaaagcccaattggggaaataacaacctgcccaaggggggcttttcatttttttttcctattgggggctcctgcctttgggggcccatgggcaattttattgggaaaggcactggggggtttttc

SEQ ID NO: 72603 - DNA, 439 bp, Triticum aestivum
  Clone ID: PAT_TA_72603
cccatccattttttattttttttcacttttttacattggaccaacacacaacccttttttaaaacatatttccaattaaaaaacccggtggaaaaggaaaaacaactcatcatgctgttggattttttttgggacccatgtttcttataaccagtccctttattgccacccaaatcctaattgatctttgcaaatttttaaacaaaagcttccaaaaaaccaatttgtttttcctcccttttagtacaaagtggagtcatttatttggggacggggggagtccaaagtaaaaaaattaatttaataaaagctttttaatggagggaaggaacttctttttataagggaattcactttatcaggcaaactgtgatgttttggcttccccgatcaaaacttcaccttaaaattcaaatttttaaacttgacaataagggaa

SEQ ID NO: 72604 - DNA, 380 bp, Triticum aestivum
  Clone ID: PAT_TA_72604
aaaacaaaaaaaaacttgggggggtttttttccccaacctggaaccaccccggggggggggcaacccggggggggcccccccctttttttttcatggttccaccgaggggggcctcccctaacccccggggacccctcccccttttaccaaagggggggcttttttaatgggcccccaaggggggaaactttgcgggaaaaggggccccggggggggggccccccggggggaacaaaacccttgcccagggggggaaaagtccccaaacccaagggccgggccccccccaatggacccggttgttggggggggaaaaccccccccccccggagaacccggaaaaggggccccaaaacccggacccccggggggggggggg

SEQ ID NO: 72605 - DNA, 436 bp, Triticum aestivum
  Clone ID: PAT_TA_72605
ccgggggccaaaaaaaaaaaacctatccggtcccaaaaggatccgggggcttttttagggtaaccccgggcttttcaaaacccccccccagggacctgggatagggggttcccacccaaccttttccccaaaggggcaaaaaaaacccttcggtctaacccctaaggatttgggaacaaacccgggccccttaatttttggtgaggggccttaaaaaaaaattcaccctttgccctaagccaaaaaatttttgggggggggaaaccaacccggttttttttgtttggcccccccggttttttttgaacccggaaaccccggggggcatccctggcaaggaccttttctggaaactctttttctttgaaaacaaagccctttaccttggccctttttggaaaaaacgggggggataacggcccaaaaacccccgggg

SEQ ID NO: 72606 - DNA, 274 bp, Triticum aestivum
  Clone ID: PAT_TA_72606
gaaaaaaaaaggggggaaaaaaaaaacttgggtggttttttttcccaaagctgaaacaaacccggggggggggaaaaaagggggggcccccccctttttttggcaaccgtaacatgggggggggcctcccctaaccaacaagaacccctcccccttttagaaaaccctttaagtttttattgggccacaaaggccccaaattttgggggaaaaggggccccctaggagggaccccccgggggggaaaccccccttccacagggggggaaaaatt

SEQ ID NO: 72607 - DNA, 447 bp, Triticum aestivum
  Clone ID: PAT_TA_72607
acataaaaggtaagcccaagcccgcaaaatagcttttcaaaaatgggggggcccgggcggggtcatttaacggaatggaaaggggtaaaagttacaaaaaagtttttttttgggattgggcggagtaccattttaaggtagccacaagcgccggggggggggagtacaagccaactggggcgaaaaatttaaacggggggggggcattccaaagtttttgggcgggggtataatcgtttatggggaggggccgggtacaaacacctataggtaattttgggggctaacctcaccgggtttttaagcttggttaaaaaaaaggggttggagagactccacgtccctggggcctttatttttgggaactttttcgccataataaaacaccttgaagggggggtatgaaggaagggccacctttgaacaaacgggtttggttgcaccgaa

SEQ ID NO: 72608 - DNA, 527 bp, Triticum aestivum
  Clone ID: PAT_TA_72608
ataacaccagttttgttctttttttaggcggaaaagcttttcatcttgcattattatggggctttactctagttacacaaaaagctgggaacacacgtcacgtttattggatagctaaggggcatgcatgcccaagccccatgcaagctgcaaagagttctatcactgcctggtcgacaatgcgtcgctgccctccagccggcacattgccggcagctgtgccgcgagctgctgcccctttgccacctttaggcgggccgcctggtactccgcgctaacatggtatgggctggcgtacccttgttgcccttggcctggttgttgcccttgtcctggttgccacaaaaaagttgggtagtacccttgttgcccttggcctgattgatgcccttgtcctgactgctgggaaaaagttggatagtacccttgttgcccttgtcctggttgcagccattgccctggctgttgctcatgtcctggttggtgcccttgtcctgactgctgcggaaaaattgggtaatatcctt

SEQ ID NO: 72609 - DNA, 363 bp, Triticum aestivum
  Clone ID: PAT_TA_72609
cggccacaggccaacatttttttttttttttgccaaaaaaaaacatcccggaagtaattaacatgccccaacagtggttttttgattgctccccaacctttttaccaaacgggaccccttttttttatgttttttttaaaggaaacccgggcatattacctttttaacacgtttgtagctggtggcccctttaaaaacatcgcccgggtgtaaaccccacagtatgaagggcagctgcttttataaacctttccaggtatccttgatgttccggaccggcctaagcgcttaaacggccgactgggaaccaaattttgcctgtttttcaggcaaatcaacccccatgaaggggtttatctaaaa

SEQ ID NO: 72610 - DNA, 401 bp, Triticum aestivum
  Clone ID: PAT_TA_72610
aggaaaccaaaaaacggccggaaagaaagggggggggccccccccgaaaaaaaaggagtcccccagtttggttcaaaagccgccaactaaaggtaccccagtcactggattaaaaggcctcccaaaaacccaggcccacaaaagggaccttccggttaaaaaaaaaaacgactaaaacttatcgggggggccatcccccccgggattgggcccaaccccaccctggtttgggaaaatcttccccgggttttggtcaccctttccaaaaagagggccccccctttttaaaaacccccccatttttaaaaaaaagttgggggttcccccattttttaacccctcaacctttttaagctttttaacccccctaaacatttccaaaattttttgggaagggggta

SEQ ID NO: 72611 - DNA, 458 bp, Triticum aestivum
  Clone ID: PAT_TA_72611
attctacccgccataaaaacattgattgattccccaagggactcattaaaccaaaaaaaaatagtctcacaatggaacccctaaagcatgacaaaagtttttttttcaccccaaataaaacaagggaaaatatcacatccattctttcaactgcatcaggaaacatctaaataggaaaaactacttcagcagcctcacataacaacctttttaagcggggatctccacctcgccggcgtcaatctccgtctgcaaatccttggggtccttgccgtcaacggggcaaccaaccctgacccaggtgccaaggatctccttgacggggccggccatttccttggccatggagcggaccttcatgatcttggcaatctcaatgacctcctcaaggctgatgttgcccctgggcttgatgttcttgacctttttgggggccctttcgggctccttgaacccct

SEQ ID NO: 72612 - DNA, 428 bp, Triticum aestivum
  Clone ID: PAT_TA_72612
ggccaaaaccatttttggttaaaaaaaaaaaaaaaggggccccccaacttttccccctttaataaactggggggtccctttttgggtccaagggggaaaacgggaaaggggggggaaaaaaaccccccccaaccaagcaaaggggcggggacataatacggggaatcccccaccccggggtgggatttgcaaaaaaacaggggtaaaccctaaggggggacccaaaaagggaactaaacccggccccaaagttaaaaaaggcccgaaaccggcggggggtaatagtctttttcatcccccaagttgggatcgtccaaggggggttttttttggggggttttccctcaaggaccccccccctttttggggtcccctgggccattagcggggggggtggccccctttgaacaaccgggattttttttggc

SEQ ID NO: 72613 - DNA, 629 bp, Triticum aestivum
  Clone ID: PAT_TA_72613
cttacatgatagtgcatgtcacattattttttcaccgctacaacgaccaaaccatggactgaaaaaaccgtgtttcatatatctagtactagagttattttcttctcagttagtaccgaaaatgcatgccaaatggcgtgatggtgcaatatggagggatgtaaacattgcaaattgcaggtagcgtctgtagcgctaggttccttatttcctcgaactggggcagttgttgaggctggacagagccctgggcctgtgggttttgctgaaatggccggaaggagccctggcctaatggatattgttgctgaggctgttggaaggagacctggctcgatggttgttgttgttgttgtttttattgttgatgcagaataatagcatgaacaacattgtggatggcctggcactgcgactgctcagggatctgccataggtgctgacaacacaattcttgcaacagctggtaagtactttgttgcaaaacttgtgatcttccatgcgctatgttgtgttcctgctatacaacatccatgcatggaatcagttgttgttgcaaaatttgttgaaggatttgttgttgttgttgttgttgttgatgttgttgttgttgttgctgctgctgctgc

SEQ ID NO: 72614 - DNA, 418 bp, Triticum aestivum
  Clone ID: PAT_TA_72614
aacaaacaaaaactttgtttggtttttattcccaagcttgaactaccactggggggggtcccacatgatggtgccccccactttatttgtcatcgctacaacgattggggcatcacctaaccaatgatgatcttgcctttttaattggccaccaatgccagcgttttttttggcatatggtaccttgatgggggagcagtcaggggggccatacacgtttcacatggttggaaaagttttcaataccaatgacctgatcccctccaattgagctggttgttgaggttggatgatacccaaaccctgggcgagctgaaataagggccggaggatcggcacgccttgttgttgttcttggtgcataatgatggaatgccccaccctgtggatggctgcccactggaactgttgaggaatt

SEQ ID NO: 72615 - DNA, 357 bp, Triticum aestivum
  Clone ID: PAT_TA_72615
aaaaaaaaaacggggtttgtttttttttcccaagtttgaactaatattgttggggtttttaaaggaaagggcctgtaacatttttttttcaccgttacaaggaccaaaccttggactaaaaaaaggggggttaatttttttaaacctaaagttttttttttttaaattttcacccaaaatcccaaaggggcccagggggcattttggggggatgtaaaatttgcccattgaaggtaacgtttgtacaccctgggttccttatttcctcaaacgggggcagtttttgagggtggacaaaaccctgggcctgggggttttgctgaaaaggccggaaggacccccggcccaaaggatttt

SEQ ID NO: 72616 - DNA, 591 bp, Triticum aestivum
  Clone ID: PAT_TA_72616
aatcgtctgaactgatttattcaggaaaccaactaacaaataaaaggatcaaatgggtaatgataacgtctttaaataggagttcagcacaccatatgtacaaaaaaactatgcataactatgaggcatgcttggggaacgtgattcccagtttcatccataaactgtaacaaacttaaaattatgtatttattgggaggagctagcatacctgcagtatgtgaccaccacttcaacagacatggatgatgccatcggcactatccgccaaacaaaatagtactccctccgttcacttttgtaggccggggaaggaaatttctgacagccccccaaaaacgctaatggacaacaatacccttccatcaacttgaaattcaaaaaccatcgggatcgcttcgccaagtgcatcgcctcccagcgcgtcgccggctcgccgcccaacttctccccccacctggccgggatctccttcctgcccaccttgcccaaattttcctccgcccaggatctcctcctccctgcccagcttcctgctcatccaggaaccttgccgccggccccaggagggcaccttgccggccgccggcc

SEQ ID NO: 72617 - DNA, 331 bp, Triticum aestivum
  Clone ID: PAT_TA_72617
aaacaaaaccaactttcctcttttattcccttgtttgaactagcataatccgggttcttacatgataacgcctgttacattattttttcaccgttacaaccaccaaaccatggactgaaaaaacggggtttcatatttctaatactaaagttatttttttctcagttattaccgaaaatgccaaatggcgccatggggctatatggagggatttaaacattgcacattgcaggttacgtttgtaccgcttggttccttatttcctccaactggggcagttgttgaggctggacaaaaccctgggcctgtgggttttgctgaaatggcccga

SEQ ID NO: 72618 - DNA, 303 bp, Triticum aestivum
  Clone ID: PAT_TA_72618
gggttttttggcaaacaaaaactctttttgtcttttattcccaagcttgaactaacactggtctgggtcacacatgatggtgcaccccactttatttgtcatcgctacatcgattggcgcatctgctcagtaacgatgatccctctatctattagtataaatcttgcttttttcattggccaccaatccccacaactattctggcaaatggtgccctgattatggaccactcaggcgggacatacacgttgcacatggttggaaaattttgcaacaccaatgacctgatcgcctccaattgac

SEQ ID NO: 72619 - DNA, 370 bp, Triticum aestivum
  Clone ID: PAT_TA_72619
gggaacccaaacaaaaaattttttgtaaacaaaacccgggtttgttttttttccccaagtttaaaccaatttatttcaggtttttccaaaaaagggcctgtcctttttttttttcccccccccaacccccaacccggggcctaaaaaaacgggggttcaattttcccccccaaaagttttttttttcccatttaacccccaaaaccccaaaggggccagggggccaattgggggggaatacccccttgcccattgggggggccctttgaacccccaggtccctttttccccaaaacgggggcattttttgggggggaaaaaacccccggccccgggggttttcccaaaaagggggaaaaaaccccccccc

SEQ ID NO: 72620 - DNA, 308 bp, Triticum aestivum
  Clone ID: PAT_TA_72620
aacccccattttccaaaaacttttttaaaaaatgattcaaatgttgatccaaaccccttggaccaaaaaaaggccaaagtttcccttcaaattcaatattcccataaaaattcggaactggccctttaatttttccccccacctaggccattttttataccccccccttttttcaccccccccaatgcagggacttggccatttaaaaatcaatcaatgggcaacttccttgtttactccccccacaaggcaaggctcaacccccactttaaatcaaccaaaattccccttccactttttaaaaacca

SEQ ID NO: 72621 - DNA, 367 bp, Triticum aestivum
  Clone ID: PAT_TA_72621
aaacaaacaaaaactttgttgggcttttattcccaagcttgaaccaccccggggggggggcacccatgagggggtccccccctttttttggcatccctccaacgatgggggcctcacctaaacaacgaggacccctctaccttttaccataaccctggcttttttcatgggcccccaaggcccacaactttgttggcaaagggggccttgaggggggacccctcaggggaaacctcccccttgcccagggggggaaaaattttaaataccaaggacctgaccccccccaattgaaccggttgttgggggtggataaacccctgaccctgaacaaactgaaacaggggccgccggatttgcccccctt

SEQ ID NO: 72622 - DNA, 375 bp, Triticum aestivum
  Clone ID: PAT_TA_72622
gggccccacaacccccgggggaggggcccctttttttttcccggaaaacccgcgccccccccacggccaaaaaaaccccggggccggcccgccttccggccaaaccccccccaaacccaaccccgggcctcccccccccccccttgggcccccccccgtcgggggaaaccccccccccggcctgcttttttttcccggcacaacaaaaggtccccccttgccggcggccacccccagggaccgcttccccccccgggaaaacccccttcaaatggcggcaacccggcccttttgctgggggccggggaaaaaaccgggccccggggggcccgggaaaaacctggccccaaaccccctccccgggggggggaaccc

SEQ ID NO: 72623 - DNA, 463 bp, Triticum aestivum
  Clone ID: PAT_TA_72623
ggaaaaagtaatatagcattgaatcaatttgggccaaaccccaatcatttcattttttggcccggccctgggatccaaacttacaacactttgaccccttttcggtggggccaacatcctacttttttgacaaccagtaaatgaacataaaaaacgcccccccggaccccacgagcgaaaaaattatcgggcccatcgatttcttttttctgatcgacccgaggatggggttaatcggggggatccggctgctgacgttgcttatttggggagtaaggccaccaaacgttgaacgctgaaacatgaaaccccccagggttgcttgagcttgggatatcacagtatccacctgtccggaattcctgtggatggcagcttgttctttaaaaaaagcttgttctgagtctccaaacttttccacgtaaaactttgctttgtcaaagtctttcaagtcaagggggga

SEQ ID NO: 72624 - DNA, 358 bp, Triticum aestivum
  Clone ID: PAT_TA_72624
ccactgaacaaataaaaatcctgcaaggtaaaacaacccataataaaatctggatagctttaaatcacacccaaaacaggcaaaactttctcagttcaacctaggactcaaacagtttacaaaaaagggggttcagtttgtctgcaaacatgacttggacccaacttttaaaaaaatccaccaagtaacatgcagcaccttttcaccctaagctggggcccccttgcccttttttttttggaccttcctaatgtaaaactccacctccttgccctccagaatgtacccatcagctttgccacactgtccagggcaaaacaaaatgcaggccaccacccttccaccgttgaactgctcc

SEQ ID NO: 72625 - DNA, 467 bp, Triticum aestivum
  Clone ID: PAT_TA_72625
aacaaaaaaacaccagtttgggttttttttaaaccaaaaaaactttttatttggaattataaggggggtttactttaataaaaaaaaaaagggggaaaaccccccaaatttttgggataaaaaaagggggggcgggccaaaaccccatgcgagcgggaaaaagttttattaggggggggccaaaaaggggtcccccccctccaaccggaaaattgccggaagttgggccaaaagctggtgcccctttgccacctttaggggggccgcggggggccccacccaaaaaggggagaagcgggaaaaccctgggggcccttgaccaaaagggggcccttgcccgggtgggggaaaaaaaaggggggaacccccttggggcccttgcccggggggaacccattggccaaaagggggcccttggccggggggggggggaaaaagggggaaaccccctgggggcccttgcccgg

SEQ ID NO: 72626 - DNA, 333 bp, Triticum aestivum
  Clone ID: PAT_TA_72626
ggaaacaactttatttttttttttttccaaaattaaaacaactggttggggggggccacacatgacatggggggaccctttttttggccccggggcttcgacatttccatcgactaaacaacggggccccaatttttttttactaaaaatctttccttatcagggggccccaactccggggccaacgtcaaagggccccctaggggggggtctgtacaacggcccattaaccctgcccattgtgggcgggaaccgggccccaagggaagtcatccccccaggcggaccttttggggggggcggcaaaaggggcccctggcccaattgttgttg

SEQ ID NO: 72627 - DNA, 351 bp, Triticum aestivum
  Clone ID: PAT_TA_72627
cggaaaaacctcccccctttcccaaactaccaaacgttcactaacaaggggggggtggcaacccttttggaaaaaacacatttttttgaacacattaaagggttcccatgcccgggcccgggacctttatccacccgtacatcccaacccccattttttttggataaaaaagggccctacatcccatcaaccgaaactttttgaaccaaaaccctttttcccttccttaattcaccgggggggaaaaaacccccccccccaggctataaaaaaaaacaccccccccccccccgggttgaccacccccccttttacccccggaaacccctcgaatcccccccctttaaaccc

SEQ ID NO: 72628 - DNA, 358 bp, Triticum aestivum
  Clone ID: PAT_TA_72628
aaaaagggtcaggccttcaaaacagttcacattcccaaaaaccccctgacaaaaccaaacccaaatcccgagttgttcacaaaacctaataattcccttcccccaaacctgaccgaaataccaaaccccagggttttcttaagccccatgatttaataaacaacctttatttagcggtaaacttgcccacccaaactcttttgaaagcctcaactcctgtcaaatgcccccggcttcactttttgcctcccaactttgggccaaaacccctttccaacttgccaataatctggtggtttgggataaccttgcctgactcgtactcctggatgacttggggcttctcattgatcaactg

SEQ ID NO: 72629 - DNA, 374 bp, Triticum aestivum
  Clone ID: PAT_TA_72629
ggactaaaaattcagtacttcatcatccatacatgggttcagtagcattcagctacaaggggacacaaattttacataaaaaaataattttttatttcttcaaactgacctacacaaatggttaaccacatcgcatgggtgcaaccatgtccagaaaaacaaattacatgttcactcttttggaccctaaagtccaccctttgccccggtggcgcaaaaacaaaacaaaggcgaagtaagtaaaacaaaaccaatggggagttcaattatcattggcccataataacggggtggcagggcctttaaggcctataaaaggagctgcaggcccccaatcataaaacttatcatctgcaaataaactttatattccc

SEQ ID NO: 72630 - DNA, 390 bp, Triticum aestivum
  Clone ID: PAT_TA_72630
aaaacacctacatcaatccttgggataatcgaccaaaattaaaccccaaaatccccaatccaaacccttgtttttttttccaacccaccttaacataatctttaggccctggcttacccctacaattcctacaaaacggagggccaccggcccagaaacctttttaccaaaagtctttccaaaatttttttaggatgcagcaaactcttcccgtttgtaatttcgtaaaccacctcaaatttttcaaactcgggccattccgggaagggggggacaatttccaggccaacaagttcccgtttttaatcctcaacaacgtgcccgtccagaagggggacttcctcaagaatcggcaatccctgcataacccgtttaaaaaaccccgtttgc

SEQ ID NO: 72631 - DNA, 392 bp, Triticum aestivum
  Clone ID: PAT_TA_72631
gtaaacaaaacatgggtttgttttttattcccaagttcgaactattatagttcggggtcttacatgatagtgcatggcactttattttttcactgctaccacgaccaaaccatggactaagaaaacggggtttcatatttctagtactaaagttcttcttttctcaggtggtaccaaaaatgccaaatggcgcaagggggggcgagccatggggagggatggaaacattgcacattgcagggagcgtttggaccgctagggtccttatttcccccaactggggcagttgttgaggttggacaaaaccctgaccctgggggtttacctgaaatggctggaaggaaacctgccttgatggatattgctgctgaggctgggggaaggaaacccga

SEQ ID NO: 72632 - DNA, 261 bp, Triticum aestivum
  Clone ID: PAT_TA_72632
gtttaaaaacatttactgttaaaaaaaaaacattttttttggtcccaaaaacttctccaacaagcgattataaacataagggtgccacaacatatctcttgccgggggtgacaaagcaaaccaaaccccatatgatatttattaaacgggggctgcccatgaaggcagggcttattagggacccccgatggggcaatcatagacatcttcctcttctcatccaatggcccaaaggcttcacgtcctccaaagtctcaagga

SEQ ID NO: 72633 - DNA, 384 bp, Triticum aestivum
  Clone ID: PAT_TA_72633
caaaacctggggggggaatataaatctaaaccccccatttggtcccctccaaaacaaaaatttcctggccaaacccaaaaatttccttccaactctttggccaaacccataatggcaaaaaccccccaccttttatttttccaaccaaagggaaaaaatgacctttttgtcccctaaaaaaaaccaacctttaaatattttccccacccttttggggatcccccagtggggcctcccctaccccaaaatgtgaccccagccacttttgaagccgccctttaaatctaaacgggcttggaacccttgggggggctcccccagggtttcaccccccaattccccccctaaaaaaaggggtcctgttttatctaaggggcccccccc

SEQ ID NO: 72634 - DNA, 438 bp, Triticum aestivum
  Clone ID: PAT_TA_72634
ggaaacaaaacctgggttggtcttttattcccaagtttgaactaatatagttcaggttcttacatgaaagggcatgtcactttattttttcaccgctacaacgaccaaaccatggactaaaaaaacagggtttcatatttttactactaaaggtctttttttttcagttagtcccgaaaatgccaaagggagcaagggggcaatagggggggatttacccattgcccattgcaggtagcgtttggagccctaggttccttattgcctcaaactggggcagttgttgaggctggaaaaacccctgggcctgggggttttgctgaaatggtgggaaaaacccctggcctgatggatattgttgctgaggctgttgaaaggaaacttggctcaacgggtggtgttgttgttgttggtgttgttgcggggggggggggggtt

SEQ ID NO: 72635 - DNA, 291 bp, Triticum aestivum
  Clone ID: PAT_TA_72635
ggggcccaccctcccttgggaaaaatccggggggaaaaaaaggcccaccaaacccttggcctcgaagaaaaaaaggccccccccaaaggacccctttaaaaagggcccccgattccccagggggggggggggaaaaaccccccctttgaaaaaaaacccggggtttgaaaaccccgccgttccccaaaagggccaaaaccttacccaatttccccaaacccccaaacctttataggccccgaaacgggactggttctcccaaaaaaaaggcaaccccccccccccaaaaaa

SEQ ID NO: 72636 - DNA, 351 bp, Triticum aestivum
  Clone ID: PAT_TA_72636
ggcaaaaaaaaccggggttggttttttttttccaagtttaaaaaaatctagttggggtttttacatgaaagggcagggcactttatttttcaccgcgacaacaaccaaaccttgttttaaaaaaacggggtttcatttttttagaaaaaaaggtcttttcttttcagttagtactcaggatcccaaagggcccaaggggggcccaccaattggggggggtgtaaaccttgcccattggggggaccgtttggacccctaggttccttttttccccaaaccggggcagtggctggggggggaaaaacccctgggccggggggttttgctgaaagggggggaacaaccccgggc

SEQ ID NO: 72637 - DNA, 313 bp, Triticum aestivum
  Clone ID: PAT_TA_72637
aaaaaggcccaaccaattaaaaaaactttttcttaacgcccagcctcatcattaacataaaataaacataccataatccctttaactaggcctgaaccaaaatgattttgcccgggcccctcaaaatccatttcatcgcccaaaagatgggaaactcctaccaaaaaatgtaaatagataagtaaacaagcagtaccccccccccgccttacccaaaaggacttttcccaaaaatcaacggtaaaacttttggaaacccccccgggccccacaaccgccaaactttttgggctcccaacggcgcgggtcggca

SEQ ID NO: 72638 - DNA, 477 bp, Triticum aestivum
  Clone ID: PAT_TA_72638
ggtcaaataaaaacaaaaacccattttggggggaaattttacttccaaaccggccctacaaaaagccttttttttgccccccaaaaaaggggaccctttttcccttttaaaacatggaaaaaggaaaagaccccttttttggtttttggcccgggcccaaatttttattggctaaaccaagggcccttgggtggaacaaacaagggtggcccccgaacccacccccagggtggtccaaaaccccttggaaaaccccaacccggcggggaaacgggtggcctgccccggcccccactttaacccaccattaaaggggggggggaaaaaaccaaacccgggccccccccctgggggccgaattggccctgaagggttccaatggcccgggaacaaaaaatgggttcaagggtttgggccccggcccattattcaaaaaccaattgcccttttaaaaaaaacggggggggtgggggcccc

SEQ ID NO: 72639 - DNA, 381 bp, Triticum aestivum
  Clone ID: PAT_TA_72639
actaatatatctaggactaaagttattttcttctcagttaataccgaaaatgacaaatgacgtgagggggcaatatggggggatggaaacattgcacattgcagggagcgtctgtatcgctagggtccttatttcctcaaacgggggcagttgttgaggctggacaaagccctgggcctatgggttttgctgaaatggccggaaggagccggggcctgatggatattgttgctgaggctgttggaaggaaaccttgctcgatggggggggtggtggtttttggtggtgatgcaaaataatagcatggacaacattggggatggcttggcactgcgactgctcagggatctgacataggggctgacaacacaattcttgcaa

SEQ ID NO: 72640 - DNA, 306 bp, Triticum aestivum
  Clone ID: PAT_TA_72640
aaacccaaaaagcttttaattttgcattattacggggctttactttatttacatgaaaaacttgaaccccccccccattttttggataactaaggggcatgcctgcctaaaccccaagcgagctggaaatatttttattactggctggccaaaaatgggtccccgccctttaaccggaacattgccggaatctgggcccaaagctggtgggcctttgccacctttagggtggccgcctggggctcccacctaacagggggtgggctggcataaccttgttgcccttgtcctgactgggggggaaaa

SEQ ID NO: 72641 - DNA, 477 bp, Triticum aestivum
  Clone ID: PAT_TA_72641
ccccccggtatcatccaaatggaaaatgtcatgcaaatgtcaattttaacaattgattgtatcacaaacaaaatataaccagacttgtaccaaactaacagatgtgcacctacttaactgcacagactaaagagggcaagacaccaattgctgtagtgttatgctatgataacatagaggaacatagttgatgcaaaccagtgcaaaggccaactcttgattgttcatcaccaagctcatgcaagcacatctccatatccgccatgaacagcttattctttaggtctggttgcctggatatgtatgcaaaggatgggggatgaaacacttccattatctaaaagactgttacatatgttgagaatgtgtgcttcttgtgattagacatccttgaaaagaagctggaatctgggtatcctctctggtggaagtgggcaaaacactatcagtttgcctttcatcgcccccttgaatact

SEQ ID NO: 72642 - DNA, 337 bp, Triticum aestivum
  Clone ID: PAT_TA_72642
aaaaacacaacccctcaatttattaaccttaacaaaaaaattaaacccccctattttcaaatttataacccccaaaaaaaaacataacttatcaattttttttatcaccatcccccaaaaccatcctaattttccccatggcattattatcgccacaaacaaaggggcccctatacatttttttttccccccaaccccaatttttaacaccccttaaaaaaggaataccccttttacccctttcaaacttaacctttaaaattcccctaatctttataaaacggtttgccctcaaccaccccccattaaacaaacttgtaaaaaacccccacccccc

SEQ ID NO: 72643 - DNA, 351 bp, Triticum aestivum
  Clone ID: PAT_TA_72643
acccaaaaaaacttttcattttgcattattactgggctttactttactacataaaaaactgttaccccccctaacattttttgtttaactaaaatgcatgcttccctaaaccccattccacctttaaaaaattttatcactggctggccaaaaatgcatcccccccctccaccctgcaaatttccggcatctttccccaaatctttttccccttttccacctttaagcttgcccccttgtgctccaccctaacatggtattacctttaataccctttttccccttttcctgatttcttcccttttcctctctattacaaaaaaattgcgtactccccttgttccccttttc

SEQ ID NO: 72644 - DNA, 249 bp, Triticum aestivum
  Clone ID: PAT_TA_72644
ccttgccctccaattaacaatgaatgtttggcacctacatgccccatattacaacacacttttaaactaccgtacaaaataccctaacccttaaagtccaaacaacctaaaataaaacacacaatccaaattacccactactattaaaggccaataaaataaaaaacactgtcacccccatccatagtgtaggggtactaaagaaaatggcttttcaccctggaaacccgttaactgcatccttaggtc

SEQ ID NO: 72645 - DNA, 394 bp, Triticum aestivum
  Clone ID: PAT_TA_72645
aaataaaaagccatgtcaaattattttttcacccctacaaaaaccaaaccatggactaaaaaaacggggtttcatatatctaatcctaaaattatttttttctcaattaaccccaaaaatcccaaatggcccaatgggccaatatggagggatttaaacattgcacattgcaggaaacctctgtacccctaggttccttatttccccaaactggggcaatttttaaggctgaaaaaaaccctggccctgtgggttttcctaaaatggcccaaaaaacccccgccctaatgaatatttttcctaaagcttttaaaaaaaaacccgccccaaaaattgttgttgttgtttttgtgggggacccaaaataattccctgaacaactttggggatggcc

SEQ ID NO: 72646 - DNA, 417 bp, Triticum aestivum
  Clone ID: PAT_TA_72646
ggaaaaaaaacccgggtttttttttttttccccaatttgaaccttttattttgggggttttcccataaaaggccgtgccaattttttttttccccgctacaacaacaaacccggggggggaaaaaagggggttttttttttttaacccaaaaatttttttttttcgttttacccccaaaaaccccaaggggcccaaggggccaattgggggggattaaaactttcccctttggggggaccctttggccccctgggtcctttttttccccaccggggggcatttttggggggggaaaaaaccccgggcccgggggtttttctaaaaaggcccaaaaggcccccccccctaaggatttttttcaaaaagcttttgaaaaaaaacccccccccaaggggggggggggggttttttggggg

SEQ ID NO: 72647 - DNA, 136 bp, Triticum aestivum
  Clone ID: PAT_TA_72647
aggcatgcaagtgatatccatcaattaaagtaaagtgcacgacaaatagttgtactctctctgtctaaaaatacttctcggaaaatggataatccatttctccgaaaagtacttgggggtggagggggtaagtttt

SEQ ID NO: 72648 - DNA, 323 bp, Triticum aestivum
  Clone ID: PAT_TA_72648
gagacaaaagatgtgtttgtcttttattcccatgtttgaactaatatagttcgggttcttacatgatagtgcatgtcactttattttttcaccgctacaacgaccaaaccatggactaagaaaacggggtatcatatatctactactaaaattcttctattctcaattaatacccaaaattccaactggagcaatggtgccatatggagggatataaacattgcacattgcaagtaacgtctttaacccttgggtccttatttccttaaactggggcaattgttgaagcttgacaaaacccttggcctgtgggttttgcttaa

SEQ ID NO: 72649 - DNA, 498 bp, Triticum aestivum
  Clone ID: PAT_TA_72649
gaatcaaaatcatacttgtttcattacaataccgacaataacaacaaacccaaaatttcctattacaccgaccgacaaaaacaaaagggcaaaacaagtggccccatcaaattctcctgatggctggaacagctgcacccaggcaaaatattcaccacaccttcggggacttttatgtacaaaaaccctttaacaacaagggggattatatcttccttcttaatatccccctgaaaaggttgaccctgttggcccccccaaacatcctattaacaacggtcgcgggggcaactccctggcctgaaaaggacaaattttttcggatctgcaacaacaaaacggcctgggcacccataaaccctgggcaggcaactgttgactggtggcaccttccttggtagtaggaccctttcaggtccctcacttcccccaaagttggcaacggatgccctttcccccattcaatccacctccccctgaaaacataaccttgattgc

SEQ ID NO: 72650 - DNA, 439 bp, Triticum aestivum
  Clone ID: PAT_TA_72650
aaaaccacacatccatttttatttatttacacctgaaaaatgattcacccccaaacaatttctgttcaaaacttttggaaaatacttgcgggggaacagctccttttcccgggtaccccccctatttgtcattttgtaacccacctttttggaggaggctgcctttttttttatcccaccccccgacaaaaaaaccctccatttccggcctgaaggaaatcccaaatttctccccaaaaaaccccacctcttcccttttggtgtaatccccccggccgtaaaaaatctgaacaaattccccttgttcccccttccccaaaaactgcccgtaaaaattaaagcggatccacctaatgcccccaaggttccccttaaatacatggacggttttcaacaggttcctcacgtcccaaactcggaattttttgttttggttccc

SEQ ID NO: 72651 - DNA, 461 bp, Triticum aestivum
  Clone ID: PAT_TA_72651
ccaacaaacaaatttccatgcttaatcttttttatggggaccaaaaaatccaaaccacaacagcaaaaactgataacaaacttcaccaggttcccaaagggaccaaaaacaacttccatactgcaatacttgtccttgacgggtaatctaaaggcaccaaacttaaataaacaccaccaatacctttaaggggccttgtcggccttggcagcaaaggcaccaccctgccctttaaaacaaccagtcctcctggcagaaataaaaccaaccttttggccaggtggtgcatcacggcggacaggggaaccgtaaccaatttgctgggggttacctcctccggggggatcctccacagggttaatggccaccccacccaccttaggccagaagttccttttcacacggtacttggggtaggcgttaccacccttgaccattggcttttaagtcctgccaccacc

SEQ ID NO: 72652 - DNA, 352 bp, Triticum aestivum
  Clone ID: PAT_TA_72652
ggaaaaaaaacctgggtttgtttttttttcccaagtttaaaccaatatatttggggtttttaaatgaaagggggtgtcaaatttttttttccccggtacaaccaccttcccagggcctaaaaaaacggggtttcttttttttaggactaaagtttttttttttttttttaaccccaaaaatcccaaagggcccgatgggccaatatggggggatgtaaaccttgcccattgcggggggggcccggagccctaggtcccttttttcctcaaacgggggcatttgttgagggtggaaaaaaccctgggcctgggattttttctaaaatggccaaaaggacccccgccccaaggg

SEQ ID NO: 72653 - DNA, 468 bp, Triticum aestivum
  Clone ID: PAT_TA_72653
gcaacaccaaaccattattttcaccaacccagaatgcatggaaataaatacataaatactccctttgttccaaaatatttgtcttaaatttcaacaagggactatttacaatccaaaatatgtctatatacatccgtatgggggagcccatttgaaatctttaaaaaaacaaattttttggaacggagggagtaaataccatcaggcatgccatgcaaggttcaaacacttaactcgattatccacccaagtccaagtttagctacctaccaaatcatccaaggttcaggttggtttaacaaccccaacacaaacacaaacgataacttgccttgccgcacatccatggtatggttcccaacgcaacaaaccgacttacttgttcattttacgggcacccatacagctacagttcaaggggccatctaaatacataaataggttttatacaaacacacggttcaacct

SEQ ID NO: 72654 - DNA, 462 bp, Triticum aestivum
  Clone ID: PAT_TA_72654
ctttaggccaaaacagttttcctttttttatttcatcccccactcaaaaccctcaaataatagggtcatacaaaaacaaaatcccttttttttaaacaggggaaacaaaaatttggcaacaaatcaagggtttccagctaaaccaaacccaaaaccacggccctcccaaaacccaaaccccaatcctttccccaatcctccccaaccataccctcccccctcgccatacccaaacccgaaaccaaaaccaccgccacctccaccgccatacccctgcccgccaccgaaacccccccccaaaccggggaaaaaccccccccctgacccggccaatccgggtttgaacccaacgcttgacccaaaaaacaaactggcacctccaaaaaaaaccaacccggatctcaactaaaaggtcaacccccctccacccacggacccggacccaaaacctgatccggaccc

SEQ ID NO: 72655 - DNA, 299 bp, Triticum aestivum
  Clone ID: PAT_TA_72655
cttccaaaattcgtttttttgtttcctaacctgaaaaaaggaaaaaactgacacctcacacaaatgagtttgaagtttttccccacccttcttggaaagatgggaacaaccccctacccaccagcaaaaaatgatcctttgccccatttacggggggccgggatccccaaaaaaagggaaaaagaaattcctattccccggggaaattgcccgaggggacaacaacaacccatttaaaaaataaaaaaaggggtggccggccctaggactaggattcccccccaatggaaatggcgggg

SEQ ID NO: 72656 - DNA, 570 bp, Triticum aestivum
  Clone ID: PAT_TA_72656
agggggttaatcagaacctccatttcctctcaatatctgaatctgaaggaatagcttgtgccaccagttttgaatcgggctacatctcaacctcaattaagttacaaacgtttcaagagttggaccaccagttttccatgataaatgacaatgtttcgacatctcacgcaagtatatgacccaaatcaacagcaggtcaaataactattctgcctccactacttctccactactcctacaggtgatgctgtggctgctgcttgacccacagaagcaaaattctcaggcagttcgaacagtggctgccctccaaccaatgcaccacggtaagcctgtccaagggaatatcccagagctcgagcaacgggaacagcaaccgcattgccaacctgaatatatttctgctttatagggccaaagagcctgtaatagtctggaaagccttgtaaccgtgcgttttcgcggacggtcaaaactcgatgctggttggggtgcaagataatctggttgtggggctcagctctggtgacaactgttggaacagtttcatcccaccacaggcgtccgaat

SEQ ID NO: 72657 - DNA, 377 bp, Triticum aestivum
  Clone ID: PAT_TA_72657
caaaacaaaatggaaaaatccctccccccgaagggggggaaattgggttccatttttgccccggggggaaaccataaaaacccaaaattgggggaaaccgaacaaaatttccccccatttgcccataattccaaccggggaaaaaggccaaaaaaaattttcccgggttttttttattttcgggaaacttaacttgtaaaacaaagccaaaaaacccctttttcaaaaagggggaaataacccttttcaaaacaaacaaaaaattttcccccttggttaaaaaaaatgggggggcccccccctttaaaaaagccccctggggggggaaacccggccccaaggttttaaaaaggaaaaaaccctttaaaaaactcccc

SEQ ID NO: 72658 - DNA, 463 bp, Triticum aestivum
  Clone ID: PAT_TA_72658
cccccttattttcctttaaatataaaaaaaaaggcaacataaattgggaaacaaaaccggggttggttttttatcccaaagttgaaactaatatagtgggggttttaacaggaaagggctggcaaaatttttttttccccgttacaacaaccaaccctgggacggaaaaaagggggttcaatatttctataacaaaagtttttttcttctcagttagccccaaaaatcccaaagggcccaagggggcaattgggggggatgtaaacttggcacatgggggggagcgtttatagcgctgggtcccttattccctcaaacgggggcatttgtgggggtggaacaaaccccgggccctgggggttttgctaaaagggccgaaaggaccccggcccaaagggattttgttcctaaggctgtggaaaggaaaccggccccaagggggggggtggtggtttttgtgggg

SEQ ID NO: 72659 - DNA, 385 bp, Triticum aestivum
  Clone ID: PAT_TA_72659
gcccaaaaaaacgtttcccaacccccaaatgataattacaaagtagtaatactcatcacgggggcctggaacaacaaaaactaaaaggaatgggggaatacggaacccatacaaaaaaaagccttatcactttttcgctagccggatactaccccccttattttaaaaataacacattggggctccggacgggggcaaaccccccctcccactggcatatgggaatatcacatcaattggcagtcattggcgggttgcccttcggagggggctccggcttcggttcgggcttaagcttgggccccggcttaagcataggttcaggcttgggctctggcttaagctctggtttaagcaatggttcgggcttaagctctggctttgg

SEQ ID NO: 72660 - DNA, 228 bp, Triticum aestivum
  Clone ID: PAT_TA_72660
ccaatcaaaaactgctttgtcatttaaaaaccgcctttggaatttttttacctaacacaaccgaccccaaacatccttgttttacccgcacactttcctttccacaaaaaacccgcccaacatgaacccacaattcccccccgggccttggccatctttcggttcttttggcccaaaaaattggaacaaaaaaattccgccctgtaaattgtgggcccaaaatcccca

SEQ ID NO: 72661 - DNA, 523 bp, Triticum aestivum
  Clone ID: PAT_TA_72661
aaaaaatgtttcaacaactgggaagcagggatgcattattatccttcatgtttcaaacattttgtttctggtcacatggttacattgcagcattttgttgatgctatattgggggaaagccaccaagctgcaaacacagaaatacctcaacatttggggcggcacatgtattattcctggaccctttgttttcccggtattttggagctcatgtccttctcatacaagtgggacccaggatgatgatgttttgccatccaacgtcaacagcacttttgtataaatcaggacccatgtccctgaatataccccaacagcaccctgtataaatcaggaattgacctcgtccaagtcgaactctgctgcaagcacctcctcgtcttcgtcatttgcaagcttgatgatctcttcagttggccctgcgatgaacgaattcccataaaactttatagtgcctttgccatgctcagtctctcaacagtttcccttcctatccggggagaagcaacaagggaaaccaagt

SEQ ID NO: 72662 - DNA, 526 bp, Triticum aestivum
  Clone ID: PAT_TA_72662
gaggcagtataccaagtccttccctcaagtttaacaatagcgtcagtcaatcaccaaaaaataggaagcaaaaaattgaaaagttccacataagctttacaatcgtccttgggataaggatattgtttcaataatttctgacagggctatactttgggccaaaagttattttttctcacacaaacgggatttgagtagcctccaaccattgggaatattaaagctcatgttgggccataggcgggtacttttgctccatgggggactactccttcttgagctactcatgctcaatcggcagctcattcaaatcaaaattggggttattgatcatggaaacctgaacccctcgaggggccatttcccctacttccaagctccccagtcctttacttttgaccccaccaaccgcacttgacaacgcgatgctccctcgcatgcgcggcaccccctggaccggcgccatctcgttcttggccatcatcttgtcatcggaaacatggtttgcatgcagggtgggggccca

SEQ ID NO: 72663 - DNA, 352 bp, Triticum aestivum
  Clone ID: PAT_TA_72663
ccccaacctataacaacttccattttttcccatttaacccaatttcaaacataaaattttccaacatcccatcccaatccataaaaaaaggaattgcttcttacccaacaaccacccaaccaaaactaaaaaataacccattttgttttttcctcccttaaccacctttaattaaccccgaacaaaccaacccttaacctcccaatcaaaaaccccacaggactcaaccacccccacaacaatttaaacttactgacaaaaaaacttaaaataccttcctaacaaaaacaacaaaatggtaaataaatcaataactggagggccccccccttcacttcctccactgcccccc

SEQ ID NO: 72664 - DNA, 357 bp, Triticum aestivum
  Clone ID: PAT_TA_72664
agggcccaaacccgggagcctagggccctaaaaaaaacccctaaagcgaagggaacaaaccttacatgaaaaattctaacaaaattcggacttgcttgggggggggactacctaccaaaggggacaaagcccccaaactggcaaagggccctggaaaaattaagggaaatcccgccccccctttcaaggggggccccaaattttttaaccccccccccacgttccggtggttaaaaaatcccggaaaacaggggccccccccccaaaaggggggctccggggaggggaaaaaaaacaacgggggcggagggccccttgtccccgggcaggggaaatgcccctccgggaaacccccct

SEQ ID NO: 72665 - DNA, 545 bp, Triticum aestivum
  Clone ID: PAT_TA_72665
aaaaaaaaaatctcccagcttgttaacgttaaccaccctttttgaacatgtacaaaacaagagttttttccggcgaaacttttacggggggatgggtccaagttacatcatcattcaaacattcatcatagtccggagcagggctttacctaactcggggccggcggctttggcaagtggcggaggacttgcttgggcgtgtcccgggcggcaagcagcaggtaaagcaccaggttgccggccctgatgacggcccacacccaaaagtagtagcccaggggcccctcgttgagggtggccgccagccacccgggccttaacgccgccaccggggtcaccaccaccgagttgacgtaaaatcccacccacccccccaggaaggaaaaggcggaacaaatgctgcgcattgaccccggcgcctccccgtaaaaaaactccagctgcgcgatcccgaaaaacacgtccgacccggccaccaacacaaactggggcacctgccacccaatgcccatttttctgcccgcgccggccacccccagccgggg

SEQ ID NO: 72666 - DNA, 375 bp, Triticum aestivum
  Clone ID: PAT_TA_72666
aaaaaaaacagggggcaaataaacttatttgggtttacaaggcagtgggggattcaggaatacttacattttacccccaggggaacaaagcaacataccctaaatcggggtttgcgaccccaacctcattacaaaataccctaacaggaacttccctgaggcaaaaaagtcccaagttacattttgacccccttgcctgaaaaaaaaataaaaaaggccctacaggggaatttttttcaaactttcacgggaaaatttcatacctgaagggggaacggataccaaccgcggggctgaaaacaaaaaacccttttccccttttaacaccaaaggctaaaaattgcccaaggcaaaaaaacatcccttgggcatatg

SEQ ID NO: 72667 - DNA, 232 bp, Triticum aestivum
  Clone ID: PAT_TA_72667
aaacgggcccacctgaaaaaaattttcctttaaaacgggaaacacacccggaagggtaaatgcttaagggggaacacaacttaaagaaagcggggccccccccccccccaccctattttctaaacaaaggggggaattttgctttgcaaaaaaccctaaaacaaaaagtttgaaaaaagggcccccccaaaaaaggaggaccctgacccccccctggaggccggccttttta

SEQ ID NO: 72668 - DNA, 409 bp, Triticum aestivum
  Clone ID: PAT_TA_72668
gggaattttttttattttttattttttttttttttttttttttttttttttttaaaccaaacccaaaactaaaattaccatcaacacaaatcattttaattgcttaaaattcaaaaaaaccccccgcaatttggaaggcaatggacccccttacccccttttttaaaaaacaactccaaaaccccaataacaaaaaaaaccccaacccaaccccctattggagaaccccccctttaacttatataaaccccatttttttgcccccctaaaaaacattatattttggggtaaatttaacctccccctttttttttccataaggcctaaaaagggggtaaacctttttggccggaaaggcaaaaatttttttaacgggacccttaaacttttttttgccccccctcagggc

SEQ ID NO: 72669 - DNA, 236 bp, Triticum aestivum
  Clone ID: PAT_TA_72669
gttaatatgtaaacaaaacctgtgtttgtcttttattcccaagtttgaactaatatagttcgggttcttacatgatagtgcatgtcacattattttttcactgctacaacgaccaaaccatggactgaaaaaacggggtttcatatatctagtactaaagctattttcttctcagttagtaccgaaaatgccaaatggcgcaatggtgcaatatggagggatgtaaactttgcaca

SEQ ID NO: 72670 - DNA, 457 bp, Triticum aestivum
  Clone ID: PAT_TA_72670
gaaaacaaaacctgggtttgttttttattcccaagtttgaactaatataattcgggttcttacataaaagggcatgtcacatttttttttcaccgctacaacaaccataccatggactaaaaaaacggggtttaatatttctaatactaaagttattttcttctcatttaacccccaaaatcccaaatggcccaatggggcaatttggagggatgtaaacattgcccattgcaggtagggtctgtacccctaggttccttatttcctcaaactggggcaattgttgaggctggaaaaaaccctgggcctgtaaattttgctgaaatggccggaaggaaccctggcctaatggatattgttgctgaggcttttgaaaagaaacccgcctcaaaagttgttggtgttgcttttggggggaacccaaaataatagcctgaacaaccttggggatgggctg

SEQ ID NO: 72671 - DNA, 261 bp, Triticum aestivum
  Clone ID: PAT_TA_72671
aacccaaaactgggacatccattccttcaataacaagtcttatagcgggattccataaaaatggcaaccacccccaaaatcatcacagggataacctcaattgcaccccaggccaatgttacccccccaaaattaccccaaaaggcttcctctgacatgtaaagctgataaaaaaacaagggccataaaaacaactgggggatgttgttgactgaacctttggggatgacggaggaaaatggggtttcttggatttgccca

SEQ ID NO: 72672 - DNA, 349 bp, Triticum aestivum
  Clone ID: PAT_TA_72672
gaaaaaaaaaaaaacttttttttttttttcccccaccccaaaaccccccccgggggggcaaaaaaaaaagggccccccccccttttttttttatttaaaaaaagggggggccccctctaaaaaaaaaaaaacccctttttgcggcaccacaaacgccgatcctttcgacacccccacccccactgtctcttacctctactgatcctgctcctactacgaccactcggactcaaaaccccacccgcgtgggggaaaaaaacgctaaacaaaaaactcttcctccccccaaaaaaaatgattgccgggggggaaaaacccccccccccggaaaaaaaaaaccccccccacc

SEQ ID NO: 72673 - DNA, 421 bp, Triticum aestivum
  Clone ID: PAT_TA_72673
ccaccccgaaaccaaaattcctaggggaacccttttgcccaacccgtcctaatacaaccaaccctttgattttccagaaaaagggcccccttgcaaacctgggacccatcgattttcaggtaaagggggaatcctgtttttgcggcaaccctttcaaataaacttattttcccccgtttaaaaaaaaaggacgggcccttccaacattttgtggtacctaagccatcccaatttacatcccatccgcccttgctttgggggggaaatctttgggtgggaaatctaaaaaaaaggccttttcccaaaatgcttccaccaggccctttttttaaaggtttgggaggggcttcctcgtcatcccagccataatcccatcctttttcccacccttttcctgtgcttgaagggttgttcccccctg

SEQ ID NO: 72674 - DNA, 429 bp, Triticum aestivum
  Clone ID: PAT_TA_72674
aaaaaaaaaaaaacttttttttttttttattcccaaacttaaaaaaaccctgggcggggtcacacataatggcctcccccattttttttttcttccttacaaaaatgggggccttaactaaacaacaaaaatccctttccctattaaaaaaacttttgcattttttattggcccccaatgcccaaaaattttttggaaaatgggccctttatgggggaacaatcagggaaaaaataccccttccccatggggggaaaaattttaaataccaatgacctgatcccctccaattaacctggtttttaaggttgaataaacccctaaccctaaaaaaactaaaacaggggcccccggatctgccccccttggcgttttttttgctgcataaaaaaggaaccccccaacctttgggtgggtcccccctggacc

SEQ ID NO: 72675 - DNA, 391 bp, Triticum aestivum
  Clone ID: PAT_TA_72675
acccccaaacataaaaaaatgcatacctgctaacaacagtgataaagtgacaaaataacaaaaagataccccataaaagtctcaggcctctcaactaaaatacccataacccccacctttgataaatataaggggaaacctactaattccccattccttttcctaataaccaccggggtccccccccccacttgccttttttggggtttttctcttcaccctgcctggagggccccccccaaatggacttttcaaaaaaaaaacaatgggcttttaaaaatcaaccctcaccataaacaaagggacattgacaatctgcctcccaaccctgatgtggcgttgcctgaacaaaacacgggcatgggggatggattttcccctcccccccttt

SEQ ID NO: 72676 - DNA, 378 bp, Triticum aestivum
  Clone ID: PAT_TA_72676
aaacaaacatactctcatttttaatacaaaaatacccccaacaaaataaccctgaaaaatctttttttttaacaatcaacccattatttcccacccccaaaaacaaaacttttattcaacaaaaccccacaaaataattttcataggctaacaattttcaaacatggaacccaaccataacaaacctactaccatcctgcaaaatccgaaaactggaaggcttcccctaatgcaacttgactttttcctccccaatttaaaaaccctcgaaattttccccgtattccttcacaacaacccatgaacaccccacccccttttttgccttgccctcaaaatcaattttgcaaaccccaccccactccccaaaatttttgg

SEQ ID NO: 72677 - DNA, 388 bp, Triticum aestivum
  Clone ID: PAT_TA_72677
gggaaaaaaaaaacttttttgggtttttttcccaaacctgaaacaaccccgggcggggggacccaagaaggggcccccccctttttttggcatcggtacctccatggggggctccacttaaccaccaagaaccccttccccttttatttaacccttccagtttttattgggccccaatggcccccaattttttgggaaaaggggccccctttaaggggccccccgggggggaaaaccccttgcccatgggggggaaaaattggcacccccaagatttggacccccccaaatgaaccgggtggtgggggtggaaaaaacccccgccctgggacaaaaaaacctgacccccccgggggtggtgaaaaaaggggcaaaaaaaatccccccc

SEQ ID NO: 72678 - DNA, 375 bp, Triticum aestivum
  Clone ID: PAT_TA_72678
gtttcaagggaaaccaatggattttattccaaatcaaacaaaatccttggcttttaaaaatttttttcaaacctaacccgtcctttaccctatttggactaaatacccgtggacccccgtcccccattttcggccggttttaacccccggaaaggaaacctccacctccccttttgaaacctgcagccggttaatcccctgttgaggataacccacagggtttactttcaccaggaggacaaaaccgggggccttctgggaacacaaccgtgggttccctccaatgctttaatcggcctcgttgccaacggcccccgcaaacatccctgtttcgtcgttgtggccccttgccggggccacggaccccccaccccc

SEQ ID NO: 72679 - DNA, 335 bp, Triticum aestivum
  Clone ID: PAT_TA_72679
gggtcaaacctaaattatacccaaacctacccaaaaactggttcacacattatgggggccccatgggccctcaaaaccaaattggggaaatttataccaacaaaaaacattacttacaacagccgggcccacctcaggggaattactggcccccccgggggggggacccccaggggggggggggccccctttggaagttgtaatccgcaagggggccggccttctccaactggttgccaacaaaaaataagcccctctgggcaagggggaaaccctccttggcccggaacttgggcctgaccttggcaaagggggcaaaactcttaacccccaaa

SEQ ID NO: 72680 - DNA, 407 bp, Triticum aestivum
  Clone ID: PAT_TA_72680
gaccacccacaacgaaccgttcaataattcccccaaacaatgggtctacatgaaaaacgtccaatgggggacccataaatcaccaatcgatcaaccgacgggtctttacaatttcaaatcatttgatgccccaattttccaatcatgaaccggcccttaatttttgaggagctccttgacaaaggggaccaccttggccttggccaccggccacccccccgaaatgggcgggttgcccgaccaccccttttccgacttgaactttttgagccccatgtccatggggggggggcctctgcaaaagccctggggctccacccgcaccacgccctttctgaaggggaaaaactccggccggaccaacgccccgagggtcaccgggtcggggaggaacaccgggggggccc

SEQ ID NO: 72681 - DNA, 272 bp, Triticum aestivum
  Clone ID: PAT_TA_72681
gaaagaaccaagcttcgtcttaacagaaggagccacgagaacgatttacttcacaacggggccaggaaaacgaaaatttacataaccctttacgccagcttggggggcgaggtaaaaggggggacctatgggccctacgggagggccaccgcggggtagtcgtcgtcggcatcggggtcgggggcagaatccgcctttcgaagggcccgggggagggccctcacgggcgcggggcccgtcctggagcaccctcccagggggggggggcccgc

SEQ ID NO: 72682 - DNA, 404 bp, Triticum aestivum
  Clone ID: PAT_TA_72682
attcttaactccctctccaaaggggatgaataccaaatttgcaccttattattcatcggtgttaaataacaccgctcgcaggcacctccgtacatataaaggcgttaatccacacacacacccacacactggtaacccataggagggcgaatgaccacccatttacggggttcgggcctggtcaaggcaatgctgcccccaattcttcacctcgtgcgccttggaatccaacttcccccccgcgtggtccaccgtgtcggcccccggcggcaaggaccccccgtgcgaaaggtacttgtacattcacgccagcacccccaccgccgccgcgccgaacgcccccgacaacacaaacccggccgtcaacatcgtcaccgcgatggccgcgggcaccaacacggggc

SEQ ID NO: 72683 - DNA, 345 bp, Triticum aestivum
  Clone ID: PAT_TA_72683
aaaccaaaaacccggcatataaaccagggggcaaaaaggggtaaaaaaaacaggggtttaacaacacaacggggggaaaaacaaccccccaaaaacaaaaattcaaccaaacaaaaaacaaataaacccccccgggcaaatcaggggaaaccccccccccccctggggaaacccccagggggggggctttaatcctcggccccctggaaaccgccccaaccctgggaaaaccaaacaccaattttttaatagcccttccccggggcaaaaaaacccccagggccccaaaaaaactttccctcctccaggccctcacccacgtaccaggggacaaaggccccctgg

SEQ ID NO: 72684 - DNA, 241 bp, Triticum aestivum
  Clone ID: PAT_TA_72684
attggggggccccatgttgaattgatccgccccagggggggggtttttttaaagcccaatttgaggaaaaaatttggagtaggggacaagtcgtacctggtttaaaccaatcctatttctaacttaaacataattatccttttaatattcccccccaatcctaccgggagtgaaccgggccatggccactgaatttaaacttttatgcttccgccgtctttttttttccgccatcataaat

SEQ ID NO: 72685 - DNA, 366 bp, Triticum aestivum
  Clone ID: PAT_TA_72685
ggcaaccaaaaagggggtgggggaataacccattggaacccgagaaaaaacacggggcttttattaccatatttaaaaccctacatttaatatgtaaattcctaaaattcataatttttataaaaaaaatccttcaaatgatactcaaaagtaatttaaccatcctaattaaggggcaaaaataaattggccgggatctaaaatccaatcgagctaaaattttttatcctcaaaaacaatggaaaaaacatttttggtacctttgaataaaagggaaacaaaaatggggccctttattaaaaggcccaaacccttggggaaataaatggctaactggtcctttgtacctaaatcctcataccttaa

SEQ ID NO: 72686 - DNA, 414 bp, Triticum aestivum
  Clone ID: PAT_TA_72686
ggaacaaaaacaaaaaaaaaaaaaaaaccctttatctcaaaaaaatggggggggggggggggggaaaccccaaaaaaaagggctttaacccaggggtcggggccaagggggggaaacttccacccccccccggccagggggagttttttgggggggccccaaccccttaaatttttttttacgggccccccttatgggaaggggggggtaccccgaccctttttggaaggataaaaaccctttaaccctccccttcccctgaaaacctcaaaagggccatggggaaaatgcccaaaatattttaaaaaatggtggacagggttgaaagggttggggaaccaaagggaaaacttaaccccttttatgaagcctaaaccccaaaaaaagggccaaaagggcgggggtaaaatattt

SEQ ID NO: 72687 - DNA, 251 bp, Triticum aestivum
  Clone ID: PAT_TA_72687
ggggcccaaaaaaaaccggcctatttcacgggttcgaaaaaaccccgggaatccccaggggggggggaaccggaaatttttttatttgggccccggggcaaaaattttaaaaagggccttgggttgggtccttacccgggggggggtttcaaaaaaattccccaaaaaggcctttaatttaaggcccaaggggtccaaaaaaaactttttggggccgctttttcccccctcaaaaggggccctcattttgg

SEQ ID NO: 72688 - DNA, 337 bp, Triticum aestivum
  Clone ID: PAT_TA_72688
ctttggagaaaaaaacttaatttgccttttattcccaagtttgaaccaatggcaaccttatgcacccatgataatgcattggactttatttttcaccggttcatggatcggaccattgactaaacattggggggccattttttggatactaaaactctcgtctttttaataaccccccatgttgggagtgacctcactggatggggatatgggggggtaacaatatgggggaacattccccttgcacattggcgggatgggctgaatcacccatgttcctattaccgcaattcaaccctgatccaattgtgtttgttggtgggggtggctaaaaccc

SEQ ID NO: 72689 - DNA, 332 bp, Triticum aestivum
  Clone ID: PAT_TA_72689
acccccataaaaattgctggaaaattaaacatacaaaaaatagtcccacaaaaaattgggtttggcaaccaaactgtaaaaacacaaattgccttgctgcgttggggccggctttggatacctaacatgaatgattgggaacaacagtgggggtaaactaaaaaacaaccgggtaaagcttgggccctaggggctaaactatgttcaacaacctcaaatttgaaacctgcctttttaaaagcttcttcaaatttggccgccccaaattacctttcgctaatttttgaggggacaactcatcctccttttgccctgccttgtggaacttgagg

SEQ ID NO: 72690 - DNA, 409 bp, Triticum aestivum
  Clone ID: PAT_TA_72690
gcccaaccaaccggttaaaaattaaatcccaatgcccccccgggccataatttaaataacccaattttttactcccgccaaacaaacaaaacttaaagggaccgggcattgggcaaaaggcccgactttaacaaaaaccccccttgcaaaaataccctgggggggacaaaaaccccttttactcgtcgtcgtccccgtcgtcatcggggggccccgcaaaatttttgagggggttgaaccttttaaaaagggtggcccttctttggttatagggcaactttttgggggtggaccccttgggaatcttgggaggcgccctggttgatttggccctggggggaacaacacgggtgggaacatgaacctttttggaaaccggttccatgttatcaactgaaaatcccctctt

SEQ ID NO: 72691 - DNA, 526 bp, Triticum aestivum
  Clone ID: PAT_TA_72691
gtctctatatgcagatggtgattgtcttgttcatctttaatcagccgaaacctatctccatacattcgcctgccacgccaaactcgttttgagtttcttcttcagccaatcaaccagtcaaatccacaacaattaacaccctgaaacccatcgacccggcacacgaatttaccttgccatctcaaaacctccataaatttaccttgccagatgataactgagcacctgcaacgacaccctacattacagactggagcatcatcctcaccccttgatcaccccagcgtttctgtacttgtaccggatggccagcaccaaaaaaaagacgtagttgagcgcgctgagcacgcacatgagccagtaaaaccgctcgaggtggtagtggttcaggctcgccccctccagccacgcccggtgcccgccgcgccccgtcgcgctgttcaccaccgtcaccagcacggagctcaggtagtaccccagcgccagcgacgcccacgacagcgacgtcgccagcgaccgcatccgc

SEQ ID NO: 72692 - DNA, 163 bp, Triticum aestivum
  Clone ID: PAT_TA_72692
atttttttttgacgcatgacattttattttgccactgctattttgatcaactaacagggaccatcggtataactagctgtcatgggaatgctataaggggtggtgggggaggctgggccttgtacagggatgtaaattttgcacatccacgggagggggtgaa

SEQ ID NO: 72693 - DNA, 458 bp, Triticum aestivum
  Clone ID: PAT_TA_72693
aggcggaaaaccttttcatctggcattattagggggctttaccctattcacccaaaaagcggggaaccccccccccgtttatgggataactaaggggcaggcctgcccaacccccatgcaagcgggaaaaagttctatcccggccggggcaaaaaggcgtcgctgccccccacccggcacattgccgggagctgggccccaagctgctgcccctttgccccctttaggggggcccccggggacccccccctaacagggggggggcgggggaaccccgggggcccttggccgggggggggcccctgcccggggggccacaaaaaagggggggaaccccctgggggcccttgccccgaaggaagcccctgccccgacggggggaaaaaaatgggaaaacccccttggggcccttgcccggggggcaaccattgcccgggggggggcccaagcccgggggg

SEQ ID NO: 72694 - DNA, 473 bp, Triticum aestivum
  Clone ID: PAT_TA_72694
aacccaaaccaatttattcataaaaataggggggatgaacaaaccggaatttaagttccaacaaccactcatttccaattccaaagggttttataataaaaataaataaataaataacaaagttctaccaccccctcgagctttcggggtaaaaaacacacaaatttggatcaaacttgtttcacccaaaaaatatttggatgcctatgtttgggtttctcaaacccccaaaacccctaaatcccaagtttcgcaggggggcaaccacccacagttgtttacttgccaccaccgatttccttaaaagggcaaatttgtttttcacccatgggggacattaaaaacaggatcaggtccttgccataaaaaaatccagttttgatctggccaaacaaaacattatcagggggaagcttcagggcatccttaaggttgccactctcagttaaaagggtgacatatccatcatcagt

SEQ ID NO: 72695 - DNA, 376 bp, Triticum aestivum
  Clone ID: PAT_TA_72695
aaaaaaaaaaagggggtgggtttttttcccccggtttgaaccatttttggcggggttcttacaggaaagggcggggcccttttttttttccccgctcccccccccaaccctgggcctaaaaaaaggggggtttatttttccccccccaaggttttttttttttcagttttcccccaaaatccccacggggccaagggggcaattgggggggatttaaaccttgccccttggggggggcgtttttacccccggggcccttttttccccaaacgggggcatttgtgggggggggacaaaccccggggccggggggttttgctgaaagggggggaagggcccccgccccgagggattttggggttgaaactgggggaac

SEQ ID NO: 72696 - DNA, 329 bp, Triticum aestivum
  Clone ID: PAT_TA_72696
gaacccttattacaaaattgaacagggctctttttaactggttacttcaaaaaaaacattttaggggccaaaatacaaaaaaacaattgtttgacagggaaacccccgccggggctgggtcaataactgggggtctcaggaaaataccccgtcccttcgggaattgcataaccccctcccatcccaacacaatccctagggacccggggatttaattggccatccaaagggctcctaactcctttaaaaatttgacaaaaatttaggacttggtggcaatgttggtggacaaccaatccaggcctttatacaggccctcccctggtgga

SEQ ID NO: 72697 - DNA, 418 bp, Triticum aestivum
  Clone ID: PAT_TA_72697
aaaaggcaccccccaaccgggccctaatttcccttaaaaggggggcaaacaccccaaccccacaaaaaagttaatccgttcttggggcttaggggttaagggaaaaacaaaagggggtctaaaaaaggggaaatccttaaaaacctcggaaggaccgcctaaacctttgggggggggtaaagggggtacctgggggaaaccttccaaaggcaaacgtgggggggggccacctttttttcaaaaaccggcttaaggaaaaaaggggcttgggcctttgcccaaaggaggggaaatccctgggggaccggctttggaaaggacctatcacctccttaaaaccccaaccaaatggcctgggatttgcccggccaaaaggcccccgaggggtcggggaaaaacaggcggggcccattttcat

SEQ ID NO: 72698 - DNA, 474 bp, Triticum aestivum
  Clone ID: PAT_TA_72698
ggccctttgggccaacctgagggatattacctggaaaagggcccatctaccccggccaatttaaaatggtaccgggtacaaaccccggggaaagacccccccacaattgggcccccccttttttaaatcaaagggggcaaaactcccaaaccccgggggggggttccccccccaaatttaaaaaccaaaaccccctgggcccttttttccaacctgaaccaaccaaattaaccccccccccccttgggaaaaaaaaacccaccccaaagggttgctttgggaactcctaccaaaaaccaccccaattttgatgattgccgtaaccactttaaaccgccaggggggttgggaacccaaaaaccccgaccctgaaaaaaagggccctcagggaaaaatttgcccgctggtggtggggccccaacgggccctggggggggacccccggggcctcccccatatgccccccctggaacc

SEQ ID NO: 72699 - DNA, 464 bp, Triticum aestivum
  Clone ID: PAT_TA_72699
cccggcccaaaaaaggtaaaaaaacgggttgggggcccggggggcgggggtccccctttcccccaaacccccaatcccaattttaacaaacccaccggggcctttaacatttttccccttcaacctttaaacccaagaaattggggaaggggggggggggcccccccaaacaccggggggaacccccccccccaaaaaggggggcggcccccccaaggggggccaaaaaaaaaaaggtaacccccccccttcccccttttggttggggccaacaaccaaaaaaacttttaccggtttttccccacagggggcaaaaaaaaacccctttttttttcacccaaggcaaacaaaagggggttttcgaacccaaatttttttttcccaacaaggggggttccctaggacccaaacatttgggttttaacagaaaggaaaaacccccccccccttaaaactggggggga

SEQ ID NO: 72700 - DNA, 378 bp, Triticum aestivum
  Clone ID: PAT_TA_72700
accgaaaaatgtttccctgggccaaaaaatttttttctttggccgcccccaatttttttgaaaagccatgaataaggcccccaaaaaccttccccattttttcaggggaaggtccccctgggggacccccccccccatcccccaggggggggcccccttctggaaaccccaatgggcccccccaaacgtgcccccctaaaacccacccattggggcttttgcaaacattgggaacccttgcttccctgctttaggccccttccccccagcacccctttctcctacaaggggggggggcccttttcccctcgggacaaggctaaaacccctggaatagtgggccctgaaaaaaccaaattttgggggcccggggaaagt

SEQ ID NO: 72701 - DNA, 508 bp, Triticum aestivum
  Clone ID: PAT_TA_72701
gtttctcttttggacaatgcatgttttctctccatgaaacaactggttcatctgatttgatcatacggttttgggtacaaatttctttctccaaagatggctacaaataattcttctacgcacaatattaatgacaaaggagttctacatacgactgggaaattttcccctaaattttcttgaatctcaaatgacttggggtctggtaccatgatctcatataatcttagtgcaccatcctaggcatgctcactggcaccttgcccagcggggaagtgcggatcacggcctcaaagcaccccatcgctgggacaggcgaagccgaccccaccggagatgacgaccccactatcttcgcccgcacagtggctggcacgtcaaggccgcgggggttcataatgtcggcgccgctcgccgtttcctcctcctccgcgtctgatgcttctgcgtcgtctgtgttgggcacgttgtcgggttcctgcacgatacaaggatgccccaggctgct

SEQ ID NO: 72702 - DNA, 441 bp, Triticum aestivum
  Clone ID: PAT_TA_72702
accgggcccccaaaaaaaaatttttgctttgtcccccaacttattttttgggtttggcccccccaaaccccccaaattgggggcaaaaaaaactcgggggcccccggggcccttggggtactcaagcaggggcccccccccgggccccccccctccgggagttgcctgcacgggcaggccggggggggggtcccccccaacgtacggggggccccccccccttttaaaggggccggacctgtccctgcccccccccatgaaaaaaaaccggagttgcccccccccccccacccaatccggggggagggggtccaccgggtcccccaaccccggggggggggcccccccgttccctcccaagagggggaaccccccccctttggggccggggtcctggaaccccaaagggaactgccccgggggggccacctttttgccggg

SEQ ID NO: 72703 - DNA, 331 bp, Triticum aestivum
  Clone ID: PAT_TA_72703
ggggaaaaatattggtgggcccccaacccatggggggggaaaaaaccaagggggcccttaattcttttcaaaaaacaaaaacaatgaataccaaaaaaaaattttgggaatcttgaaacaaattttccaacccccccaaggaaacaagaacattttattaaaacatgggcccaaaaattggaaaccaggggggggaaaccggcccttttatttttggggccaacgggtcccaaaattgggaaaaacccgggctcccaatttttagggggaccggggctttaattcggggaaaatttttatgggcctgggcccttgggggtaaatttgcccc

SEQ ID NO: 72704 - DNA, 164 bp, Triticum aestivum
  Clone ID: PAT_TA_72704
ggggggggcacacatgaaattgggggaaactttatttgtcacccctgcattgacattttcattcacttaacaacggggaccccatttttttttaccaaaaaactttccttattaatagggaccaactcccgggcccacctccaatgggacacttatggggggtt

SEQ ID NO: 72705 - DNA, 479 bp, Triticum aestivum
  Clone ID: PAT_TA_72705
gaacaaaccaatttccagttttaaatggttaccaatggagcaaaaacaacaccctgtcttttttctaacgtttcccaacaacccaaaaacaaattttgtgctccaaatgctgctgggttcttattgcctggctccccaatgacaaaggcggccatttgctaaacccatgctcatttgtataactgcttcaatcttctcgcaacttcaataatgttctctttgggcccaaatgcactgacccttacaaaacccttaccaccgggcccaaattcactggcgggagtaatgaccacctttgccttttcaaggatctcggcaaaaacatcccaagaattgcggccaaaaaaatgcacccacacatagggggcattcttggcaccgtaaacgttgaatcccaacgactcaaacgtgtccacaatgattttggggttctccttggaaaatcccacaacgttttgcataacctttaaaccctttgg

SEQ ID NO: 72706 - DNA, 386 bp, Triticum aestivum
  Clone ID: PAT_TA_72706
cccaaagtttaaactaaaatagtgggggtttttaaagaaaagggctggtaaaatttttttttcaccgttaaaacaacaaaaccggggggggaaaaaagggggtttaatttttttagtccaaaagttttttttttttcatttaaccccaaaaatcccaaaggggccgagggggcaattggggggggtgaaaactttgcaaattggggggagcgtttgaacccctaggttccttttttcctcccccgggggcatttgttggggggggaaaaaacccggggcctgggggttttgttaaaagggccgaaaggacccccgccctaagggattttgtggaaaagggtgtggaaaggaaacccggcccaagggggggggggggggtttttggg

SEQ ID NO: 72707 - DNA, 400 bp, Triticum aestivum
  Clone ID: PAT_TA_72707
aaaaaaaaaaactttgttggtttttttttcccaagctggaactaccccggggggggggcacacatgaggggcccgcccctttttttggccatcgttccatggatgggggctttggctaaccaagggggacccattttttttttattatggggctgggttttttaatgggccaccatttccggaactttgcgggcaaagggggccctgatgtgggacccctcgggggggacatcccctttgcaaagggggggaaaaatttgcaaccccaaggaccggatccccccaaattgacctggttgttggggggggataatcccctggcctggaaaaaaagtcccttgccccctttgtggtggccaaaataggggaaaaaatttcccccggcctggggggggggggg

SEQ ID NO: 72708 - DNA, 335 bp, Triticum aestivum
  Clone ID: PAT_TA_72708
aaaaaaaaactttttttgttttttattccaaaatttaactcctagttgggggggcccacatgacgttggggggaccctttttttggccccggtccctcgacttttccatcgactaaacaagggggatctaacgacttttttttactaaaaatttttttttatcagtaccccccaactccagggccaatggtgaaggggataatagggggcgagctgtacaacgggccgttgaccccgcacatttttggcaagggccggggtgcaatggaagtcatccccccaagtggaaattttgggggggggtgcaaaaatatcccctggggtttctgttgttg

SEQ ID NO: 72709 - DNA, 211 bp, Triticum aestivum
  Clone ID: PAT_TA_72709
gggctaatttactttttttttttttttttttttttttcaccgggaaaccttttccttttgcattattatgggggcttaccccacttacataaaaaactgggaacccccctccccttttttggatacctaaggggcatccctgcccaaacaccatgcaagccggaaaaagttctatcactggctagcccacaatggctcccccccctccatc

SEQ ID NO: 72710 - DNA, 467 bp, Triticum aestivum
  Clone ID: PAT_TA_72710
aaggggaaaaccttctgacctttcttttttcatgtaaaacatgccatttttttcggacaaaaccttttttcaaaaacaaagggcctggccccccctgatgatgtttggcccttttattttataacttttcatcgaccaactaaacggggatccatctacctaccccatcacaaattttacccggccccccccccccaggttcctgtcatggggattttgtaaatggcgggggcaatggtcccccccgggggggggggccaattttgggggatgtttcccctgcccctccacggaagggtctgaacccccctcccctttttttcaaccggaacctgctgttgaggctgcccaaaactttccccttgctgctgctgaggctggccaaaaccttccccttgctgctgccccatgataatctgtgccaccctacaaaccgtttggccccaaccctgctccaaaatctgggc

SEQ ID NO: 72711 - DNA, 328 bp, Triticum aestivum
  Clone ID: PAT_TA_72711
ggggcaaaacaattttctggtgacagtcaaacccgggtaccaacaaattttacacacaccaatacctggggtacaaaaaccctagggacatggacatacatttccggctgatggcaaacaattgaaaaactactggaaaaaaatgggcatttggtctaacaaaaatccatcgggtcaatactaaatacaacgcttggacttttgggaatgcaaacccacaaaatgggcctgcaatgaaaaaatgaaggggtttttgtaggaaaaagggccaaatcttgacacaacaaacctttgtaatgaacccgcaccgggggtttcaaaacttgaa

SEQ ID NO: 72712 - DNA, 310 bp, Triticum aestivum
  Clone ID: PAT_TA_72712
ccaccatttcaccccctaattaataattttactttacaaatccttccccggtaaagtacaaaaaccaatcccagtggccaaataataaattacccctcctacctaggaacaaaaacagtaagtcagcgtttgtccataggggccccgttttcctacaaattaaaataaacttaaacctactgtttcgcaggggttaaagttttcaatcaaacctaaaaagggaaaactgtttggccccagccacaccggtactaacttacttaaggcaggcctaacaatgccggggggccaataaacccaggctcgttgc

SEQ ID NO: 72713 - DNA, 207 bp, Triticum aestivum
  Clone ID: PAT_TA_72713
aaacacttaaaagttaatggcatcatggataaaccattttcttgttacagcaaatacagtactggtcacttattccaggacccataccctacagtacaccttttcagtttcaatgaaactagctaagtactcgctagcaaccttgtccatgttcctatgacataataaggttattcacatgggaactggtggccttacccaattttt

SEQ ID NO: 72714 - DNA, 306 bp, Triticum aestivum
  Clone ID: PAT_TA_72714
gggggaaaaaaattttattttcccattttccctcaaaccccttaaactggttatttgtttcaaaatcttattttttatattacaccccccaaccctgggtttgctttattttgtctcctctacattatactgctgtcaacgggggccaaaaccccttgggaaaattcaccaggcttgccttttatcccccacatttttcaccaatttaatcaccggactttgcccttaacctttcatggaacacccttaaaccggaaattattccccggatttttttcttcttccgaaagatcctgccccttaaat

SEQ ID NO: 72715 - DNA, 408 bp, Triticum aestivum
  Clone ID: PAT_TA_72715
gccaacaaacaaaaactttggttggcttttattcccaaacttgaactaacactgggggggggcacacatgagggggcccacccctttatttggcatcgcttcaaccattgggggcttaactaaacaatggtgaacttgcatttttcattggcccccaatgcccacgtctatgttgggatatgggaccttgatggggggacaatcaggggggacatacaccttgcacatgggtggaaaaatttttaataccaatgacccggtcccctccaattgaaccgggtggtgagggtggatgaaacccaaaccctgggggaactgaaataatggccccaggaacggccccccttggtggtggtcttggtgcatgaagaaggaatgccccaccctggggatgggtgccccctggaa

SEQ ID NO: 72716 - DNA, 350 bp, Triticum aestivum
  Clone ID: PAT_TA_72716
gcaatctaataacttgcatttcacaacaaatcaatctcaggggcccaagaatttaacccaccccggaataaaaataccgtaattaaaccacaaacaaatcattgctccctcgggataaaaatctgaaacaacaaaaaccatgacccggaacaaaaacattctgctaaataacacccctatttcttcttgatggcaaccttggtaaccttggcgcccgggggggcctttttttccacccccttgatgaccccaacagcaaccgtttgtcttatgtcacccccaacgaaaccgcccaaaagagggtagggggccaaaggctccacaaccatgggcttggggggaatcatttt

SEQ ID NO: 72717 - DNA, 301 bp, Triticum aestivum
  Clone ID: PAT_TA_72717
caaccccaatttttacggggatccttttattttaaaaaggggattttcccaatccttggataataaataagggccccaggttgccctggggacagggaaaaacaaacttttaacctggcaaccggggcaataaaatggacttccacccaaggccaatataaacttgggctggaaacaactttttttttattttattcaaaaattaaaacaactagtgggggggggcaacacaggaaatggggggacctttttttgggccccggtgcttcaacttttccatggactaaacaagggggaccca

SEQ ID NO: 72718 - DNA, 416 bp, Triticum aestivum
  Clone ID: PAT_TA_72718
ggggtccaatgcatgaaaaaaaaactcattccacattgcctcagggctttgctaatacaaaacaactcaaagttcacacatgaccaccaaacgttacaactcatgttttcccatgtaaacaagggaaaactggcataatatcacaggttgggcaccggtagttcgtcatttccatgataacactgactatgtcacccttaacaaacttgaacgccttcacagccttgggcctaagcaccccggcctgggtcatcaccaactcaatgtccttcgggtcaactccgggctcatcacaatcctcgtcatcctcctgaatagctgtaaaaacctcaaggtttgaaatgaccctgctaaaatcaagcgccttgaattgctcaaccgcctgggactgcaactgtgaactcaaatcctcaatc

SEQ ID NO: 72719 - DNA, 423 bp, Triticum aestivum
  Clone ID: PAT_TA_72719
ccagcaaatgtcctgtcctgtaaatcatcaggcaaaaggggacctacaaccctaattcatacccactgggaaaaccaccaaaaaggaccatccttcccaatgtgcggctgttctggggggaaacaaaattttttaaggaccggaaggtttcatttattcaaaacatcaaaggaccacctgcccttcaaatggggatttacccaaggcatgattaggccacccccttttcctccaacagttcctgggggggggcatccatttttttcctcaaaaactcatcaatcgggaccccttaaacaattgtccattcaccaccactgcactttactgggaaggattaaataaaaccaccaggcccaccgtttaaaccatcaaagtccacacccatggaaacaaatgttccctcgggggttcccaaaaccc

SEQ ID NO: 72720 - DNA, 348 bp, Triticum aestivum
  Clone ID: PAT_TA_72720
aattttcaccccaaaacacgcaaatttccctccataaccccccccctttttttttttattttacccaaaaattccaaaacctcccccaaacaaccccaatacccgtcacatttttttgacccaaacaaatttaaaaaatccctttcctgggtttccccccccctttttttcaaaatggccaatggtttgccattcacggctagggtagggtaggggggcccaacccaaaaacaacccctttccaggccccccccgcccccttacttcccccttggaaaaggggtgttatcaacataacccccccacattcccatttaaacttttttttgaaacttttgcgggtttccc

SEQ ID NO: 72721 - DNA, 402 bp, Triticum aestivum
  Clone ID: PAT_TA_72721
gacctccaaacatactttgggtaatgccataagtgtttgccaaaccaccccgcttttggatcaaaaatcaaaaatcccataaataacatataccttcaacaaaattgggtttcaagggaaactttttgtaaagtacacaacaagggcgaaaatggggtcaacaaaatgggcagccaccaaaatagttcaaacacctttggtttttcatttatccagggtacttgggaaggggtaccctcgatttggctcattctaaaacctgaaatggttaactagggccatcaacctcgaatttatttggttttcttgggcttggcctttggaaacgcgggacccttcaaccactcgtccatgttggggtcaattgttccaattcccaattccaccttggggccttttttt

SEQ ID NO: 72722 - DNA, 543 bp, Triticum aestivum
  Clone ID: PAT_TA_72722
atttcaataggaacattctttgatgtgcaaacaagtcatccaccaccacagatgtgcaaaaaatcaatcaattatcatcttgatatttggtgcgcaagggcctcaaacatgcaaaaggaactacctagcgacactgaaaaaccaaaatctgaagttccatgtttcagtctgaggataccaatatgggtgcaagatttttgtccaaaaaagtacaagtattaacccaacataacgtgttgaagctagggtccaaaaacaatcgacgtggacttcagtcggccatcgggaatggcaaaaagcatgattggtttcgatgacccgacaaatggaacatcacacctgtaatagcctttcctttcgagctggataacttctcctcgcttgatgttccgcatgtttgggtctccaaaagctaaagcttctcgtcgggtgcatgggttaaaattttcaagaaacttctcacctccgggtttatcatcttctcccagttgaagctttttattgatgattagggagtcaaaatccaccaaagagagagacaca

SEQ ID NO: 72723 - DNA, 350 bp, Triticum aestivum
  Clone ID: PAT_TA_72723
aaaaaagggcccctctgcataaatttccttgtaacacctaatccccgggccaaaggggggaacgtcccttccaaatcctggtccaaaaatggcaaaaatgataccaaataaccccaatgcccccatttaaatttaaaaggttgggtcaataataacccccaaaggggtgccccccgtctcccaaaacggggggtttaaggaaatcctttttttaaaccaacccccggccctttttttttttcctcctgggcccccccaacccttttgacaaaagggtccaaacctttcaaaaaaaattgccttcttttttgggttaaccccttggggaaccaaaaaaatttgggtttttc

SEQ ID NO: 72724 - DNA, 331 bp, Triticum aestivum
  Clone ID: PAT_TA_72724
aaaccaaaaaacctttcatcttccattattattgggctttaccctatttccccaaaaacctggaaaccccccccacctttattgtataactaaggggcatccctccccaacccccatccaacctgcaaaaaattttatccctgcccgggcaacaatgcctccctcccccccaccccccacattccccgcacctttcccccaaccttctccccctttcccacctttaagccgcccccctggtacccccccccaacatgggatgggccggcctacccctgttccccttgccccggttgttccccttgtcccggttcccacaaaaaaattgggg

SEQ ID NO: 72725 - DNA, 360 bp, Triticum aestivum
  Clone ID: PAT_TA_72725
gacccctaccccacttatcacattaaattaaaaatttttttgtctgaacattccccaacgatttggaaaatataccccaatttttttccctttttccccagtcaccattttaacagcgggcgttaataaaaccataacccaaccacggggcgaaaacaattcccaaattccattacaggacggggaccctgggacacaaaatttgcaaatccccactaaaacttattcaacttttggacccttcccaatgactgactgactgactgggataaaaaaaaggggctaaacaaactcccccttgggggaaaacccgacggggacgggcaagcccaattttgggaggggggccaaaaactgggg

SEQ ID NO: 72726 - DNA, 314 bp, Triticum aestivum
  Clone ID: PAT_TA_72726
gtttttttaacacactacagggcccatttcctaaaaaacccatacaaattacatcaaaatttaaaattcagaatcatggtcccttttttcacttttttcaacactctttttttccttacaaaaacgcccgtttaatcattcaatcacaaggggacacactcacacaaacaccattgccacacttcttacacggttttattttgacacaacaacattattctttaccagcggcaaaggactactactacaacggacggacggactgactgaccgcaacataggaccacttggggggcttgtcccccgactaatcc

SEQ ID NO: 72727 - DNA, 351 bp, Triticum aestivum
  Clone ID: PAT_TA_72727
aaaaaaaaaaatggtttttttttttttcccctttttgaaccaatttaattcggggttttacataaaagggcattttactttttttttttccccgttccaccacccaaccctgggctaaaaaaaccgggggttatatttttaccactaaaagttttttttttttcagttatacccaaaaatcccactggggccatggggccatttgggggggttttaacatttgccatttgaggggacgtttcttacccttgggttcttttttccccaaaccgggggaattttttagggtggacaaaaccccgggcccttggggttttcttaaaagggtggaaagaacccccgccctatgga

SEQ ID NO: 72728 - DNA, 358 bp, Triticum aestivum
  Clone ID: PAT_TA_72728
ggaaaaaaaaaccgggttttgttttttttccccaatttgaaccaatttttttcggggttttaacttaaagggcctggcaaattttttttttactggttaaaccaccaaaccctggggtggaaaaacgggggtttattttttttttactaaaacttttttttttttaattaatccccaaaaagcccaatggggccaaggggccatttgggggggtgttaaaatttcccatttgggggggcgcctggaacccttgggtcctttttttcccaaactgggggaattttttaggggggaaaaaaccccgggcccggggggttttcttaaaaggcccgaaagaaccccggcccaatggattttt

SEQ ID NO: 72729 - DNA, 230 bp, Triticum aestivum
  Clone ID: PAT_TA_72729
ggaaacaaaaactgggtttgttttttattcccaaatttgaactaatataattcggggttttacattataggggctggtacattttttttttacccgttcaaccaccaaaccatgggctggaaaaacgggggttcatatttttaatactaaaattatttttttttcaattaatacccaaaattccaaatggggccatggggcaatttgggggggtgtaaacatttcacatt

SEQ ID NO: 72730 - DNA, 310 bp, Triticum aestivum
  Clone ID: PAT_TA_72730
cttgctaaccctctctctcgatcccttggcctctccgtcgtctccctccagtgccgccacgcgcacacaaccagcaccaggaggagcgccgcgcccgatctgctccaagccgcgccgctggccatgccctcgaccggatcctgcagccccgcgccgtccttccgtgcaagctgctgctttgctccggtccgccgcccctgctccgaccagcaggcgtgccgccgccgtccaggaccaccatggcctacccaagctcctcgcgatctccactcgagccggcccgccgacgtcatcgctaccccgcgtcccc

SEQ ID NO: 72731 - DNA, 631 bp, Triticum aestivum
  Clone ID: PAT_TA_72731
cactacttaacaccaatccaccatgaagaccgggctcgtctttggcctgctcgccgttgcggcgacaagtgcaattgcgcagatggatactagatgcatccctggtttggacagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctac

SEQ ID NO: 72732 - DNA, 636 bp, Triticum aestivum
  Clone ID: PAT_TA_72732
ccaccatgaagacgtcactcatcctgacaatcattgcggtggcactaactaccaccaccgccaatatacaggtcgaccctactggccaagtacaatggccacaacaacaacaaccattctcccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaacaatttccccagccccaacaaccacaacaaccatttccccagcaaccacaacaacaatttccccggccccaacaaccacaacaaccatttccccagccccaacaaccccaactaccatttccgcaacaaccacaacaaccattcccccagcctcaacaaccccaacaaccattttcccagttacagcaaccacaacaacctttaccccagccccaacaatcgcaacaaccattctcccagcaacaacaatcattgattcagccatacctacaacaacagatgaacccctgcaagaattacctcttgcagcaatgcaaccctgtgtcattggtgtcatccctcgtgtcaatgatcttgc

SEQ ID NO: 72733 - DNA, 649 bp, Triticum aestivum
  Clone ID: PAT_TA_72733
gggcaacaaacaggacaagggcaacagccagaacaagagcgggaaccaggacaagggcaacaaggatactatccaacttctctgcagcagccaggacaagggcaacagcaaggacaagggcaacaagggtactacccaacttctctccagcagccaggacaagggcaacaagggcactacccagcttctctgcagcagccaggacaaggacagccaggacaaaggcaacaaccaggacaagggcaacatccagaacaagggaaacaaccaggacaagggcaacaagggtactatccaacttctccacagcagccaggacaagggcaacaactaggacaagggcaacaagggtactacccaacttctccgcagcagccaggacaagggcaacaaccaggacaagggcaacaagggcactgcccaacgtccccgcagcagtcaggacaagcgcaacaaccaggacaaggccaacaaataggacaagtgcaacaaccaggacaagggcaacaagggtactacccaacttctgtgcagcagcctggacaagggcaacaatcaggacaagggcaacagtcaggacaaggacaccaaccaggacaagggcagcaatcatgacaagagcaacaaggctacgacagcccataccatg

SEQ ID NO: 72734 - DNA, 652 bp, Triticum aestivum
  Clone ID: PAT_TA_72734
catcacaactaccatatctgcggctgcaaccatgtgcgcagccgcaactaccatattcacagccacaaccatttcgaccacaacaaccatatccacaaccgcaaccacagtattcgcaaccacaacaaccaatttcacagcagcagcagcagcagcagcagcagcaacaacaacaacaacaacaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcaacacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactg

SEQ ID NO: 72735 - DNA, 554 bp, Triticum aestivum
  Clone ID: PAT_TA_72735
cgctaccatccccttcatcaccctgccgtcgccctccccgtgcacgcctctacccagcaccgccgcccccaaatcttgtactcgtagagccggacgccaccaaatctcgtactcgcgctgccccacccacacttccgagacacgccgccgccaatccccatccacactgcaccggcatccctcaccctgagccgccgcctcccatccccatctccttccacgccgcaccagcatccccagtccagcgccgccaccccattccccaatccctatccccgcccctgcttcgcctcacagtgcagcccggtgtgacagctcctctgttcgttcgtgctaccacctggtgcaactgccactgctgttcgtctgttgctgctgctactctgttctgccctatgacacggattcaacttgtgttcgtcaactgaagcagcagcagcagctacagctatcctcagtcgcacatagaggctgcaactgaactcttttcttttttggtcggtctttacaggtgaaccatcctaaactgatcttgaaagacaagttttgagatc

SEQ ID NO: 72736 - DNA, 141 bp, Triticum aestivum
  Clone ID: PAT_TA_72736
agcaagttgcgcattcagacatggcagcttcgagagcgctggtcctcggcgtcctgctggcgatcacggtcgccaacgccgaggcggcgtccgtcgtgggcggcctgaccaagtgcgccgactgcaccacgaacaacatca

SEQ ID NO: 72737 - DNA, 589 bp, Triticum aestivum
  Clone ID: PAT_TA_72737
aaccccaacaacacattttcccagccccaactacaattaccccagcaaccagaacaaataattgcccagcaaccccaacaaccattcctcctggaatcgcaacaaccattcccccagcaaccccaacaaccattttcccagccccaacaactgatccccatgcaaccacaacaaccattcccccagcaatcccaacaatcacaacaaccttttcccgggccccaacaattatttcctgaactccaacaaccaattccccagcaaccacaacaaccattccccctgcaaccgcaacaaccattcccccagcaatcgcaacaaccattcccccagcaaccacaacaaccattccccctgcaaccgcaacaaccattcccccaacaaccacaacaaccattcccccaacaaccacaacaacctttccccctacaaccacaacaaccattccccctacgaccgcaacaaccattttcccagcaaccccaacaatcacaacaatcatttccccagccccaaccccagcaaccccaacaaccatccatcctgcaaccacaacaaccatttctgcagccccaacaacaattatccc

SEQ ID NO: 72738 - DNA, 575 bp, Triticum aestivum
  Clone ID: PAT_TA_72738
ctcaactggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgttgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgatagggacatgggtgattcacaccatcccggcaatgtgcgacgtgca

SEQ ID NO: 72739 - DNA, 282 bp, Triticum aestivum
  Clone ID: PAT_TA_72739
gtacctggtacacacattcatacatacattcttcttcagcggtccactcattgctagctagcttgcgaggcagtgtgtgagctgttagtttgagcgggagaagctgggtggacggagagcacggcgctagctagcttgctggtgcaagatgaggagccgtggtagcttcgctctgaaccatgcggtggcgtttctcgtgtggtggatggtgcattgcggcactgagctcgttgccgccgtgcctcctgatggttggtactactacactgcccacacggactg

SEQ ID NO: 72740 - DNA, 358 bp, Triticum aestivum
  Clone ID: PAT_TA_72740
ctcaccgcaagaccggaaggagcggagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcaaaaccttggcatcagtgtccccatgatgtcatcttctccattgtttgccaatgcaccacctgagaacaaaggtgtcaagaactttgcaattgacttcctcatgggaggagtgtcc

SEQ ID NO: 72741 - DNA, 678 bp, Triticum aestivum
  Clone ID: PAT_TA_72741
cgcatcatttaagccaagcaagcgggggtcaataaaaatccaccatgaagacctttctcatcctagccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacagccatatccggatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctacc

SEQ ID NO: 72742 - DNA, 506 bp, Triticum aestivum
  Clone ID: PAT_TA_72742
actatctaccaccaccgccaatatacaggtcgagcctaaaggccaagtacatgggtccctgcatcggcaacacttttgccacccccaacaaccattctcccaacaaccacaacaaatttttccccaaccccaacaaacattcccccatcaaccacagcaagcatttgcccaaccccaacaaacattcccccatcaaccacaacaacaatttccccagccccagcaaccacaacaacaatttccccagccccaacaaccacaacaaccatttccccagcaaccacaacaacaatttccccggccccaacaaccacaacaaccatttccccagccccaacaaccccaactaccatttccgcaacaaccacaacaaccattcccccagcctcaacaaccccaacaaccattttcccagttacagcaaccacaacaacctttaccccagccccaacaatcgcaacaaccattctcccagcaacaacaatcattgattcagccatacctac

SEQ ID NO: 72743 - DNA, 465 bp, Triticum aestivum
  Clone ID: PAT_TA_72743
tgcgaaatctccctgaggcgcgcggtgccgaggccgcggcgaccggtgacggcgaggcctggtgcagtggtgaagtactccacacttgtggcaagaggtcctgggtttgaggcagcctctgcattgcactgtgcaggggtaaggcttgccccgtataatccttccccggaccccaactggccccggcacatttctatcgactgaaaaagcttactgggtcatcttcccctacagaaagtggttctacaaggcttaccctaaatcttccaggatcgacctatcagtttccgcagagaaggtcggtctgtggtcatcatctatatgggcaaaacatctgcttctggtgttgttcaggacaatgaaaaagttgggaatggttcaccctcttctcctaccaaggggaaaaggggaaggaaagggtcccacattatatcaaataaaaagtatcccctgagatctgcacat

SEQ ID NO: 72744 - DNA, 292 bp, Triticum aestivum
  Clone ID: PAT_TA_72744
atcgtcggcgatggcgggactggtgagcctccttctccccttactctcgttcgttgtggttgtggtacattaggccgtgatctgtccgatgcgcctgcttgttgccgtcgttgcggcgagatctggctcagttaccagtttgcctggcctccggatggaatctgacgccctattaggtgttggggattgcgggggcgaccctaatccgtgccacgaaagggtttcgtggttggtcctgccgtacggaatcagttttcgatgctttccgttttggaaagcagggaaaacagag

SEQ ID NO: 72745 - DNA, 559 bp, Triticum aestivum
  Clone ID: PAT_TA_72745
aatacaaattcaccatgaacacatttgtaattcttgcagtccttgctattgtaacaaccaccgtcacaattgcagttatagttacagtgccacaattgcagacacaaaatccatctcagcaacaaccacaagagcaagttccattggtacaacaacaacaatttccagggcagcaacaaccatttccaccacaacagccatatccgcagccgcaaccatttccatcacaacaaccatatctgcagctgcagccatttccgcagccgcaactaccatatccgcagccgcatctaccatatccgcagccgcaaccatttcgaccacaacaaccatatccacaaccgcaaccacagtattcgcaaccacaacaaccaatttcgcagcagcagcaacaacaacaacaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattgtgttgtcagcagct

SEQ ID NO: 72746 - DNA, 466 bp, Triticum aestivum
  Clone ID: PAT_TA_72746
tgtatcaaccagcatttttttagcaacaacaacattttatgtagcaacaacaatcacttttaccgaaacaaccactattttcgcagcgaacaaccaccattttctcagcagcaacaacatccaccattttcgcagcaacaacaacaaccaattctactgcaacaaccaccattttcacaacaccaacaaccagttctaccggaacaacaaataccatctgttcatccatctatcttgcagcagctaaacccatgcaaggtattcatcaagcagcaatgcagccctgtggcaatgccacaaagtcttgctaggtcgcaaacgttgtggcagagtacttgccatgtgatgcagcaacaatgttgccggcagctgcctcatattcacgaataattacgctatgatgtaatccgagccatgatatacttgatcgtcctacaaaaacatcaacatggtcagggtttgaacc

SEQ ID NO: 72747 - DNA, 125 bp, Triticum aestivum
  Clone ID: PAT_TA_72747
ctccgaacccgatccccacgacgccaacagaaccctcgcgtggcgaatacctcatcggaggacctccggcctggatcggtgggaaccgaggggctccgccccgccaatccgggcgggggcttacc

SEQ ID NO: 72748 - DNA, 193 bp, Triticum aestivum
  Clone ID: PAT_TA_72748
ctggccgccttcgggtgtctctctgcccgaaggggcccaccgcccgtaggccgtactggtagcccgtcgtggatgacattagggtcaacgtggcaacagtgctgcgccggacgggtcatggccacccgtacggcgcactgtgccaggcgtgctccgggattcgggggtggtaggttcaactacaacaatgcct

SEQ ID NO: 72749 - DNA, 210 bp, Triticum aestivum
  Clone ID: PAT_TA_72749
ccatcgggtccgcgcccgacgccgaggtgcgcctgggctgggcggccggcacgcgccacctgctcggcagctccctgccatcgccggaaggctactacggcaactgcgtgtaccccggcgggctcgccagggccagcaaggacgtcgaggaggcgtcactggtggagattgtgaccgcgatccgggaggccaaggacgcgctgtcggctc

SEQ ID NO: 72750 - DNA, 724 bp, Triticum aestivum
  Clone ID: PAT_TA_72750
gcataatttaaaccaagcaagctgtggtcatttcatattcggcatgaagacatttgtaatccttgctctgcttgctatcgtggggagcagcgacacaacgtggggttaagagttccagtgtgacaatctgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccattttcgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaacaagaacaacaaatccttcaacaaattttgcaacaacaactgactccatgcatggatgttgtattgcagcaacacaacatagcgcgtggaagatcacaagttttgcaacaaagtacttaccagctgttgcaagaattgtgttgtcagcacctatggcagatccctgagaagttgcagtgccaggccatccacaatgttgttcatgctattattctgcatcaacaacaaaaacaacaacaacaactatcgagccaggtctccttccaacagcctcagcaacaatat

SEQ ID NO: 72751 - DNA, 378 bp, Triticum aestivum
  Clone ID: PAT_TA_72751
ctcctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcacgcccctgtggaggcactac

SEQ ID NO: 72752 - DNA, 585 bp, Triticum aestivum
  Clone ID: PAT_TA_72752
aaactaccatggagacctaactcctcctatctatccttgccattgatttaacaatctgcacctacaatatccacgtccatactattctccaactacactgggctcaataacatctaatccactaaccccaacaaccattattccatcatccgcaacaatcatttccccaaccccaacaaacatttccccatcaaccacaacaacaacttccccagcctcatcaaccacaacaaccatttctccaaccccaacaagcatttccccaacaaccacaacaaccattccctcagactcaacaaccacaacaaccatttccccagcaaccacaacaaccattcccccagactcaacagccacaacaaccatttccccagcaaccacaacaaccatttccccagcaaccacaacaaccattcccccagactcaacaaccacaacaaccatttccccaccaaccacaacaaccattcccccagactcaacaaccacaacaaccatttccccagttccatcaaccacaccaaccttttccccaaccccaacaacaattccctcacccccaacaaccgcaacaatcattccccc

SEQ ID NO: 72753 - DNA, 470 bp, Triticum aestivum
  Clone ID: PAT_TA_72753
cactttcctccatgcccgacgagatctgctgcgctcgcgtggttgccctggccctcgcgctcgccggcctccatcgagccaaatcctgcgctagagcccctccttcctcaaccttcttctccaccgatgtacccccacaccccgatcagcaacgaagcaccccgcatgagcggacgcgttcccctgccccagatcgggggcgaagcgaccccgcgctctgcttctccctacccggcgtcgtcctacaccccgccgcgtcgacccctcgccggatagatgcatcccgtggctgggacctttgcttcctgtttgacccagtcccttctcatccaacaacaacaacaaaaggaggaagcggctgctccggccaccccctgcagattccaaccagcgacggccccttctgctcacgcgccccttggagatcccggatcatgtggacgtcgacgagaagcacggagcagtggatg

SEQ ID NO: 72754 - DNA, 568 bp, Triticum aestivum
  Clone ID: PAT_TA_72754
ctcattaatataccacatcatttaatccaagcacgctgtgggcgatacaaatccaccatgaaaacctttctcatccttgccctccttgctatcgtggcgaccaccgccacaactgcacttagagttccagtgccacaattgcggccacaaaatccatctcagcaacagccacaagagcaagttccattggtacaacaacaacaatttctagggcagcaacaaccatttccaccacaacaaccatatccacagccgcaaccatttccatcacaacaaccatatctgcaactgcaaccatttctgcagccgcaactaccatattcacagccacaaccatttcgaccacaacaaccatatccacaaccgcaaccacagtattcgcaaccacaacaaccaatttcacagcagcagcagcagcagcagcaacaacaacaacaacaacaacaacaacaacaacaaatcattcaacaaattttgcaacaacaactgattccatgcatggatgttgtattgcagcaacacaacatagtgcatggaaaatcacaagttttgcaacaaagtacttacc

SEQ ID NO: 72755 - DNA, 174 bp, Triticum aestivum
  Clone ID: PAT_TA_72755
ggcaaacactcgccatctcgccacgtgagaggagaagcacgcggcgctggtgcttgagcggatctggaaaggatggccggcggcgcggacgcggacggggagcgcaggatcggggtggccatggactactcggcgagcagcaagcgggcgctggagtgggccgtcctgaacctg

SEQ ID NO: 72756 - DNA, 548 bp, Triticum aestivum
  Clone ID: PAT_TA_72756
agtatagcgcatcatttaagccaaccaagcgggggtcaatagaaaatccaccatgaaggcgctttctcatcctacccctccttggtatcgtggcgaccaccgccacaagtgcagttacagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccggaaccacagtatccgcaaccacaacaaccaatttcgcagcaacaagcacaacaacaacaaatccttcaacaaattctgcaacaacaactgattccatgcagggatggtgtcttgcaacaacacaacatagcgcatgcaagctcacaagtattgcaacaaagtacttaccaacagttgcaacaatta

SEQ ID NO: 72757 - DNA, 538 bp, Triticum aestivum
  Clone ID: PAT_TA_72757
gctgcataccaaggattcgttggaagccaaacagggcacccgagaaggagaagaggagaatgctctgaagagaggaaatgataagttttatcgttttgttttaagagcaagataagatttgatatgtagttccctggtttctttgtattctactccctctgtcccgaaataagtgtctcgaccttagtataactttgtactggagttagtacaaagttcacacacttattttgggatggagggagtactatgtgtatggccaaggcactcatgattttgtagacatatttttaaacaaaagcctatgtttttttttgctcaaacagagtcactggaaagtgcacatattttcaatgcgtacatgatttcaaatgggtctatgtgaagatgctataaaatattttatgttgtcaaattaaaatgtgtacatacatctcgttgtagacaacaatcgaccatttttcctatttaaggtgattgaaccatggataattttttcctcacacacatggatttagggtgcctctacaccattttg

SEQ ID NO: 72758 - DNA, 541 bp, Triticum aestivum
  Clone ID: PAT_TA_72758
ttgcaaaggagcttatttagacagaggtgccctctttccaaaggagataacttaggcatgggaatgttttcattgtaggaatcctaagtatttaggaaggatgtgaaatcatctcttgttttgactagctgtgcagaagatgacctaaaaattcatctaaaaaaatgtaaaaagggatgtacttatcccttggactgccagctggcttaaaaagcactaagactggttgtgggccttagcggtgtttgtttcgcaccatggttcccacaccgtgaacttattatttgtttgtcattgcaacttgaattctagtttttgttcatcagttgttgtgtttcctaattttaaaactgttatgggcgcctatgggtgacatgtgatgcaatgcaatagggacctcaattcatgacataagtttgtttgtacacctaatttctttgtcaacattcgtacgggaggatgttgcaatcttgcttctccatcatctattatattattaaaagctccatgttgtgattgtagctgtgaaactcaagaccac

SEQ ID NO: 72759 - DNA, 697 bp, Triticum aestivum
  Clone ID: PAT_TA_72759
caactagagcacaagcagaaaatcaaagtacgtagtagttggcgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgc

SEQ ID NO: 72760 - DNA, 609 bp, Triticum aestivum
  Clone ID: PAT_TA_72760
gagatctagcaagcaagagcagattcacaattcaatagtctgaacattgcttgctttgatggacggtcttgattcacgtggacaagttgttttgattggagcaaccaatcggattgatgccattgatggggcattgcgtagacctggccgttttgatcgtgagttctattttcctttacctggctatgaggcacgagctgaaatactggatattcatacacggaaatggaaggaacccccgccaaaggagctaaagatggagcttgctgcgagctgtgttgggtattgtggtgctgatttgaaagcattatgtactgaagctgctattcgagcatttagggagaaatatcctcaggtttacacaagtgatgacaagtttgtcattgatgtaaactcggtcagggttgagaggaaccacttcttggaagctatgtctacaataactccagctgcacataggggatcaattgtgcattcaagaccactgtcaccggttattgctccatgtttgaacagacatcttgagaagataatggaaaggatttctgatatttttccttacctttcagcattggatcttagcaaatactctaccctttcatatggatc

SEQ ID NO: 72761 - DNA, 467 bp, Triticum aestivum
  Clone ID: PAT_TA_72761
actgcaacaaccactattttcacaacacaaacaaccacttctaccgcaacaacaaataccatctgttcagacatctatcttgcaccacctaaacccatgcaaggttttcctccagcaacaatgcagacctgtggcaatgccacaaactcttgctaggtcacaaacgttgaggcaaagtatttgccatgtgatgcaccaacaatgttgccggcagctgccacaaatacccgaacaatcacactatgatgcaatccatgccatcatctactcgatcgttctacaagaacaacaacatggtcaaggtttgaaccatcctcagcagcaacaaccccaacagtcggtccaaggtgtctcccaaccccaacaacaacagaagcagctcggacagtgttctttccaacaacctcaacaacaacaactgggtcaatggcctcaacaacaacaggtaccccagggtaccttgttgc

SEQ ID NO: 72762 - DNA, 711 bp, Triticum aestivum
  unsure (1)..(711): unsure at all n locations
  Clone ID: PAT_TA_72762
cacaactagagcacaagcagaaaatcaaagtacgtantagtggacgcaaatccaccatgaggaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgct

SEQ ID NO: 72763 - DNA, 533 bp, Triticum aestivum
  Clone ID: PAT_TA_72763
gcaatataaaaagaggccagctgattataaatctttttgagggaaatagtgcatgactgagcaaaagattcttatgtactcttttaagtcttaactctaactgcataaaggagtatcacactttcaaccttggcctgtgttgaacttgtatatatttaccagtagttgttttgtctttgtctttagtttgatatttgaaatcttctagtattataagtttagggtagacttgttcatgctcaggtgagtcagtctggactgtttttttgacacctgaacagtttcggccttcttcgaatcctgataaaaggtaaaatgtaatagacagatattgtattaagaagattatgaatgcaatattcttccctgaaaatcaacaatgtttttagtgtggacatgaccttttaagatcaggctttaggttcggcgctggaatgacctctagctaggtggttggatatcatttttcctaagttggctggatttaatggcgtactcatggggttattagattttcccaaccattcttcaaa

SEQ ID NO: 72764 - DNA, 562 bp, Triticum aestivum
  Clone ID: PAT_TA_72764
ggcgagaccgactccttgagtgccaacgttgccaagggatgggcttccgtccagacgattccgaggacggtagagttggatgagaagacccggacgaacctcctccaatggccggtggaggagatcgagaccctccgcttcaacagcaccgactttggcgtcatcactatccacaatggatccattatacctctctgcctccgccaagccacccagcttgacatcgaggcctcctttcgccttgacacttccgctagtgccatcatcaacgaggctgacgtcaactacaactgcagcaccagcggcggagcctcaaccatgggtgtgcttggtcccttcggcctcctcatccacgctactggtaatggtggcagcgaacaactcgcggtttacttctatgtatcgaggggccgtgacggggcactccgaacccacttctgccatgacaagttgttgtcgtctcgggcgaatgatgtcatgaagcgggtggtgggcagcacagtgccggtgctcgacggcgaagctctatctgtgagggtgctcgtggaccattcgattgtgg

SEQ ID NO: 72765 - DNA, 641 bp, Triticum aestivum
  unsure (1)..(641): unsure at all n locations
  Clone ID: PAT_TA_72765
ctcccagcctctggcagccgctgctgtggtccggcacccctgcttctcctcatcaccggcgagccgcgccgtcctccacgagcagccgaggcccagcacttctccgccgcgtcctcgctctagtccatgtcagccccgtcaccaggagctcaagccccgccatggccacggctccctgctacggaggccccgccgccaagtcccgcatgcgtcctcccatcaagcgtcgggacgaacggcagcagctcccttctgcgccctccggcgaccccaccgtccgaccgtcgcgttgtcatctttagccacctgcactctcacctagtctgctcaacgacatgttgtgccgctcactatggacgtcgttgcgtctctgttcgtcgatgttttcaccatgagccccgtgcccatttccatcgctgctcgcgcgccgccttgccttgtctgcttccggccagaggcccttttgttctccctttgttttgggtcancaagagaggcgccaagaactataaccaggaccatcaggcatcttctttgaggtttttgccaagtacaacgacgacgcgtcatgtttgtctactgtcatcttcggaatcgctaaaaacgacaagtactttgatgcccgatgcatacaacaacta

SEQ ID NO: 72766 - DNA, 260 bp, Triticum aestivum
  Clone ID: PAT_TA_72766
cgcccacgcagcacgcgccggagcacccaaatcgacgccaatgaggatggcgctggagtggccagccaccgccgcaccagtaagcgtcggagcacccagatccaggcgagcgaggggggcgaccgattcacccgccgccgccgcggtaagcgcctccgcccccaggctcacgcgagcgaggtgggcgacggcacctcgctggagccgcccgcctattcgcttgaagtcaacgatctcctgagggagatccttctccatct

SEQ ID NO: 72767 - DNA, 621 bp, Triticum aestivum
  Clone ID: PAT_TA_72767
gcgcatcatttaagccaagcaagcagtgctcaatacaaatcggccatgaagacctttctcatccttgcactccttgctattgtagcaaccaccgccacaattgcacttagagtcccactgccacaattgcaaccacaaaatccatctcaccaacaaccacaatgagcaagttccattggtacaacaacaacgatttgccagggcagcaccaaccattcccaccacaacagccatatccgtagccgcaaccatttccatcacaacaaccatatctgcatctgcaaccatttacgcatccgcaactaccatatccgcagccgcatctaccatatccgcagccgcaaccatttcgaccacaacaaccatatccacaaccgcaaccacagtattcgcaaccacaacaaccaatttcgcagcagcagcaacaacaacaacaacaacaacaacaacagatccttcaacaaattttgcaacaacaactgattccatgcagggatgttgtattgcaacaacacagcatagcgcatggaagctcacaagttttgcaacaaagtacttaccagctggtgcaacaattgtgttgtcaccagctgtggcagatccccgaacagtcgcggtgcc

SEQ ID NO: 72768 - DNA, 508 bp, Triticum aestivum
  Clone ID: PAT_TA_72768
ctcttgaccacttgaccgctctttctcccgtggccatgttaagctagggtttagtcttgaaggagatacagggtttaggatccgggagcagcccagctctcctcccagacctctctcatgtcgtcttcctcccgagtaagggttgggactctggttccctttgctgaaggcaaatctggttcgccgaatgcgtcgccgccaatgccaagcattcccatccttgagggctccaatgtcgtcgggaggagtaatttggtggctgttgacaagagggtcagccgcaagcatttgagcttgcgcgccttgcctgatggctccgtcgaagtcgtcgtggaggggccaaatcccattgttgtccgatcagagggtcagagaagaaaagtttgtgctcaccacaaagccaaggttatgcacgatgatgtcctggagctgattcccggtgaatattttatgaagtatgtcaatacgagcgatgagcgtaaaagttccacatcagtcgaatcacatg

SEQ ID NO: 72769 - DNA, 193 bp, Triticum aestivum
  Clone ID: PAT_TA_72769
tgtctctcctagtctcgcgtagacagcaatggtgttcgttcacaagggtggtgtttggtggttcctctttctcgtggcggtgctgctcgctgctgcggccgtaggagcggagcaggaggatggggccacggccaccgtagccgcggaggtggaggaggaggtcggtgggcgtgtccatgaccacggcaactac

SEQ ID NO: 72770 - DNA, 367 bp, Triticum aestivum
  Clone ID: PAT_TA_72770
cagcgccgccgctggccctgcctcgccatcccggacctcgccggcgctggctaggccgtcgccgccgccgatcccgactcccgcatcagccctacttcctcccgaagctccagcacctccccttccctcccgcagctgcagcgcctcccctccctccagaagccgcgctgcgcccctctgcaccaactgcggacggcgcctccccctccctcccgaagctccagctggacggccaccactccacctaaaggcaacagctgccggttgtgcagccaccaacaccaagactgctatcaaaatcatctcatatggacacaacatctgggccaagacgagcgcacaccttatgctactcctgaccatcacc

SEQ ID NO: 72771 - DNA, 435 bp, Triticum aestivum
  Clone ID: PAT_TA_72771
ctcccccatctagatctagatccccccacccctcctgttcagggccgcagccgacgcccctcactcgccgtcgacgacccacgccgccgccgcacactaccgcgccctcccctcaccctggcccaattcaatccaaccccgcgcgcacaccgatgccgccgccgtcgaccccttcctccctcccctgcctcgcacccatggcgtttgcgctcaaggcctccgcctcccccgccctcaccgctacctcctcagcgacgttcccctccttctcagctgcctccgcggtgcccaggggccgcgccgccgcggccaggagagtctcgctccgcggggccgcacccgcgacctgctaccccgcgcccgcgccaactccagcagttggctcgctcgcttgctgctgcaggtgagtgctggtggagctcgtatcggggatga

SEQ ID NO: 72772 - DNA, 561 bp, Triticum aestivum
  Clone ID: PAT_TA_72772
caacaccaacagctggtgcaacaacaaatccctgttgttcaggcatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgccattcgacgttggcaccggagttggtgcctactgataaggaaagatctct

SEQ ID NO: 72773 - DNA, 652 bp, Triticum aestivum
  Clone ID: PAT_TA_72773
gcatcatttaaaccaagctagctgtggtcaatacaaatccggggtgaacacctttctcatccttgccctccttgctatcgtggcgaccaccgccacaactgcagttaaagttccagtgccacaattgcagccacaaaatccatctcagcaacagccacaagagcatgttccattggtacaacaacaacaattgctagggcaccaacaaccatttccaccacaccaaccatatccacagccgcaaccatttccatcacaacaaccatatctgcagctgcaaccatttctgcagccgcaactaccatattcacagccacaaccatttcgaccacaacaaccatatccacaaccacaaccacagtattcgcaagcacaacaaccaatttcacagcagcagcagcagcagcaacaacaacaacaacaacaacaacaacaacaacaacaaatccttcaacaaattttgcaacaacaactgattccatgcatggatgttgtattgcaccaacacaacataccccatggaagatcacaagttttgcaacaaagtacttaccagctgctgcaagaattgtgttgtcaccacctatggcagatccctgagcagtcgcagtgccaggccatccacaatgttgttcatgctattattctgcat

SEQ ID NO: 72774 - DNA, 490 bp, Triticum aestivum
  Clone ID: PAT_TA_72774
cgcaaatcttatcatgaagaccttaatcatcctgacgatcctggcgatggcaataaccatcatcaccgccacatatgcaggtccaccctatccgccaaatacaatggtcacaacaacaactaatcccccatccccaatacccattatcccatcaaccacaaccaatcatttcctccaacctccaacaacacattcctcctcatcaatccacatacaacatagttccccatcctcaccaaccacaacaaccatttctccaaccccaacaaccattcccccaacaaccacaacaaccattcccccagactcaacaaccacaacaaccatttccccagcaaccacaacaaccattcccccatactcaacagccacaacaaccatttccccagcaaccacaacaaccatttccccaacaacaaccacaacaaccatttccccagcaaccacaacaaccattcccccatactgaacaaccacaacaaccatttcc

SEQ ID NO: 72775 - DNA, 629 bp, Triticum aestivum
  Clone ID: PAT_TA_72775
caactaccatttccccaacaaccccaacaaccattcccccaggctcagcaaccccaacaaccatttccccagtcacaacaaccacaacaaccttttccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagcgtcgcgcattccatcatcatgcaacaagaacaacaacaaggcgtgccgatcctgcggccactatttcagctcgcccagggtctgggtatcatccaacctcaacaaccagctcaattggaggggatcaggtcattggtattgaaaactcttccaaccatgtgcaacgtgtatgtgccacctgactgctccaccatcaacgtaccatatgccaacataaacgctggcattggtggccaatgaaaaatgcaagatcatcattgcttacctga

SEQ ID NO: 72776 - DNA, 707 bp, Triticum aestivum
  Clone ID: PAT_TA_72776
tttaagccaatcaagctgtggtcaatacaaatccaccatgaggacatttctcatccttgccctccttgctatcgtggccaccaccgccacaaatgcagttagagttccagtgccacaattgcagccacaaaatccatctgagcaacagccacaagagcaagttccattggtacaacaacaacaatttctagggcagcaacaaccatttccaccacaacaaccatatccacagccgcaaccatttccatcacaacaaccatatctgcagctgcaaccattttcgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaacaacaagaacaacaaatccttcaacaaattttgcaacaacaactgattccatgcatggatgttgtattgcagcaacacaacatagcgcgtggaagatcacaagttttgcaacaaagtacttaccagctgttgcaagaattgtgttgtcagcacctatggcagatccctgagaagttgcagtgccaggccatccacaatgttgttcatgctattattctgcatcaacaacaaaaacaacaacaacaactatcgagccaagtctccttccaacagcctc

SEQ ID NO: 72777 - DNA, 676 bp, Triticum aestivum
  Clone ID: PAT_TA_72777
caaccattggcaccacaacagccatatccgcagccgaaaccggtgccatcacaacagccatatctgcacctgcaaccatttacacagccgcaactaccatatccgcagccgcaaccatttcgaccacaacaaccatatccacagccgcaaccacagtattcgcaaccacaacaaccaatttcgcagcagcagcagcagcagcagcaacaacaacaacaacaacaacaaatcctacaacaaattttgcaacaacaactgattccatgcagggatgttgtattgcaacaacacaacatagcgcatggaagctcacaagttttgcaagaaagtacttaccagctggtgcaacaattgtgttgtcagcagctgtggcagatccccgagcagtcgcggtgccaagccatccacaatgttgttcatgctattattctgcatcaacaacaccaccaccaccaacaacaacaacaacaacaacaacaacaaccgttgagccaagtctccttccaacagcctcagcaacaatatccatcaggccagggcttcttccaaccatctcagcaaaacccacaggcccagggctctttccagcctcaacaactgccccagtttgaggcaataaggaacctagcgctacagacgctacctgcaatgtgcaatgtgtatatccctccatatt

SEQ ID NO: 72778 - DNA, 362 bp, Triticum aestivum
  Clone ID: PAT_TA_72778
caagaaaaccacagattaggttaaatgggcaaagaggtcgacgggggtgccctcgaggccggcggcgcccgggactactccgaccctccgccggccccgctggtggacgtcgatgagctcggcaagtggtccctgtaccgcgcggtgatcgccgagttcgtggccacgctgctcttcctctacatcacggtgtccaccgtcatcgggtacaagcaccagacggacgcgtcggcgtcggggcccgacgcggcgtgcggtggggtgggcatcctcggcatcgcgtgggcgttcgggggcatgatcttcatcctcgtctactgcaccgccggcatctccggcgggcacattaacccggccgtgac

SEQ ID NO: 72779 - DNA, 677 bp, Triticum aestivum
  Clone ID: PAT_TA_72779
ttaacccaagcaagcagtgctcaatacaaatccaccatgaagacctttctcatccttgcactccttgctattgtatcaaccaccgccacaattgcagttatagttccagtgccacaattgcagccacaaaatccatctcagcaacaaccacaagagcaagttgcattggtacaacaacaacaatttccagggcagcaacaaccatttccaccacaacagccatatccgcagccgcaaccatttccatcacaacaaccatatctgcagctgcagccatttccgcatccgcaactaccatatccgcagccgcatctaccatatccgcagccgcaaccatttcgaccacaacaaccatatccacaaccgcaaccacagtattcacaaccacaacaaccaatttcgcagcagcagcaacaacaacaacaacaacaacaacaacagatccttcaacaaattttgcaacaacaactgattccatgcagggatgttgtattgcaacaacacagcatagcgcatggaagttcacaagttttgcaacaaagtacttaccagctggtgcaacaattgtgttgtcagcagctgtggcagatccccgagcagtcgcggtgccaagccatccacaatgttgttcatgctattattctgcatcaacaacaacaacaacaacaacaacaaca

SEQ ID NO: 72780 - DNA, 314 bp, Triticum aestivum
  Clone ID: PAT_TA_72780
ccgaaatccccccaccccctacccgcgccgccgcgcgggggcccggggggctcggagcgacctcggccgccctccctctgccgcgcggagtcgacccaagacgcccgccagggccattccgcgccccccctgctcgcgcggctgacggcgagcggccatgaatttcctctaccgagccgcgcagcccgagctgccgcggatccccgagcagcagggggtcctcaagaccctggagggcctcatcgccgacgatccgctccgcatctccgacgtggcggaagacgacgaacctgccagcaacggagccggggaga

SEQ ID NO: 72781 - DNA, 435 bp, Triticum aestivum
  Clone ID: PAT_TA_72781
acaaggcgctcaacaacctcttcgccgtccggatgcgcctgggccacttcgacggcgaccccagggccaacatctacggcggcctcaacgccgccgacatctgcaccccggagcacaggagcctcgccctcgacgccgcgcaggacggcatcgtcctcctcaagaacgacgctggcatcctcccgctcgaccgggccgccgtcgcctccgccgccgtcatcgggcccaacgccaacaaccccggcctgctcatcggcaactacttcggcccgccctgcgagtccgtcacgccgctcaagggggtccagggctacgtcaaggacgccaggttcctcgcagggtgccgctcggcggcctgcgacgtggccgacacggacgaggcggcctccctggcggcctcgtcggactacgtgctcctcctcatgggactgagcc

SEQ ID NO: 72782 - DNA, 573 bp, Triticum aestivum
  Clone ID: PAT_TA_72782
ggcagtacccatcttctcagcagcagccaggacaagggcaacaggggcagtacccagcttctcagcagcagccaccacaagggcaacaagggcaatacccagcttctcaacaacagccaggacaagggcaacaagggcactacctagcttctcacacacaaccaagacaaaggcaacaacggccctacccatcttctctgcaacaaccaatacaagggcaacaagggcattacacagcttctctgcagcaaccaagacaagggcaacaagggcattacccagcttctctgcagcaggtaagacaaggacaacaaataggacagctaggacaaaggcaacaaccaggacaagggcaacaaacaagacaagggcaacaactagaacaagggcaacaaccaggacaagggcaacaaacaagacaagggcaacaactagaacaagggcaacaaccaggacaagggcaacaagggtactatccaacttctccacaacagtcgggacaagggcaacaaccatgacaatgacaacaaccatgacaagggcaacaagggtactactcaagttctctacaac

SEQ ID NO: 72783 - DNA, 408 bp, Triticum aestivum
  Clone ID: PAT_TA_72783
aatgaccctcacactctctgatcacagtaggactaacttcaactagggggcagcgtctgccactcggggcattttcttgcatcaaccacggcaatggccaccgctgatgtccagaaccctacggccgcgctgacggaggacgcgcccgcggaggagacgcccgtctccgccgaggaggttgctaaaacagaggaggtccccgcgccggtggaggccgaagtcgaggcgcctgcccccgtcgaggttgaggcgaccaaggaggacgcaccggccgccgccgagacgaaggagaccaaggagcccgagccagcaactgctgccgagccggaggccgaggcgccgaaagagccagccgtggtcgagacatacaccaaggaggcggtggcagaggccgagccggcggtggca

SEQ ID NO: 72784 - DNA, 538 bp, Triticum aestivum
  Clone ID: PAT_TA_72784
ccgaaccctttactgcattccgtagtgcttgggagccgcaacatccatcatctccggagcatcaaccaactccgcagccacaacaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgttgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgatagggacatgggtgattcagaccatcccggcaatgtgcgacgtgcatgttccaccatactgctacaccaccatatcaccatccagtgacgtcactaccgacat

SEQ ID NO: 72785 - DNA, 604 bp, Triticum aestivum
  unsure (1)..(604): unsure at all n locations
  Clone ID: PAT_TA_72785
gcgcgtccaggtgggaggttagtgtggcccgggcgtccgctgcggtgcancggatgtggcagccccgagccatggctctcgccgtccgagtcgtttattgtggcgcttgaggctacaagtccaagtatcttcagctcaagaagaagttagaagatgagttccccggccgcctggacatcgtgagtcttgggatggggagaaagacttgagcacagccactgtgtcggtccgttaggcctggatggcactgcaggggggttagtgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcaaanattgacgcccccggtctttgcctctgagcgggaaagtctgtgtgtatgtgtc

SEQ ID NO: 72786 - DNA, 688 bp, Triticum aestivum
  Clone ID: PAT_TA_72786
gtcttcttgagttttctcaactcaacctgtgtattggcactacacccttctgtaatctttccatgttttgaaattttctcttgcaacaactcaatggatgacccacctagggaaggtatattccatattttctctactagatctttaatatcttccctaaggagacacgtgttctcaaatttatagcttgtagttctagcttatttactaataccagaatcccatacgttgagagtgtggtcacttcccattcttggaagggcattacaataatctaaacggaaaatatctaggtcagtatcacgaaacatcctatgtatagtggacataataatgccaacctggttattagcgcaagtatatttcctagaggaaagcttaatttctagtgaactccatatatccacccaagtattgaagttatctctccagctatggttgatgaccccattgctcttatatgattaactctaaccaggtcaaaagtcacctcaaattagagtaggagtttgaatatatataaataatgaatgaagctcagagagaaattacgctttgcatgctcataaggggatccataaacaataacaactataattgtatttcttgcttttcatcataagggtgcaagccacatatagaattgagcaacgccccatttaatcacatcaaagatatctacatctac

SEQ ID NO: 72787 - DNA, 361 bp, Triticum aestivum
  Clone ID: PAT_TA_72787
caggcgtcctcggatctcctccgcttcggcggtggcggtgggggcggcatggctgcccgcctcaaccacctcctgtcgtcgtccaacgccccgtccttccgccacctgccacctccacaagcgccgcccttccacctcggctcggcgcaggagttcatcgacgggaatggatcgcccgcgttcttgcagggcaaaccgttccacggcctcatgcagctcccggatctacaaggaaacggctccggcggcacgtcgtcgtctgctcctggtcttttcaacctgggatacatcgccaacagtggcaatacctccggtacctccagccacggccactcgagtcacggacacatggccaatgacc

SEQ ID NO: 72788 - DNA, 716 bp, Triticum aestivum
  unsure (1)..(716): unsure at all n locations
  Clone ID: PAT_TA_72788
aaatcattgctgagctcctcaaggctgggctcattaggcctagtactagccccttctcttctcctgtcctcctggtcaaaaagaaggatggaacttggagactctgtattgattacagaaaactgaatgcaatcaccatcaaaaacaaatatcccattccaataatagaagatcttctagaccaattaaaaggagcaaccgttttctccaagatagacctcagaagtggatatcatcagataagaatggctgaagaagacatccacaagacaacattctctacactgcaagggcactttgagtttctagtgatgtcttttggattaacaaatggacctccctcatttcaggctcttatgaactttttgtttggctcttttgaatttgtggtagtgttctttgatgacattctagtgttcagcacaaccatggcagaacataaactacacctgaagaaagtatttcaagtgctgcaagagaatcatttatatgccaaactgaacaaatgttcttttggacagtctgagatagaatatttgggccatgttatcaacaaggaaggtgtggcaacagatccttctaaaattgctgctatcaaggagtggccaactcctaaaactgtcactgaactcanaagctttttgggtctgagtggttactacaggtgatttattcagggatatggcatcatttgcaggcccccttttgactgtctg

SEQ ID NO: 72789 - DNA, 649 bp, Triticum aestivum
  Clone ID: PAT_TA_72789
caccaatccaccatgaacaccttcctggggtttgccctcctcgccggtgcggctacaagtgcaattgcgcagatggagactacatgcatccctggtttggagagaccatggcagcaccaaccattaccaccacaacagacatttccacaacaaccactattttcacaacaacaacaactatttcctcaacaaccatcattttcgcagcaacaaccaccattgttggcagcaacaaccaccattttctcagcatcaaccaattctaccacagcaaccaccattttcgcagcaacaacaactacttctaccgcaacaaccaccattttcacagcaacaacaaccagttttacctccacaacaatcaccttttccacaacaacaacaacaccaacagctggtgcaacaacaaatccctgttgttcacccatccattttgcagcttctaaacccatgcaagctattcctccagcagcagtgcagccctgtggcaatgccacaacgtcttgctaggtcgcaaatgttgcagcacagcagttgccatgtgatgcaacaacaatgttgccatcagttgccgcatatcccacaccaatcccgctatgaggcaatccgtgctatcatctactccatcatcctgcaagaacaacaacag

SEQ ID NO: 72790 - DNA, 427 bp, Triticum aestivum
  unsure (1)..(427): unsure at all n locations
  Clone ID: PAT_TA_72790
caggcggcaagacgattcctctcctccaaggagacgagctcgccatgattccgaggaaccccaggacatctcaccaccacggaggcgcacgaggcacgactccaaggagcctcataaccgctccccccctcggcgccggacacggcatgactcggaggagcctcataaccgctccccctctcggcgccggacacggcatgactcggaggagcctcagaaccgttccccctctcggcgccggacacggcatgactcggaggagcccggagatatctctccgccacgaagacggaagcaccaggcctctgcacagctggatgacctgtcactcgcaagaagacaaaatttgggacagagcctgngggatggggatatttctccaccaaggaagggtcggaagtctgcatcagatgatttatctcccacc

SEQ ID NO: 72791 - DNA, 497 bp, Triticum aestivum
  Clone ID: PAT_TA_72791
tactccacgtactaattcagaatgcacgaagtgaaggacggcttgattctggtattgttgatattaaagcaaacagggttgaaatgaacgacccaccgaagacagttcatgttgatagcctgtctggtgcttccacggtgttgttcactcttacaattgaccgtggagttacttgggagtcggctaaggcaattcttgaagaaaggcataaagatggtgcgtgttcttctaatgatgggttttacgagtcccggagagagtggatgggcaaaacgcatttcatgctaccgtttgaaggctcaacggaaggaatgtacagagtaactcgccctgccgtcggggaagcttcgaacgagatgcctttggctgaactagaaggaaagtacaagaatgcctcatcggctgacaaaactggggaaggttggcacgaagaatatgatgtgtcgtccaagcagtgcatgcatgggcccaagtgcatacttggaagcgattgtact

SEQ ID NO: 72792 - DNA, 513 bp, Triticum aestivum
  Clone ID: PAT_TA_72792
caatactagttaacaccaatccaccatgaagaccttcctcagctttgctctccttgccattgcggcgacaagtgccattgcacaaatggagactagccgcgtccctggtttggagaaaccatggcagcaacaaccattaccaccacaacaacaaccaccattttcacaacaacaacaaccaccatttcagcagcaacaaccaccattttaacagcaaccatcttttccacaacaacaccaacagtttccacaacaacaaatccctgttgttcaaccatccgttctgcatcatctaaacccatgcaaggtgttcctcctacagcagcgtagccatgtggcactgtcgcaacgtcttgctaggccacaactgtggcaacagagtagttgccatgtgatgcaacaacaatgttgccaacagctgtcgcacatccccgaacactcccgctctgaggcaatccgcgccatcgtctactccatcatcctgcaagaacaacaacagggttttgtccaacc

SEQ ID NO: 72793 - DNA, 644 bp, Triticum aestivum
  Clone ID: PAT_TA_72793
tgaaaaccttactcatcatgacaatcattgcggaggcactgggtccaccaccgacaatatacaggtcgaccctagtggccaagtacaatggccacaacaacaacaaccatgctccaatccacaacaaccattatgataacaaccacaacaaatgcttccccaaccccaacaaacattaccacatcaaccacaacaagcatttccccaaccccaacaaacattcccccatcaaccacaacaacaatttccctagccccagcaaccacaacaacaatttccccagccccaacaaccacaacaaccatttccccagcaaccacaacaacaatttccccggccccaacaaccacaacaaccatttccccagccccaacaaccccaactaccatttccgcaacaaccacaacaaccattcccccagcctcaacaaccccaacaaccattttcccagttacagcaaccacaacaacctttaccccagccccaacaatcgcaacaaccattctcccagcaacaacaatcattgattcagccatacctacaacaacagatgaacccctgcaagaattacctcttgcagcaatgcaaccctgtgtcattggtgtcatccctcgtgtcaatgatcttgccacgaagtgatttgc

SEQ ID NO: 72794 - DNA, 701 bp, Triticum aestivum
  Clone ID: PAT_TA_72794
acagccacaaccatttcgaccacaacaaccatatccacaaccgcaaccacagtattcgcaaccacaacaaccaatttcacagcagcagcagcagcagcagcaacaacaacaacaacaacaacaacaacaacaacaaatcattcaacaaattttgcaacaacaactgattccatgcatggatgttgtattgcagcaacacaacatagtgcatggaaaatcacaagttttgcaacaaagtacttaccagctgctgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagccctacagacgctacctgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtgacatgcactatcatgta

SEQ ID NO: 72795 - DNA, 637 bp, Triticum aestivum
  Clone ID: PAT_TA_72795
gtccgagacatgggattgggccatccacccatgggttgaaattggcggcgacaacagcctaaagtacaatgctggcatgctggtggatggttccgtttactggcctttccatggcgaacaccgcatgataaggatcaacacagccaccatggaggtcatcaatgtggatctacccttgcaggtggatgtggagagctgcaattacaacgctggggagactagggatggtcagctatgcattgtctatgctgccgatgattttcacctccatgtttggatccgtggtgtggatggtgatggaattgggatttgggtgccgcaaaacatactctctttgagtgcagaaattggtcgggtcactcggggctggctgggccaccttagggttgtgcaagttaggtctggatatgtctacttgtccatgaaatgcattacccctgttggcatactccgctgctggttcttatccctttcattggagaccatgaagattgagtcactgatccacgggacatttggtgactctgcctatccgtacattatggcctggcctccttgtttgattggtcatgatgggagcagcactgggcatgaagttgaagcttctcactgaaatctgcacttgttcgtcttatat

SEQ ID NO: 72796 - DNA, 720 bp, Triticum aestivum
  Clone ID: PAT_TA_72796
cagccactaccatttcgaccacaacaaccatatccacaaccgcaaccacagtattcgcaaccacaacaaccaattgcacagcagcagcagcagcagcaacaacaacaacaacaacaacaacaacaagaacaacaaatccttcaacaaattttgcaacaacaactgattccatgcatggatgttgtattgcagcaacacaacttagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaagcaacaacaacaactatcgagccaggtctccttccaacagcctcagcaacaatatccattaggccagggctccttccggccatctcagcaaaactcacaggcccagggctctgtccagcctcaacaactgccccagttcgaggaaataaggaacctagcgctacagaccctacctgcaatgtgcaatgtctacatccctccatattgcaccatcgcgccatttggcatcttcggtactaaatgagaagaaaataactctagtactagatatatgaaacaccgttttcttagtccatggtatggtcgttgtagcggtgaaaaaataatgtgacatgcactatcatgtaagaacccgaactatactagt

SEQ ID NO: 72797 - DNA, 294 bp, Triticum aestivum
  Clone ID: PAT_TA_72797
gagcttaacgcaatggtggaacgcatggaatcatctgaccttgacactgtgaaccttactgacaatgatctctcaaaataccacctaatatactttattggaggcaggtcaaaagtcaaagacgaacttgtttaccggtttattttcccagaaaggccatgtgctcttatgaattttttggatacgctgagccctcgatggaacatcagccttttccattaccgtgcacagggcgaaaccggagcaaacgtgttatttggcatacaagtgccaccataggatgttgatgaattc

SEQ ID NO: 72798 - DNA, 620 bp, Triticum aestivum
  Clone ID: PAT_TA_72798
gcaagggttgagcggttcgggtggtgctccactgcagctcggttgctggagggagggcggtggtgatgtgcggtcatgggggttggatgcccagcgccgtcctcttctgcccttcctccaccctttttctcctccaaggataggcccggtgagcctccaatcccgactaccaactctgtaggtccactaacttagatgcgtgtgaccttctctaatgtgcgcctcaccagtggggccccacatcgccggcgtcggcctccaacgagcagtggcccgagcttgtctcttcatttttctgctcgtgcacctcccgtttagaccctgctgtttgtgggcacaagcgatgcagtccactatgtattcaggtagtgcaatgtgctagaatccttttgttggaggtgactgctgctcctcgccacccatctccttcctctactgcagaaggaaggctcgcaacgtctccatgcagttcgcccctggcagcgacaccatggctgtgtgtggcatgcatgcgcttggtgaaaccaaagccaaacccgaagtgaagaatgaagaacagaggtctgtgatagaaaagtttccatcaagtgttcctgtgattggtcctgcaatgaaaggag

SEQ ID NO: 72799 - DNA, 519 bp, Triticum aestivum
  Clone ID: PAT_TA_72799
ggattctgattctgtaatttgttttactgttgctaactgagcatgcttacataatgggatgatttgagtggagtttcaaagtcaatcgtccatgtttgcagtctcaagtttctatatgtatagtctgagacctaataagtaccgatcatttcagaaagtttcacgtttcatacttataattgatactgattgtattcatgtaattgggccacttgattatagtgattttctaactaataagtaagatgtccctggttctgcataaagatttaggcaccctaatttcttaagtctttgtggagtcagaagttttgaatgtttttgttcagagtctttttgaaatgatgagtgatgcatacctattcagtgttttacatggtactgcaagtgaagaaatgatttgtactgaaccatctaatgtgttattgcgtttctttgaagtcatgaatttgtagcaagtgacgccctcattggcattatttttcttacatatgcaagatagttaaagcatcgtgggga

SEQ ID NO: 72800 - DNA, 588 bp, Triticum aestivum
  Clone ID: PAT_TA_72800
ccctacgaatcatcacgcagcttcacgcggccttcaccgccatcttcgccgctctctggcagccagccacgggacaggtggttcaaccttgccctccgggactgcccagctgcacttgagaactttgacctgtggagacagagcaatcttgagccattggttattgatattgtgatgctccggcgtgacaatcccaacactacctgtgctgagggtggcaagatcatagagaggtgggtgatacagtatgaaaccagcaagcctggcagtggcaatggtaatggcagcaagaaccatagcaggaagtctaggaacagcccggctgaggatcatagcttgtacaggagtacatacaagggctcaacagtgttacttcggtcattgcatctggttgtcaggctcttgccagcctacaatctcttcagggagttgaattcatctgggagaatccgtccacttaacctgtcacacaagatatcatcattcgtcgagccgtttactagggcagaggatgcagagatgaagcactatgcatttgctccaattgaaactctgtttggccgcctgagcttgtcagtttcttatgtg

SEQ ID NO: 72801 - DNA, 619 bp, Triticum aestivum
  Clone ID: PAT_TA_72801
ccacccccttctcccccgcagccgcctatagataccgatcgctccggcccaatggcggtcggcggcgacgacgacatggagcgggacttcgccgctaggctgcgcctcgcgccctccaacccctcctcagcctccgcctccgcctcggcctcccccacggcggcctcccctactgcgggcggcggcgggatcgccttccgcgcgccgcaggagcagttcaccgccggcgacttcgagctcggcaagatctacggcgtcggctcctactccaaggtggtgagggccaggaagaaggacacgggcaacgtctacgcgctcaagatcatggacaagaagttcatcaccaaggagaacaagatctcctacgtcaagatggagcgcatcgtgctcgaccagctggatcacccgggcgtcatcaggctcttcttcaccttccaggacacctactccctctacatggcactggagtcctgcgaaggcggggagttgttcgaccaaatcgtacggaaaggccgcctgtctgaggacgaggcgcggttttatgccgctgaaattgttgacattctggagtatttgcatagcgtaggcctaattcatcgggatgtgaagccagaaaatt

SEQ ID NO: 72802 - DNA, 691 bp, Triticum aestivum
  Clone ID: PAT_TA_72802
cagccttgtgcgccaaaccttcaatgcagaagattctgagagtgatcttgcagatccccatttatgatcgtacacctgactcgattgcgtggcattttgacaaaaaaaggaatcttcttggtgaagtcagcctacaaggtagcagtggatagcatagaacgtgattcaacacatggccaaccatctagttcaagaagcgatggagaggcaattgattttgaatggaagaaactatgggcgttacctctcccaaataaagtcctccattttctttggcgtatagcaacatatagcttaccattaagaatgaagctgaagaatataggcatggaaatagatagtagatgcccagtgtgccttagatatgatgaggatggtggtcgctgttttcttaaatgcaaaatggtgagacggctgtggagcttggcacaaatggataatattcgaaataggctaatgttatgcaacgatcctcttagcttattcaatgagttgtttcgcctgacagaagaggagagcataaaggaatcttaagaagcagaggagcacccagaagcagacttccacggcaaaatggtctcccctggcaaacgaattcctgaaagtaaactccaatggggcgtttaaggaagcatcaaaatctggtggctggggttttactttgaggaatagtaatggtatgcttttggct

SEQ ID NO: 72803 - DNA, 653 bp, Triticum aestivum
  Clone ID: PAT_TA_72803
catttccccagcaaccacaacaaccattcccccagactcaacggccacaacaaccatttccccagcaaccacaacaaccattcccccagactcaacaaccacaacaaccatttccccagttccagcaaccacaccaaccttttccccagccccaacaacaattcccgcagccccaacaaccgcaacaatcattcccccagcaacaacgaccgttcattcagccatctctacaacaacgtttgaacccatgcaagaatatcctcttgcaacaatgcaaacctgcgtcattggtgtcatccctctggtcgataatctggccacaaagcgattgccaagtgatgcagcaacaatgctgccaagaactagcacagattcctcagcagctccagtgcgcagccatccatagcgtcgtgcattccatcatcgtgcagcagcagcagcaacaacaacaacaacaacaacaacaacaacaaggcatgcatatcctgctgccactatctcaacaacaacagttgggtcaaggtactctcgtccaaggccagggcatcatccaacctcagcaactagctcaattggaggcgatcaggtcattggtgttgcaaactcttccaaccatgtgcaacgtgtatgtcccacctgagtgctccatcatc

SEQ ID NO: 72804 - DNA, 680 bp, Triticum aestivum
  Clone ID: PAT_TA_72804
agcacaatcatccatacttcacacaactcaagcacaaggatccaccatgaacaccttactcattctgacaatcattgcggtggcactaactaccaccaccgccaatatacaggtccaccctagtggccaagtacaatggccacaacaacaacaaccattctcccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaacaatttccccagccccaacaaccacaacaaccatttccccagcaaccacaacaacaatttccccggccccaacaaccacaacaaccatttccccagccccaacaaccccaactaccatttccgcaacaaccacaacaaccattcccccagcctcaacaaccccaacaaccattttcccagttacagcaaccacaacaacctttaccccagccccaacaatcgcaacaaccattctcccagcaacaacaatcattgattcagccatacctacaacaacagatgaacccctgcaagaattacctcttgcagcaatgcaaccctgtgtgattggtgtcatccctcgtgtcaatgatcttgccac

SEQ ID NO: 72805 - DNA, 651 bp, Triticum aestivum
  Clone ID: PAT_TA_72805
catttctgggcaccaccgaggacttgctggaccaaggcgaggcgtttgatgtcgctgtggccgagacgagctcctacctgggcgtgggcggcgaggaggtcgtcagtaccaaggagcgcagtgggcagaccatggattttgtcagtagcatgagcgtggagcagggcatacatgatgtggtcgtgcagcagctggtcactaccggagagcgtggtgagcagagcctcgagcagcgcttacatgatgctgttgtgaagcgggagtggccaatggaagtggagcaaggtagtagcagcggcggcaccgcgtcaccagcatgtgctgatgaggcaggcacatcgctgaactggctgctaggagcaaggcagcgagttgtgctcacttctgagaggccaaacaagaagaggaagctcataggtgtggatgctgggttggagcagcttgtgctgcttccacgcctgggagctcaggctgggacgatgtgcgatgtttgctgtttgggagagactgacatggcgtccaataggatgctttgctgtaacaactgcaaggtttccgtgcaccagtggtgctatggtttgcatgttgtgccagatggccagtggttgtgcacttggtgcaagtatgtggagtcgacagggtgctcattga

SEQ ID NO: 72806 - DNA, 608 bp, Triticum aestivum
  Clone ID: PAT_TA_72806
gtcagcagccaggacaagggcatcaaccaggacaagggcagggagggtactacccaacttctttgcagcagtcaggacaagggcaacagccaggacaatggcaacaaccaggacaaggacaaccagggtactacccaacttcttcgttgcagccagaacaagggcaacaagggtactacccaacttctcagcagcaaccaggacaagggccgcaaccaggacaatggcaacaatcaggacaagggcaacaagggtactacccaacttctccgcagcagtcaggacaagggcaacagccatgacaatggctgcaaccaggacaatggctgcaatcagggtactacctaacttctccgcagcagttaggacaagggcaacagccaagacaatggttgcaaccaagacaagggcaacaaggatactacccaacttctccgcagcagtcaggacaagggcaacaattaggacaagggcaacaaggatactacccaacttctccgcagcagtcaggacaagggcaacaaggctacgacagcccataccatgttagcgcggagcaccaggcggccagcctaaaggtggcaaaggcacagcagctcgcggcacag

SEQ ID NO: 72807 - DNA, 518 bp, Triticum aestivum
  Clone ID: PAT_TA_72807
ccgatgcccccgccgacgtggtcgccgaaaaccccgtcccgggcgccgccggccgccgcgggcgcaagccgcgacgcgtcgaggtctaggccccggccgtcgaggacgcctccacgccccagcgcggggactctaagcacctggtgaacggtggggacgcggcgatggcggagctgggccccgcgggctgggaggaggtcctcagggtggtgccgtccatggacgcggtcgtcaaggtgttctgtgtgcacaccgaccccaacttctcgctgccgtggcagcggaagcggcagtacagctccagcatcagcggcttcatcatcggcggccggcgcgtcctcaccaacgcccactctgtcgagcacttcacccacgtcaagcttaagaagcgcgggtccgacaccaagtacctcgccaccgtcctcgccatacgcaccgagtgcgacattgccttgttaactgtcagtgatgatgatttctgggagggagttacaccagttgagtttgggtcgttgcca

SEQ ID NO: 72808 - DNA, 649 bp, Triticum aestivum
  Clone ID: PAT_TA_72808
cacgcccaaggcttgatctgccgccgcctctactctacccatgctgcctgtgacacgtcagatccccatctgccgtcacttctcctctgcccatgggccatggctgttttaatgcatcaaatccgtaagcttccagttgcatctccatctcttgcagattgatttacaattgggacctctaatgatggtgccgtccctaacaaagactacagatcgatctgctgtaacattggctgggtgttctcttctcgactctaccaacactctggagttacaagcaattgcatcaggtttatatatctatgttcttttttttttgctttgagctgctttggttttattggtaaacggggagaggcttgtgagctgtcagcacatcttggccacaactgatttacaaaaagacgaatagacatgcagtctaagctccattgcaaagggattttgttagtacatgccatgtttatgctcactgttgaatagtctgtatacaactatttatgcaatacttggaccacaggagcaattcattctgtatattttgctgggggttgtgccttgcagtcaatttatagaagggtaagatgtatcgcaatatctttgacttgcattctctgtgatgtcaagtaagaaaatagaatatatactc

SEQ ID NO: 72809 - DNA, 622 bp, Triticum aestivum
  Clone ID: PAT_TA_72809
ctggaaaatatatctgctacctgagcactggggatttttatggggaggatatcttcagcttcaaggatgaaattcaggagaaaaatgtggtctgcgaggatctgaagaaggctccggaatctttatcgtcttcttccgagcattgctttccagttccaggtgagacattcatgccagtaccagagatggaagagcgggagaaatccatcaacaatgtacagagtgtaagcttgccagagagaaagggattcaccagtgattcggttgaggagaagaggttggagtgtgaccctgttcctctgtcagcaatggagacgaagaaacctgagcgggtcggcaagccacattcttcgatttctcagcgaataaggcaatgggaatgtgggaatttgaagggagttcttgatgaaatcgaggataatccggtggaaatctttttcgagaagggatcattcaaggtcgtggaggaagccatgccattggagactgaatcttgggaccaaaaacagagtcaagaccagctcgctcaagaagaatctgaccggaagcaattaccagaggaggagcttgtacatgtcaaggaagaatcggcgcagtcgaaggtggcggaagaatgcatcat

SEQ ID NO: 72810 - DNA, 665 bp, Triticum aestivum
  Clone ID: PAT_TA_72810
caaggtcaacagccaggacaagggcagcaaccgggacaagggcggccagggtactacccaacttctccgcagcagtcaggacaagagcaacagctagaacaatggcaacagtcaggacaggggcaaccagggcactacccaacttctccgttgcacccaggacaagggcaaccagggtactacccaacttctccacaacagataggacaagggcagcagccaggacaattgcaacaaccaacacaagggcaacaagggcagcaaccaggacaagggcaacaaggtcaacagccaggagaagggcaacaaggtcagcagccaggacaagggcagcaaccaggacaagggcagccagggtactacccaacttctttgcagcagtcaggacaagggcaacagccaggacaatggcaacaaccaggacaaggacaaccagggtactacccaacttcttcgttgcagccagaacaagggcaacaagggtactacccaacttctcagcagcaaccaggacaagggccgcaaccaggacaatggcaacaatcaggacaagggcaacaagggtactacccaacttctccgcagcagtcaggacaagggcaacagccatgacaatggctgcaaccatgacaatggctgcaatcagggtactacctaacttctcc

SEQ ID NO: 72811 - DNA, 629 bp, Triticum aestivum
  Clone ID: PAT_TA_72811
ccgcgtgtggaccggaagaggcggcgccgttctgtgccgctggccggcccggtgtccaaggtgcttggctacgacaacctcctcatcgagatcctcgtccgcctccctccgaagccgtcctcgctcccccgtgcgtctgtcgtatgcaagcgctggggcagcatcctctccgacccccagttcctcaaacgcttccgcgagcaccacaggaaacctcctctgctcggcttcttcagagggtatgctaaaaacttcattcctgccatggactcacctgaccgcatccctgctgcccgcttctccctgcccaagagcagcataccctaccacaccgatgaagcatacatgggctgccgccatggcctctctctcttaatcaacattcataagcgcgagaccgtcgtgtgggatcccctcaccggtgaagagcgcatcgtggcttttccaccagggttcaacagtaccttaatgtggagttacagtggctggcatggcactgtattgtgcgtcaatgctgaagatgggcatgtccacggagattgcttctcgagcccgtttaaattggttttggtctgtgctgagtacaatacaccggcagtttgttctgtctacgactcggcgtctgatgt

SEQ ID NO: 72812 - DNA, 719 bp, Triticum aestivum
  Clone ID: PAT_TA_72812
ctaccatattcgcagccacaaccatttcgaccacaacaaccatgggcacaaccgcaaccacagtattcgcaaccacaacaaccaatttcacagcagcagcagcagcagcaacaacaacaacaacaacaacaacaacaagaacaacaaatccttcaacaaattttgcaacaacaactgattccatgcatggatgttgtattgcagcaacacaacttagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaagcaacaacaacaactatcgagccaggtctccttccaacagcctcagcaacaatatccattaggccagggctccttccggccatctcagcaaaactcacaggcccagggctctgtccagcctcaacaactgccccagttcgaggaaataaggaacctagcgctacagaccctacctgcaatgtgcaatgtctacatccctccatattgcaccatcgcgccatttggcatcttcggtactaaatgagaagaaaataactctagtactagatatatgaaacaccgttttcttagtccatggtatggtcgttgtagcggtgaaaaaataatgtgacatgcactatcatgtaagaaccc

SEQ ID NO: 72813 - DNA, 564 bp, Triticum aestivum
  Clone ID: PAT_TA_72813
gcatcattcaagccaagcaagcagtggtcaatacaaatccaccgtgaagacctttctcatccttgccctccttgctatcgtggcgaccaccaccacaactgcagttagagttccagtgccacatttgcagccacaaaatccatctcagcaacaaccacaagagcaagttccattggtgcaccaacaacaatttttagggcagcaacaacaacatttgccagggcaacaacaaccatttccaccacaccatgcatatcctcagccgcaaccatttgtgccactactaccatatccgaaaccgtaactatttccaccacatcaatcatatccacaaccactgccacaatatacccatccacaacaaccaatttcgcaataacaagcacatctacatctgcggcaacaacaactacaacaacatcaaatcctttaacaaattctgcaacaacaactgattccatgcaaggatgtcgtcttgcaacaacccaacatagcacatgcaagctcacaactatcgcaacaaagttaccaactgttgcaacaattatgttgtcagcaactgtg

SEQ ID NO: 72814 - DNA, 529 bp, Triticum aestivum
  Clone ID: PAT_TA_72814
gcaggagacacgagctgcacgcctcctctgacatctgggaatggcgtggctgtagaagtgtccaagcctgtggagatcatctatactggccttgttggaattgcctggaaagctggattacaagcctgtgcccacgttaaaatcatcatttggagcataggtattctgtggatatctagcagtggaaggatcattggttatgcttgataagtgatcaatggtttcttaaatactattgaccaagtcagtggccaaacatgtgctccaagcggaacacgtgttatggaggaccatctcaacaagagcacgacactcctgcagttgctaatgaagtgtttgctattgatgaggaggtctcccatcttactaggcttaaatcagagccaagtgagagaactcgtgcatgccttcatgctggcaagagccatatctatacattcaagctgtcgtcatcaagagaatccaatcgctccggatttggtagattctcttcagtccattgctgttatgctcttcacaaacacctacc

SEQ ID NO: 72815 - DNA, 730 bp, Triticum aestivum
  Clone ID: PAT_TA_72815
tttgcaagtatagagagagcgccgaggctgtggagaagcgggtgaatcaggggggcaagatctgccagtgggcatggagttccttatgcaaccgattaaaatatttatggtgcctgaggaggttaatgattgtgaaatccctatggagcccctccattatcctgtggcggcacggagcataatcaacccccattcgatgggaagatttgtgcggtagaggcagccgctagagatcagagggaggattccccacaggcctcggcacagtcggcaggaaagatggatccaagaacttcaggatgggcacacagttttttgggtcgatggtgaatgttcccttcacaaatggggcgcggaagaatctatgtgggaaaattagccatgagcaaagcagaggacgatgtacggaagacgatggaggttttcgcggatgtcggttcaaaagatacacacttcacctatcgctatgttaacaaggagcatgatgttcttcctcgcatcaacctctttgatcaagacagtctgttaaaagaatgatcaatatggctgctggcatcggcaaggatgttacatcatactcaaactgcaaggaattcccttgtccacaaagttcgtaggtttatacgaatatcacgtgttgctccaaaggaacagctagccgggaacacccttatggatcatgagttgatgcccataatcctatgccgctactcccagattgacatggaat

SEQ ID NO: 72816 - DNA, 663 bp, Triticum aestivum
  Clone ID: PAT_TA_72816
gtgtttattgagaaacgtttcttgtcattcttggttgcaattaccactattcacaagcttaacatcatattggatacactttatgtttgcaaaaatggtttgagttaccattttgattgaaaacaatgatagcttcatgatgtagctattgcagcttactgttcatctcatgatgtagctacctttctcagctctcatgatgtagctatctttctcagcttgctgttcttgcatgatgtccaagctatgttttgtcaatgtagtagttccctagtatacaccactctttcatcaaatttggtgcattctcatatatctattagatttctccatttagttattttcacttgttcaaaacttgttgccttttaacttcatgtaagatttagttgcgtattttctacactggtctgattaattgcttaacttcgtgtgagttcatgtgagcttactctacttactacatagagacatatttggcgtatcttaaactattttgcaggatgagatgctaacattgataggtccacggcgaggattagttcagttagataatatttattttgagttgaatctgagggtgaagggtgatgccggcgacgaaaattttagcaaaggtgtggtagtgctccatgttggtccctatgatcctaaaccaatcac

SEQ ID NO: 72817 - DNA, 699 bp, Triticum aestivum
  Clone ID: PAT_TA_72817
ctagagcacaagcagaaaatcaaagtacgtagtagttaacgcggatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgcggcaa

SEQ ID NO: 72818 - DNA, 525 bp, Triticum aestivum
  Clone ID: PAT_TA_72818
cgctggcagcggccccttcctccactccccgctcctcttcgggacgcacgacaacggaaggaggggtcctgatgggagcaaggcttgcgaccccgccgtcacaactgctctggagccccgacaaagctagcaacagcaacacaggttccatggcctctgtcgcacatctgccgcccagccgtccccagggtaggtggtggctcgtattctgcttgctgtgggctgcatctcctcccacaacaacggccggcaactaggttcgccatcggagttcttcagcattgccccctgtctgtcattttacacgacttcttaagtcatcccggcctccccattctgtttcaacatgacttctttgtatttattggagcaaggcggtaatgcagcctcctcgcgttagacagtgtgctcccacacctcttatgccagaacggtggcatccttcatcacagccaccgcctccttgccaggccagtcactcacatgccagcgctctcttgcaccgaattagccggctgattgacg

SEQ ID NO: 72819 - DNA, 616 bp, Triticum aestivum
  Clone ID: PAT_TA_72819
ctctgagtatactgaattgtcgtgagttggttgaggtcttcgacgtccctgcatctctcaagacaatgcaaattacgagatgctataaggttgagtccatattcggcaggaggctacatcagggacagtcgtcatcgtcgattcagcaaggggcatcttgtatactggaggtgccatcatcaacacctggagctggggtggagcgtttaacattagaaagatgtgatggattaacaggggccctccatcttccccagtcactcatgtatctacatctttggcactgtgatcagttggcatctctagaatcttgctcgggagagctcccatcattgaggcgcctcatgcttgagtattgtcctacactgtcatccctaccggatggcccacaagcatactcttctctcgaagatattcgcattagaggctgccctggcatgaagacgctccctgcaagcctgcagcaacggctaggcagcctcgagtgggaaagcatagatgcccattattatggaaataagcctatgctgctgaagcctaagacgtggaaatatgccatccgtagagattagagtggaatacctgtgtggaagttttcattcagcacaaacaaatg

SEQ ID NO: 72820 - DNA, 243 bp, Triticum aestivum
  Clone ID: PAT_TA_72820
ctaaactgtagaacaaacattatctaacacaaatcaaccaggaaaaaatttctcgttcttgccctaattgttgcatcggcgaccaccacggaagccgaaccctttactgcattccgtaatgcttgcgacccgcaacatacataatctccggagcatcaaccaactcctcagtcacgaaatcatccaattccacatcaaaagttgaacccatgcagggatgccctcctacaacactgtacccca

SEQ ID NO: 72821 - DNA, 644 bp, Triticum aestivum
  Clone ID: PAT_TA_72821
cccacacgccgctcgccctctctcgagatctctggcgcctcccatgaatccccaccccctccgcctcggcgcgctcttggcggccctcgtgcttgccgccggcggcgggtggtgggcccgtgcggaggcgtcgatccacacctacggccgcgagtcgttccgcgaggtgggcaacgctttcctcctctccggcggcagcgagggcatcgtcgccgacggggccgatctcgccgcccccgactcctccttcatcaagtttgtgaatgttactttctggaggaactcagaatcggcagaatcacatacaaaaatggcacatagtacaggcttggtgcaagctattttatttgaagcagctgacagggataacattgggggttctgcctatggtggacagaggtccatttgttgcacccctgaccttgctaaactagagggctgcaaacaaggtgaagtaatcaggaggccatcttctgatgatccaggttggcctgtcgtggtaaatacacacttcagtgctaatcacctttcagtgaagttggatgacgaggaagttcacattacaaagacaggcatgtacaacttgttcttcatttcttgtgatccaaaactaagaggccttgctatgagtgggaagacaatct

SEQ ID NO: 72822 - DNA, 261 bp, Triticum aestivum
  Clone ID: PAT_TA_72822
acctacgtcgtgacatatcaagatagagtatgtaaattcagggcaacaaattgcatattgcttgactaaaggactgggaaccagagaatgtagcttaccgcgtgacaagatgggaatgatatatatctatcatccctcttgagggggagtgttgcatggaaactatcttttagtttctggtgtggatcctgccttctaaagacactttatttgattttatgaagctaatcataaatggggatatagattttgcattcaaaa

SEQ ID NO: 72823 - DNA, 718 bp, Triticum aestivum
  Clone ID: PAT_TA_72823
gagcgcatcatttaagccaagcaagcgggggtcaataaaaagccaccatgaagacctttctcatcctaaccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatc

SEQ ID NO: 72824 - DNA, 517 bp, Triticum aestivum
  Clone ID: PAT_TA_72824
ctctcatcagatcagccacagagtcacacaagcactagcttgagctagccagcctcagccactccgggcattttcttgcatccacgacggcaatggccaccgctgatgtccagaacccgacggccgcgctgacggaggaggcgcccgcggtggagacgccggtggccgccgaggaggccccgaagacggaggaggtccccgcgccggcggaggccgaggtcgaggcgtctgcccccgtcgaggttgaggcgaccaaggaggaggcgccgggcgccgctgagacggaggaggccaaggagaccgagccagcagctgcggccgagccggaggccgaggcgcccaaagagccagaggcgccagccgtggtcgagacagagaccaaggaggccgtggcagaggccgagccggcggtggtcgaggaggtgaaggaggaggccgcgcctgctgccgagccagaagcaccggccgtcgccgaggaagcaccggctgcagcggaggaggcccccgcggccgtggc

SEQ ID NO: 72825 - DNA, 650 bp, Triticum aestivum
  Clone ID: PAT_TA_72825
acaacactagttaacaccaatccaccatgaacaccttcctagtctttgccctactcgccgttgcggcgacaagtgcaattgcgcagatggagactacatgcatccttgtgtttggagagaccatggcagcagcaaccattaccaccacaacagacattggcacaacaaccgctattttcacaacaacaacaactatttgctaaacaaccatcattgttcgcaacaacaaccaccattttggcagcaacaaccaccattttctcatcaacaaccaattctaccacagcagccaccattttcgcagcaacaacaactagttctaccgcaacaaccaccattttcacagcaacaacaaccagttttacctgcacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcatatcccccagcaatcccgctatgaggcaatccgtgctatcatctactccatcatcctgc

SEQ ID NO: 72826 - DNA, 650 bp, Triticum aestivum
  unsure (1)..(650): unsure at all n locations
  Clone ID: PAT_TA_72826
ccaaattgaagaggttaacgtccgacagaaagacgccatgggtgacgaagattactagggacaaaccaccacccgcctctgcagaaaacgagcagctccacacgaggcgcgccgctccagccaccgcaccgagcaccactccgaaaccccactcatgaacaaactcctccttgcagaccccatggcgccaagccccggatctggccgttccccgcgaggaacaactcaccagacggggtagcagcaagcagccgctacgcatgcaccccgggccgatcggcggcaggaggcaaggccccaatccgcggggacgtcaccaagatgagatccagcggcggtgaccttcacgactcgagccaccggggacaaagtgggtgagcagatggaggaagcgtagggagggaaggagcaggaggtggaggaactcccgccgccggcaacggcggcgagggaaggtgaggatggaggcggtgctcggggggaaaacctgatcgcccccgagtcgcctgcacgagacgacgcggggttacgcctccaggtgcttacgagcgtcagttgtattcgactggtgattactatgcttttgataatactcttggtgtctctggaaatcctctntgcttctattatgcgccaatttgcttatgatg

SEQ ID NO: 72827 - DNA, 670 bp, Triticum aestivum
  Clone ID: PAT_TA_72827
catgaactttggaatacagaagtgtgcttcagtgccattaaatatgtgcctgtatgttgaaacagttttgtctagattatagaatctagactggagtccaagaatacaacaatttagcttgttttcctccttgttttgtttatgaatctgaagttgcggaagcaggccccattagcttttccttgtatttctgagaacgtgtttttggcttcgaaaactctcaaactattttgtgttgataccgtggataaggatcagctgagctccatctgaactatttcatgttagtctgttgatgtggataaggatttcttagcttccatgtccaagaagtgtacactatagttaaacaccctttaaacctagcagttgtcatgatttctatcattctgtgcatagatcttattggttttagtctaggttgtacacatcgattaatttagccaaaggagttattaataagggttcttaatagacggtggacatgcaccctaacttgtttgcaggaaaaactgtccctccaattcatgctaacaagttgaccacatatgccatgttgttcaatgcatctgaacttagtgattcatcagaatatagcactgtatgagtaatggatgcttcttgagacttgagaagaatgtgattcatggcgtatatcatacatattact

SEQ ID NO: 72828 - DNA, 624 bp, Triticum aestivum
  Clone ID: PAT_TA_72828
caaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccttgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtgacatgcactatcatgtaagaacccgaactatactagttcaaacttgggaataaaagacaaacacaggtcttgt

SEQ ID NO: 72829 - DNA, 589 bp, Triticum aestivum
  Clone ID: PAT_TA_72829
acaatgatcacattcccgattccgtggtatacattaagggaatacgggattctattcttcgtaacgaattcatacttcaagatggaactgctcaatgtgatatggacattcataaaattaagatggacattcagaaaattaatactgaaaagaagatgacaaaagacgtgttgtcaacaatggagaaatataaggaacctagctcaaatataatgaaagttgccaatctaactttctctggcgatgatgggaaaaccaagagcactaagagaatggaattgaaatttaaggaggcactcgcacaacgcgataaatgcatggagcttaatgatatctgctgtgattgcgattggatggcccctacatacacagtactaccttcactaacatatggaatgcacgtcggcgaagtgcgttcgaaatgccctgattttgagtcgagcatcactagcgatccttgtccaaccccacatgatgcgaggtgctctgcagctgccaatatgatattggagcttggcaagaaggtggaggacacagaacatcatgctaactgatgcaaagttgctaactgggaactagcacgctgggg

SEQ ID NO: 72830 - DNA, 517 bp, Triticum aestivum
  Clone ID: PAT_TA_72830
ggattttagcctccagcgccgccgccgccgcccagcgaggtcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcctgaacgctgcccgctggtacgacgccgtcgccgcggccgtttcttcaaggttccctggccaggcctctggggtgagtgcatcctcggctcctgctgcagctgctcctgctgcttccaaggatgaagatgatgacgatgacatggatctgttcggcgatgagaccgaggaggacaagaaagcaccagctgagcgtgaggctgccaagcctgcaaagaagaaagaaagtggctaatcctccgtcctcatggacatcaagccatgggacgatgagactgacatgaaaaagttggagg

SEQ ID NO: 72831 - DNA, 525 bp, Triticum aestivum
  Clone ID: PAT_TA_72831
tcaatacaaatccaccaggaatgacctttctcatccttgccctccttgctatcgtggcgaccaccaccacaactgcagttagagttccagtgccacaattgcagccacaaaatccatctcagcaacaaccacaagagcaagttccattggtgcaacaacaacaatttgtagggcagcaacaacaacattttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaacaacaacaaatccttcaacaaattctgcaacaacaactgattccatgcagggatgtcgtcttgcaacaacccaacatagcacatgcaagctcacaagtatcgcaacaaagttaccaactgttgcaacaattatgtt

SEQ ID NO: 72832 - DNA, 519 bp, Triticum aestivum
  Clone ID: PAT_TA_72832
tcctctcaccacggcgttcgccgcttgccacaccgtggactgccggtttctcccctccaagtgccccaccacgccggccgccggtctccacgccgtcgactgtcgcagttcttcgtcgccggatgtgccccgcaaagagccccgccccgcgcgagcccttcgccgccggatgtgcgtcgccaagtgctccgccccacgccagcccttcgtcgccggatccccgtccagcgcggccagccccccgtcgctggatctgcgccgtcaagagccccttctgcacggcaccgcagccggatcccggccccgcgacagtcctcccccgccggttgtggccccgcctggaatactcccacccagcaaacctcccgtagcgccgagccgtcttgctcatcggtgcagcgtccatcgcccaagtgtcggctcttcaggtgataggtgctgatcgtaaaaagatagatgttgtcaagaattccaatggcattggcatagccaagctgatcaagaactcggcagagaact

SEQ ID NO: 72833 - DNA, 516 bp, Triticum aestivum
  Clone ID: PAT_TA_72833
ctccagcagcgtagcgtagcgcccgcttccgccgttccggcccgccgccatgagggagtgcatctcgatccacatcggccaggctggtatccaggtcgggaacgcgtgctgggagctctactgcctcgagcatggcattcagcctgatggacagatgcccggtgacaagactgttgggggaggtgatgatgctttcaacaccttcttcagtgagactggtgctgggaagcatgtcccccgtgctgtctttgttgatcttgagcccactgtgattgatgaggtgaggactggcacttatcgccagctcttccaccctgagcagcttatcagtggcaaggaggatgcagccaacaactttgcccgtggtcactacaccattggcaaggagattgttgacctatgcctggaccgtatcaggaagcttgcagacaactgcactggtcttcagggattcctcgtcttcaatgctgttggaggtggaactggctctggccttggttctcttctcctggagcg

SEQ ID NO: 72834 - DNA, 428 bp, Triticum aestivum
  Clone ID: PAT_TA_72834
cctagccgtgctactcgccgcgctcgcgtacgtgcttagcgtgctccgcagcctcgtgtggatcccgtaccgactggagcgccgcctgcgccggcagggcatccggggccctccgcgcagcctcatctccggaaacggggccgactacggcgcccttctcgccgccgcccagtccaagccgcttgcctccttccaccacgccatcgtcggccgcgtcgcgccgcactaccgcgagtggcccgcgcggtacggccggccgtttgtgttctggttcgggccccggtcgtggctggtgttctccagcccggaagtcgccaaggccgcgctgaacgactccacggggaccttcgataaggctggcaacggcggcggcagcaacccgctcgctcggcaactcatcggcgagggactggtggggctcaccgggg

SEQ ID NO: 72835 - DNA, 682 bp, Triticum aestivum
  Clone ID: PAT_TA_72835
cgttgatgcattgcaggaccttcttttctccactagcatctgtgcgtgctattgttgagactcaacaagattcatcgttgggtgatttactgattagtgtaggcctcttctgttatggagaaattggtagcgcatcaccaccgcctcatgtagtcttttttttttcctaaaaaatatcataaaataaatctgcaagaattttatataaccgtgtacaaaagaagttctataagaacattaacttttttgtatatccttatcttgccatctagcttaaatatgataacccgggatatgctttgtgcattacatattgggagtgattcaaagcaatgcaagaaattatttatttgtattgtagcttgaatatcaattattctattataactatcttaatttatttgcatgttttgttacaattttttgccaaccatggttaacttaatgccttatttatatacccgttcaatttacactataatctgagccctaagagtgcttgcaggtcattgttctcactgcaacagttttgaaatcatcatctgcaattaaattcgatttggagtgtcggtggaaggaggaggcagtggcgccggcacatagcaaactggactgaagatggagtagcagagtcctctgatctaccacagtgtccgaatgatgctgcccactgctccatcag

SEQ ID NO: 72836 - DNA, 720 bp, Triticum aestivum
  Clone ID: PAT_TA_72836
cagcctcgctctctccctcaatgcccattcagcaccgcagcggcaccctcgatcccctctgccttctcctcatcacctcgctcgcctccgcctccttgccatggcccctcgcaaccgctcctcctctgcctcgcgccgccctccactgtcaagagtcgaccttgtccggatcggtcgggccctgccatggccgtgtctccctactgtcgaggccccgctgccaagtcccgcctgcatcatcctgtcgagcaccaggacgaacggcagcagctcctccctccttgtccacgttgacgaaaggcgtgccctggacctctttaccctcgctggagcgagctcgaccccttgctgccatgcacaacttctgtcgtgccctgttgtgcgtgctctccgctgcctggcaccattgacatcaaggccgtggttgccaagttcctctccgcggtgaaccactacttccacaacgcgtccggaatgactaccgtcgccttgggtttcatcaagttcccctacaacaagtgtacctctaccgccgtcttcggaatcgcgaagaacgccaagtacctagacgggtgtttttgccaagtaccgcgacacccagatccctcagatcagtcaagttcatctacgaaaacgtgtatgaccatcgtcaaaactgtaaagtacctctacgcacggatatcgccaagtaccacgataccgatgacatccactactact

SEQ ID NO: 72837 - DNA, 649 bp, Triticum aestivum
  Clone ID: PAT_TA_72837
cgaagaatctccgaccgatcgaagccagggctctctcgtccgtggctccccaagatctttgtgaagaccctcaccggcaagaccatcacccttgaggttgagtcgtcggacaccatcgacaatgtgaaggcgaagatctaggacaaggaggacatctccctggaccagcagcgcctcatctttgccggcaagcagctcgaggatggctgtacatttgctgactacaacatccagaaggagtccacccttcacctggtgctccgccttcgtggtggtatgcagatcttcgtcaagaccctgacgggcaagaccatcacactggaggtggagtcctcggacaccatcgacaacgtgaaggcaaagatccaggacaaggagggcatccccccggaccagcagcgcctcatctttgctggcaagcagcttgaggatggtcgcactcttgctgactacaacatccagaaggagtccacccttcacctggtgctccgccttcgtggtggtatgcagatcttcgtcaagaccctgacaggcaagaccatcatgttggaggtggagtccttggacaccatcgacaacgtgaaggcgaagatccaggacaaagagggcatccccctagaccaccagcatctcatctttgctggtaagc

SEQ ID NO: 72838 - DNA, 222 bp, Triticum aestivum
  Clone ID: PAT_TA_72838
gccgtggccaacatcacgccgggctctatgaccgcgccgtactgaaacacccagtcattcaagctcgccgtcgtgctggaaggcgagggagaggtggatatcgtgtgccctcacttcggccgtgacaccgagcgccgcgagcacggtaagggcaggtggagcgaggaacaggaggacgaccgacggcagggaggcgttccccacggtgcaggccgcggtgga

SEQ ID NO: 72839 - DNA, 489 bp, Triticum aestivum
  Clone ID: PAT_TA_72839
caagggcaacaaatgggacaagggcaaccatggtactacaccgggttctccacagcagatcaggacaaggacaacaatcaggacaaagacaacaagggtactacccaacttctccgcagcagtgaggacaagggcaacaaccgggacaagggcaatcggggtacttcccaacttatcggcagcaatcaggacaagggcagcagccaggacaatgacaacagtcgggacaagggcaacaaggtcagcaaccaggacaaggacaacaagcgtactacccaacttcttcgcaacagtcaagacaaaggcaacaggcaggacaatggcaacgaccgggacaagggcaaccagggtactacccaacctctccacagcagccaggacaagagcaacaatcacgacaagcgcaacaatcacgacaatggcaactactgtactacccaacttatccgcaacagccacgccaattgcaacaaccatcacatgggcaac

SEQ ID NO: 72840 - DNA, 629 bp, Triticum aestivum
  Clone ID: PAT_TA_72840
gcagagtgaaggttctcactggtctgaatgacctggaacacgtccaagagctggcgctgtacaacatggatgtgctcgtcgatacattaaagcttgccgacgagaagctttgtgacaagatcaaatgcctgaccacccctaccaaggtagaccgaggcgtgctcgctggttcctggctcagaaagttgggggcaccggctatgacatcatccgacagcgcagctccagaactgccctgcggtgatttggagaggtctggttctgttgggcgaaaagcaactgatgacattgaggtacactacagttccggcggcgcatggacaaggttggcacaggtgtaagcctgttttcagatcagtgtatagaagaagcatgccttcgtgttgcttgctcggtgattctgtgaggtgttatgcttgcgatgggtggagaacttctgattgctcgccgtcaccaacctgattttcttggttttcatggaatatcgcaaaactgtttcgagttctagttgcgagctttcaatcatttttcggcaaaagggctgtggccccagttccattgaagcaacaaaaacaagctcaagataggcatggcggacatggcaattatgacacgaaaaggtacaacag

SEQ ID NO: 72841 - DNA, 691 bp, Triticum aestivum
  Clone ID: PAT_TA_72841
caccaatattactgcatgtacacctttggaaaacatgaaatgggtatagcaactttatcacattatctgagtactagcaggctactcctgaaacatgacctcagtagaacttctgcattggacaagacatcagccatatctactgttattgatctccttgattacaacatagccttttctgtttcgtggctatgccatgacataaaggcattacttatcatgagcaatccagtgttaggtgcttctgcgaatgatgagtcatttcaagtattattagaccgattgatgcaagctgcgcaccataaaagtcatggtatatcaattaacacagaggcagtaatgcccaatggttcattggacaagagacaaccaggaggaagtgaggattcaagtctttcaattgatgaaaagtggcatttgataggtgcttccttgtggattggattgtcatcctttatgaaacatctcttaaaagagttcattggaaacgagaaacttgaatgtgaagcttgtacaagtgacgtgaaggaatttaagggtcttgcctcttcagttgctgcaaagtttgttattgattccctgcaatttgtgtcgtcttcattagtaagactccatgcatcatttttcagagacaaattatcaaataatttacatccgagtgtgcttttctggttagaatatatgtcgtctc

SEQ ID NO: 72842 - DNA, 682 bp, Triticum aestivum
  Clone ID: PAT_TA_72842
taattatactgcgcatacaattgattcggtacagcgcttggtattgggtatctcaacaattataagggctggtgcatggttcaactcgagatgcaatgaaacgaaacatgggccaactgatactaaaacacatgcaagttccagttgggcagagttgaagggaattatttgcacgggattggaactcaggcactacaaaccatgggagaattcagagaccccctacctaaaattattggcacttattcaagtacaacaatcaggttctcatttttggccagtgaagtttctatccaccgatgtttatgcacatgaagcttggtactactgcattcctgacacttgtatcaggagaaccctcatgggaattgtggactcttgttcagcgagaatgtctatccccgctatacttgaagatgcttcagggcatcactgtgaggttcccatctgtgcaattatacaggccgatggtgatcagtgcaagtgtgagtggaaactacaatgctctttaagcaaatggccagatgaagttggaagaggccagaatggcgactactgtatccccttggattgttatgcatggggactgctgcatcctaattgctataaagaagttactcaaggagggaggggcgacggagctcatgctgggcatgtttgctgcatctactacacttactac

SEQ ID NO: 72843 - DNA, 609 bp, Triticum aestivum
  Clone ID: PAT_TA_72843
ctctcttccccccgatctggatcgagatcgggggctgggctcggcgctcgatgctgccgcggcctggatcaccacgtcgccggagccgccaccgccgccctccatgtcgacctccgcatccttgaccgccccaccggagtgcttcttcctcgtctcctccacctccccgactagatctgggctacgcccctggcgcacccgacgccaccgccgcacaccgtcgccgcctcgtcctgccactgcatcgccgaacctcgccgcatcctcatcacctcccatgacggcctacaacaggcctcgccgcccccgacgccgctggaccacgtcgctgttgcccagaacgccacctcaaccgcctcctcgccgaaccttgcgtcctcgtcctcttccccgtcggccacctgcaagcctcggcgccccctctacccatcaacgctgaccccgagattgccggcgacccccagttcaattacggtgtagacgacccctcctacttgccagagcaaccagtcgttggagcccaggagtcagacgccaccgtcgacgacgactactacactggaggtgcctactactacgtgcaggctgctgacgacgaccaggagtagt

SEQ ID NO: 72844 - DNA, 658 bp, Triticum aestivum
  Clone ID: PAT_TA_72844
tttcacagcaacaatcaccgttttcgcaacaacaacaaagggtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgccgttgtatagaaccaccactagtgtgccattcggtgttggcaccggagttggttc

SEQ ID NO: 72845 - DNA, 310 bp, Triticum aestivum
  Clone ID: PAT_TA_72845
cttctccacagcactcatgacaattgcaacaaccagcacaatggcagcatccaggacaagagcaacatggtcaacagccaggacaagggcagcaaccgggacaaggtcagccagggtactacccaacttctccgcagcagtcaagacaagagcaacatctataacaatggcaacagtctggacaggggcaaccagtgcactacccaacttctccgttgcagccatgacaagggcatccagggtactacccaacttctccacaacagataggacaagggcagcagccacgacaattgcaacaaccaacaca

SEQ ID NO: 72846 - DNA, 677 bp, Triticum aestivum
  Clone ID: PAT_TA_72846
tcgcaaaacactgacaacaatcgtactacccaatcttcttatggggggtgaaaacaaaggcaacaggcaggacaatggcaacgaccgggacaagggcaaccaaagttctacccatcctctcacactgcacctatgacaagatcaactatcaggacaaacgcaacaatcaagacaatggcaactagtgtactacccaacttctgcgaaacagccacgccaattgcaacaaccagcacaagggcaacaaccagcacaagggcaacaatcagcacaagagcaacagccaggacaagcgcaacaatcaggacaatggcaactagtgtactacccaacttctccgcaacagccaggacaattgcaacaaccagcacaagggcaacaagggtactacccaacttctccaacagtcaggacaagggcaacaagggtactacccaacttctccgcaacagtcaggacaagggcaacaagggtactacccaacttctccgcaacagtcaggacaagggcagcagccaggacaaggacaacagccaagacaagggcaacaagggtactacccaatttctccgcagcagtcaggacaagggcaacaaccaggacaagggcaacaaggatactacccaacttctccgcagcagtcaggacaagggcaacaaccaggacatgagcaacag

SEQ ID NO: 72847 - DNA, 622 bp, Triticum aestivum
  Clone ID: PAT_TA_72847
gaaaagtctcctgtgactgttgtacttgtatacatgatggagcttgagatgaagcaagcagctacaagagcagcagaccactatcttgattacgcacttcccccttctcttgtgccggtttgccagttatttgttgataactacagactctggaaactgatgagatgttgattcagtaatcggttcatcagtaaggtccaacctagtcgtatggatgtttcttatgttcaagatggcgccatgcaagttgttcaaatgcaagatgctgagaagggtagtataagaattggagatgaagaaaagcaagctgcaattaattactagatggtatgatacatggtgcgcaaaagaaagctagcatgagatgtttctccatgtgttgatctgccggagggaaatactcatgggaggcatgcatcaggttgttaccagattcagttctggtgataattgagatttttggttggtttgcttgcaggtcaccggatcatttctttacagctaaacagaatgttaatcagctccgatctatgatggccaactcaccagaggagatgtgttggagatatccagagctaagcatgcagagtgtcagttccactgaaacagaatgtaaggcaag

SEQ ID NO: 72848 - DNA, 596 bp, Triticum aestivum
  Clone ID: PAT_TA_72848
gaaaagacagccggccaacctgcccccaggctccctcggcctgccggtgatcggccagagcctcggcctcctccgggccatgcgcggcagcggcggcggcagccggtggatacaggaccggatcgacaggtacgggcccgtgtcgaagctgtcgctgttcggcacgccgacggtgctcctggccggaccggcggccaacaagttcctcttcttcagtagcgcgctctcgacgcggcagccccggtccgtgcagcggatactcggagagaacagcatcctgggcctccacggcgccgaccacgggcgcgtccgcggcgctctgctcgagttcctcaagccggacatgctcaagatgtacgtgggcaggatcgacgccgaggtgcggcgccacgtcgaggagaactgggccggccgcgggaccgtgacggtgctgccgctgatgaagcggctgacgttcgacatcatctcggcgctgctcttcgggctcgagaggggcgccgtgcgggacgcgctggccggcgacttcgcgcgcatggtcgagggcatgtgggccgtcccggcgaacctgccgttcacggcgttcagccggagcctca

SEQ ID NO: 72849 - DNA, 641 bp, Triticum aestivum
  Clone ID: PAT_TA_72849
cgccaagcacaagcacgcaggtgtcgccgtcgtgcggatccgcggtggtcgccgacgcaaagctggcggagggagggaggggaggcgcctagctcggtcggttgcgcttagggcctgcgggcgccggagcggagcctcgctgacggcaacctcgcagatgcagcagaccaacctcgcaatgctctgccggttcttggaaatccccgatgaacttcagcgaagactggagaagcggcaggcaaatcattggcaatggaacacgatacacgctctttttatcctggtcagttatgatgagaatcacaactccatgcttcagtaatctttcaaggtacatgtaagcatgcttgtctgtacatttgctactttggttggtttcttcagaacataatctgtggatgtgggggatggatgcacggtatccttctggtttgatagttggttgccatgcggagctctggcaatagccttccccatcctcttcacgcacgcaacggacgtcgaggtcaccgtctggcaggtgcgaggtgacgggctgcgtcgccatcttgcaccgcgcctcacaagtgccggggcgcgggatctggcctgtgtttcaacgttgattggttccgcgccaaggcgcgcgggaggggatgatc

SEQ ID NO: 72850 - DNA, 685 bp, Triticum aestivum
  Clone ID: PAT_TA_72850
gacgaggcgaggctgaggtcaaaagtgaagaagagggtcaggggggcgctggtgcgattgttccaccgccgccctgtcaacgagttcaggcccttctttgagagcattggcctcaggccaagcgagtgcgattacctcttgccgcaggacctcacattcctcgcggatgccgagatgctgctcgagagctaccatgcactatgcagttacggcatcgcacgccgcaagattggaaggatatactggaatgctaccgaggtgtttagtcttggccagggcgttcttgcatctaagctcgaggcccttgagggcctaggcttcagtaaggccagtgtgatcaaactagtgatctctactccgaccgtgttggttcatgacccggcggtggaactgaagacgttcttgctgtggctggacgacattgggattcagcgagactggatcggccagttcttatctgaaagggtgtcctataattggccaaaaatggtacaagcccttcagtccttgagcgatctggagttcaccaaggatgacattggtaaagtggtgaggaaaaatccacattcgttgttggaacagtctggtggggagctacactccacagttgacaccatgcaaatggtcggatctggaaaaagggagctacttgatctttttctgaaccaccccaatgttgacagcg

SEQ ID NO: 72851 - DNA, 630 bp, Triticum aestivum
  Clone ID: PAT_TA_72851
aacaacaattggccttgcaaccgctacaacaatttgccaagatccaacaaccacaacaatcattcccacaacaaccccacagaccacacccattcccaaacaactaaaacaagtaatttaacagtatccacaacaaccattcctcctgcaaccgcatcaaccattcccccagcaaccagaacaaataatattccagcaaccccaacaactatttcccagtcacaacaaccatttctccagcaaccccaacaaccatttcccctgcaaccgcaacaaccatttccccaacaaccagcacaaataattgctcagcaacctcaacaaccatcccctctgcaaccacaacaatcgttcctccggcaaccacaacaaccatttccccaaccccaacaagtagtacaaataaatccccagcaaccccaacaaccattttcccagtcacgacaaccatttccccagcaaccccaacaaccattcccactgcaaccgcaacaaccatttccccagcaatcagcacaaataattcctcagcaaccccaacaaccattccctctacaaccacaacaatcattccttcggcaatcacaacaaccgttcctccaacaaccacaacaaccatctccccaaccc

SEQ ID NO: 72852 - DNA, 636 bp, Triticum aestivum
  Clone ID: PAT_TA_72852
ccctcctcccgagatcccatccatggccgcctcccgcccccggatctggccctgaggccgccattgctggatccgcctcccccctccgcgccgtcgcgttcctggctcctccgcgcaccccgctgattgaggcggcctgtcctttccccccctttttctggcggtgcgctcattcgtcggttcttgatccgtcgcatttgcgccggtgagctgcccgagagcaaggaattcaccctgagatctccggttgctgttgccgtcgaagtccccccctccctgccattgcaatctcctgttgctgtcgcaaggtgcgtcttttacataaaatttctgcgaggaatttcacggctgattctcgggaggacggattcctcgcaatggttctttgattgggggagaatttgatgtggtgttggtgccgccgtattctgccgccatgtggaagcaatttatcggcaagctctcgtggaaatcgctgaaatctggccctggcggcggaggaggagggggctcgcccacggcgaagtccaatcccatgtctcccagggagaatggggcattcgggaagccccccgcctcgcccaagtccccctcgggggccgccggagccgaggggaggtccagggaggacgcctt

SEQ ID NO: 72853 - DNA, 256 bp, Triticum aestivum
  Clone ID: PAT_TA_72853
cgaatttccctaaaaaaataaggaaaaaaaggaggagcgagggcgagcaaccgaatgattccgctgtgcgcatcctcctccccgtccacacccgctataatagcgccacgccctcgtcgccttcgtcaccgcaccaccactccctccctacctcactcccgatccccccaccgccacctcctcctcgcctcgccctcctcgcccgctccgacccaacgccccctcgcgcgcgcgcagcggctcgccgtcgcggcca

SEQ ID NO: 72854 - DNA, 669 bp, Triticum aestivum
  Clone ID: PAT_TA_72854
acaaacattcccccatcaaccacaacaacaagttccccagcgtcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcagcagcagcaacaacaacaacaacaaggcatgcatatctttctgccactatctcagcagcaacaggtgggtcaaggttctctagtccaaggccagggcatcat

SEQ ID NO: 72855 - DNA, 488 bp, Triticum aestivum
  Clone ID: PAT_TA_72855
gtggccttctgtatacatagcaacctccgtagcagcagcaggggcactgtgatctgcgagttcgcggcggcgccggccatgcagcaagagctcgccgcgctggcgtaccagtcggccggtttcgtcggcctcccgacgtcctacctgccgccgcacccgcacgacgtcgacgtggacctcgtcgacgggtggttggtcggcggcagcggcggggctggcgacaatggccgcggcccgccgtcgtgcggcagcggcctgagccacgtcgccgacgccgtgagcgagacgaggaaggcgaggcggctggcgtcgaaccgcgagtcggcgcggcggtcgcggatgcggcggcggaggcagctggacgagctgtcggcgtgcgccgcggagctgcgggcggccaaccagcggctcgtcgtggagctcaaccgcgccgaggccaggcacgcgcaggtggcccgggacaacgcgcggctccgggaggagctgcg

SEQ ID NO: 72856 - DNA, 675 bp, Triticum aestivum
  Clone ID: PAT_TA_72856
cgaagtcaaagcgaagttcaagataagtttgcttggccaagataggcaaccagtgccgcagtacagtttcagcagcctgatacacaccttctccaccaaagaagctgcatggggcttcgctcaattcatcaaaaaatatgacttggaggaatcccttcacctcaaggatgatgttttcagcatcaggtgcgatgtcaccgtgttaaaggagatcttcaccgagccaatccggccgcctgtggtggtgccggtgccaccatctgacatgcaccagcattttggacagctgctcttggccggtgaggcggccgatgtcaattttgaggtcggtgcggagacattcgctgcacacaggtgcatactcgcagctcggtcgtcggtcttcaaggcggagctgcttggtaccatgaaggagaagaccgcaactcacatacgaatcgacgatatggaacccaaggtattcaaggctttgctccacttcatctacaccgactcgctgcccgtgatggacgagggcgatggggcagcgactgcccagcatttgctggtagcggcggacaggtatagcatggaaaggctgaagctgatctgcgagggaaagctgtgcgatcacatctgcaagagcacggcagcgacgacgctggcactggctgagcagcatggtcgtgttgctct

SEQ ID NO: 72857 - DNA, 684 bp, Triticum aestivum
  Clone ID: PAT_TA_72857
cggcaaacgaactatagctagcaccacaccaaccaaccagttgtcaattaagcagccacttgagtcttgaccatggggcccaggcagctccccaccgtcctcctcgcctgctgcgccaccctcctggcccttgccacgccattgctcgccggcgaccccgacatgctccaggacttatgcgtcaccgactacaaatccctcaacggcccattgcggttgaacgggttcccgtgcaagaggccggagaacgttacggcggacgagttcttctcggccgcgctggcattcccgggcaacacctgcaactcggtcggctccgcggtgacggcggcgaacgtggagaagctcccggggctcaacacgctgggcgtctccatgtcccgcgtggactacgctccgtggggagtgaacccgccgcacacccacccacgtgccaccgagatcatctacgtgctagagggctccctcgacgtcggcttcgtcaccaccgccggcaaactcttcgcccgcgccgtctgcaagggtgagcttttcgtcttcccccgcggcctcgtccactaccagaagaacaacggtggcgcgccggccgccgcaatctcggccttcaacagtcagcttcccggcacgcagtcccttgccctagcgttgttcgcagcctcaccgccggtgcccaccgacgtgctg

SEQ ID NO: 72858 - DNA, 636 bp, Triticum aestivum
  Clone ID: PAT_TA_72858
ctcaactggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgttgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgatagggacatgggtgattcagaccatcccggcaatgtgcgacgtgcatgttccaccatactgctacaccaccatatcaccatccagtgacgtcactaccgacatgggc

SEQ ID NO: 72859 - DNA, 728 bp, Triticum aestivum
  Clone ID: PAT_TA_72859
ctctgccgaatccgtggcgacctggctccccatagccgcgcgccgcctctccggcggtatactgctttacaacgctgtaccgcagaaccaggccagggaaagaggcgtctttgagctgccacgcttcgagaacaccacctctatcgtgttcgacctaggatttcttggccttgccgtgccgcattccagcgtattcgcccgcctcgtctctctctggctgtttggtgtccatctgcatggcccgtgcgagcttggtgacgctctctcctcaccgcggtgcccatccttacgagaactcaagatccgcaatgcctggggtcttggtaacttcaccatccactccgagtctctcctgcaaatggagctgaataacttgtatggcttgcagcagctcactgtagaagcgaaggtacttcaagagttatatgtgagctcttgctttgagaattctatcactgcggtgagtcgaccggttgcaaacatctcagcccctcaactggcgtcactccactggacggatgcttatgaaccaagctctgtccagcttggcgagatggcacatctccaacgtctggagactggtcatttttttgtgtttggacattatttggatgactacacaccaaatcgcaattgcttgaggctcttgcagcaatttgaggtcatgcaccatttaaagctctcgctgatctatctgctggacaaaggtcaccatcaatacctgatgg

SEQ ID NO: 72860 - DNA, 718 bp, Triticum aestivum
  Clone ID: PAT_TA_72860
caagaatcaaatccaagtaagtagtacctaacgcaaatccacgatgaagaccttactcatcgtaacaatccttgcgatggcaacaaccatcgccaccgccaatatgcaagtcgaccccggctaccaagtacaatggccacaacaacaaccattcccccagccccaacaaccattctgccagcaaccacaacaaactattccccaaccccatcaaacgttccaccatcaaccacagcaaacatacccccattaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccatagtgtcgtgcattccatcatcatgcagcaa

SEQ ID NO: 72861 - DNA, 606 bp, Triticum aestivum
  Clone ID: PAT_TA_72861
ctaaaaggggcttgtgctgaatttagaaaacgaacacctcatggtcaatggcatctttctgctcttggcttgccatttgcatcccgtgccggtcgatgtcaatagctatgggaaagacttgcagaccagcgagagaggagaggcgaattggagaggaaccagcaggtgggcgtgtcggtgggagagaggagaggcagagatggtagaggaaccagcggggacgtgccgatgggagagagaagaggcagatggtaaaaaacctgcagggggtgtgccagtgtgcttactccggtggccggccggctacctgcgatctgcatcttgcgacggtggcggcggcggctgtgtgttgcggatgtgtgtgtgtggctgggtcataagggttagtccctactggaacctactggttttgcgagccagaaggttaccctattggtaacaaacccacgtgcatctcaccagggccaatgggccgaaccagaccacgtgaatcttgaaaggcagcaccgatgccatcttcctctccggctcacacgagctccagcaaactcccaagaaaccgaagtccgagctagttacatgtatttaattggacatttgatctgt

SEQ ID NO: 72862 - DNA, 491 bp, Triticum aestivum
  Clone ID: PAT_TA_72862
caagcttcttcgcaacggccaagacaaggtcagcagccatgacggggacaacaggggtactacccaacttctccgcaacagccagtacaatggcaacaaccggaacaagggcaaccaaggtactacccaacttctccgcagcagtcaggacaattgcaacaaccagcacaagggcagcaaccaggacaagggcaacaaggtcatcagccaggacaagggcaaccagggtactacccatcttcttcgcagctgcagtcaggacaattgcaacaaccagtacaagggcaacaagggcagcaaccacgacatagggcatcaaggtcaacagccatgacaagggcaacaaccatgacaaggacaacaaggtcaacagccaggacaagggcaacaaccatgacaagggcaacaaggtcagcagctcggacaaggacaacaagggtactacccaacttctctgcaacagtcgggacaagggcaaccagggtactacc

SEQ ID NO: 72863 - DNA, 715 bp, Triticum aestivum
  Clone ID: PAT_TA_72863
catccttcacacaactcgagcacaatcatccaccatgaagaccttactcatcctgacaatcattgcggtggcactaactaccaccaccgccaatatacaggtcgaccctagtggccaagtacaatggccacaacaacaacaaccattctcccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaacaatttccccagccccaacaaccacaacaaccatttccccagcaaccacaacaacaatttccccggccccaacaaccacaacaaccatttccccagccccaacaaccccaactaccatttccgcaacaaccacaacaaccattcccccagcctcaacaaccccaacaaccattttcccagttacagcaaccacaacaacctttaccccagccccaacaatcgcaacaaccattctcccagcaacaacaatcattgattcagccatacctacaacaacagatgaacccctgcaagaattacctcttgcagcaatgcaaccctgtgtcattggtgtcatccctcgtgtcaatgatcttgccacgaagtgattgccaggtgatgcggcaacaatgttgccaacaactagca

SEQ ID NO: 72864 - DNA, 698 bp, Triticum aestivum
  Clone ID: PAT_TA_72864
acaagcagagaatcaaagtacgtagtagttaaggcaaatccaccatgaagaccttactcattctgacaatccttgcgatggcaataaccatcggcaccggcaatatccaggtcgaccctagcggccaagtacaatggctacaacaacaactagtcccccagctccaacagccattatcccagcaaccacaacaaacatttacccaacctaaacaaacattccccatcaaccacaacatcaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaacctttttcccagccccaacaacaattgtcgtagccgcaacaaccgcagcaatcattcccccaacaacaacggccattcattcaaccatctctacaacaacagttgaacccatgcaagaatatcctcttgcaacaatgcaaacctgcgtcattggtgtcatccctctggtcaataatctggacacaaagcgattgccaagtgatgcggcaacaatgct

SEQ ID NO: 72865 - DNA, 725 bp, Triticum aestivum
  Clone ID: PAT_TA_72865
cataactagagcacaacaatcaaatccaagtaagtaatacctggcgcaaatccaccatgaagaccttactcatcggaccaatccttgcgagggcaacaaccatcgccaccgccaatatgcaagtcgaccccggctaccaagtacaatggccacaacaacaaccattcccccagccccaacaaccatgctgccagcaaccacaacaaactattccccaaccccatcaaacgttccaccatcaaccacagcaaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagacatccatagtgtcgtgcattccatcatcatg

SEQ ID NO: 72866 - DNA, 662 bp, Triticum aestivum
  Clone ID: PAT_TA_72866
atttattccaagcaagctgtggtcaatacaaatccaccgtgaatacctttctcatccttgccctccttgctatcgtggcgaccaccgacacaactgcagttagagtttcagtgccacaattgcagccacaaaatccatctcagcaacagccacaagagcaagttccattggtacaacaacaacaatttctagggcagcaacaaccatttccaccacaacaaccatatccacagctgcaaccatttccatcacaacaaccatatctgcagctgcaaccatttccgcagccgcaactaccatattcacagccacaaccatttcgaccacaacaaccatatccacaaccgcaaccacagtattcgcaaccacaacaaccaatttcacagcagcagcagcagcagcagcaacaacaacaacaacaacaacaacaacaacaacaacaacaaatccttcaacaaattttgcaacaacaactgattccatgcatggatgttgtattgcagcaacacaacatagtgcatggaagatcacaagttttgcaacaaagtacttaccagctgctgcgagaattgtgttgtcagcacctatggcagatccctgagcagtcgcagtgccaggccatccacaatgttgttcatgctattattctgcatcaacaacaa

SEQ ID NO: 72867 - DNA, 678 bp, Triticum aestivum
  Clone ID: PAT_TA_72867
gcaacagttttgacaagggcaacaactgggacaagggcaaggggggtactacccaacttcgcagcagtcggaacaagggcatcagccaggacaaggaaaacaaccaggacaaggacaacaagggtactacccaacttctccgcaacagtcaggacaatggcaacaactgggacaagggcaaccagggtactacccaacttctccacagcagtcaggacaaggacaacaatcaggacagggacaacaagggtactacccaacttctccgcaacagtcatgacaagggcaacaaccgggacaagggcaatcggggtacttcccaacttctcggcagcagtcaggacaagggcagcagccaggacaaggacaacagtcgggacaagggcaacaaggtcagcaaccaggacaaggacaacaagcgttctacccaacttcttcgcaacagtcaagacaaaggcaacaggcaggacaatggcaacaaccgggacaagggcaaccatggtactacccaacctctccacagcagccaggacaagagcaacaatcaggacaagcgcaacaatcaagacaatggcaactagtgtactacccaacttctccgcaacagccaggccaattgcaacaaccagcacaagggcaacaaccagcacaagggcaacaatcaacacaagagcaaca

SEQ ID NO: 72868 - DNA, 699 bp, Triticum aestivum
  Clone ID: PAT_TA_72868
tcgcaaccacaacaaccaatttcacagcagcagcagcagcagcaacaacaacaacaacaacaacaacaagaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccagttctccttccaacagcctctgcaacaatatccgttaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaaataatgtgacatgcactatcatgtaagaacccgaactatactagttcaaacttgggaataaaagacaaacactggtcttg

SEQ ID NO: 72869 - DNA, 753 bp, Triticum aestivum
  Clone ID: PAT_TA_72869
aagtagagcgcatcatttaagccaagcaagcgggggtcaataaaaatccaccatgaagacctttctcatcctagccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggc

SEQ ID NO: 72870 - DNA, 690 bp, Triticum aestivum
  Clone ID: PAT_TA_72870
caatacaccatgaataccttgctcgtatttgccctcctcggcgctgcggcgacgggtgcaatcgcgcatatggagactatatgcatccttggtttggagagaccatggcagcacctaccattaccaccacatcagacatttgcacaacaaccactattttcacaacaacaacacctatttcctcaacaaccatcattttcgcagcaacacccaccgttgtggcatcaacaaccaccattttctcagcaacaaccaattctaccacagcaaccaccattttcgcagcaacaacaactagttctaccgcaacatccaccattttcacagcaacaacaaccagttttacctccacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttg

SEQ ID NO: 72871 - DNA, 519 bp, Triticum aestivum
  Clone ID: PAT_TA_72871
cccaagggcagatccttataccctggagagacaacaccactgtagctactccaacaaggaatattttggggaacatattcacaaacagtacaagggtattacccacgcgtaacttctactcggaaggggtcatattatccacgccaagcttctacacaacagccaggacaagggcaacagcctggcaaatggcaagaaccaggacaagggcaacaatggtactacccaacttctttgcactacccaggacaagggcaacagataggaaaagggcatcaagggtactacccaacttctctgcagcatccacgacaaggacaacaagggtactacccatcttctctgcaacacacaggacaaaggcaacaaccactacaagggcaacaaccaaaacaagggcaacaaccaggactatggcaacaagggtactatccaacttctgcacagcagctaagacaaggtcaacaaccaatacaatggcaacaatcaggacaagggcaacaagggcactacccaact

SEQ ID NO: 72872 - DNA, 379 bp, Triticum aestivum
  Clone ID: PAT_TA_72872
cgggtctccatccctgggctagggttccatacgccgccgcctgggggcagaccacacacgctgacgtggaggtccgagaggatcaggccgccgctccgtcttccgcctccaccatcttccgcctccaccgacctccgaggcgccctacccgtgggacggcgccgccgccgccttgcggaaccccagggcagggcagggcgtggtcgcgttgcgtgcgggcagcgaggagcggcgcaccggcgcgtgcgtagccagttagcgagagaggaagggaggaagggagtggcgattgtcctgatgccccagctccgattgtcctgcctggctgcctgctgaatcccacagaagatccatccacaggcagtactgttgccacagc

SEQ ID NO: 72873 - DNA, 295 bp, Triticum aestivum
  Clone ID: PAT_TA_72873
tgcatattctggatattgaatttgctgtgacctcttaaggtgtcaagatggagttgattgatcccccatttccacttctcaagggagttgttgcaacaactgatgttgttgaggcctgcactggtgtgaatgttgcggttatggttggtggattccccaggaaggaaggaatggaaaggaatgatgttatgacgaaaaatgtttcaatctacacagctcaagcatctgctcttgaagctcatgcagcccccaattgcaaggttctggttgttgccaacccagcaaacaccaatgc

SEQ ID NO: 72874 - DNA, 657 bp, Triticum aestivum
  Clone ID: PAT_TA_72874
ctgcaagtcaggctgcctgcatgaggcactgacggtgttctcggagatgtctcagaaaggggtcgcgccagatgttgtgacgttcacgtcgcttatccacgcgatgtgcagtgctgggaacttggagcgggcagttgccctggtagggcagatgaaggagaggggcctccggatgaatgagatcgctttcacagcactgatagacgggttctgcaagaacgggttcttggatgacgcattgctcgcactgaaggagatgagggagtgcaggatcaagccttcggtagtgtgctacaatgcgcttatcaatggttactgcaagttaggaagaatggaagaagcggggcagttagtcgatgaaatggaggctaaaggagtgaagcctgacgtcgttacatatagtacaattctcagtgggtactgtaagattggtgatacagattctgcatttgaattgaaccggaaaatggtgaaaaaaggtgtggttccagatgcaatcacctactcatcgctcataaggggtctttgcgaggagaaaaaacttggtgatgcatgtgaactctttgagaagatgcttcaactcggcctacagcctgatgaatttacttatacaacgctgattgatggccattgcaaggagggggatgttgacaaagc

SEQ ID NO: 72875 - DNA, 338 bp, Triticum aestivum
  unsure (1)..(338): unsure at all n locations
  Clone ID: PAT_TA_72875
acctcctctcttatcccgattcacccctcgtctccctcccatcccacgctaccgccgcccaccaccccggcgacctccccactggcgatccccggcctctccctctccttctcccctgcatcttcctccgaggcgcggcaaggggaggccgccgtcntcnccgccgccgcgcgcgatccgggagggcaagaggggaggcggacgcgggcgaggagatggcatcggaggacgtggcggggaagagcaggggcggcacggccatcaacaccatcgncaacctggctgaggaggccaagctcgcgcgcgagggcgtcaagggccccggccaccaggtcctc

SEQ ID NO: 72876 - DNA, 738 bp, Triticum aestivum
  Clone ID: PAT_TA_72876
gcaaccatttccatcacaacaaccatatctgcagctgcaaccagttccgcagccgcaactaccatatccgcagccgcaactaccatatccgcagccgcaaccatttcgaccacaacaaccatatccacaaccgcaaccacagtattcgcaaccacaacaaccaatttcgcagcagcagcagcagcagcaacaacaacaacaacaaaaacaacaacaacaacaacaacaacagatccttcaacaaattttgcaacaacaactgattccatgcagggatgttgtattgcaacaacacagcatagcgtatggaagctcacaagttttgcaacaaagtacttaccagctggtgcaacaattgtgttgtcagcagctgtggcagatccccgagcagtcgcggtgccaagccatccacaatgttgttcatgctattattctgcatcaacagcaacaacaacaacaacaacaacaacaaccgttgagccaggtctccttccaacagcctcaacaacaataaccatcaggccagggctccttccagccatctcagcaaaacccacaggcccagggctctgtccagcctcaacaactgccccagtttgaggaaataaggaacctagcgctagagacgctacctgcaatgtgcaatgtctatatccctccatattgcaccattgctccagttggcatcttcggtactaactgagaagagaagaactctagtagtagatatatgataca

SEQ ID NO: 72877 - DNA, 207 bp, Triticum aestivum
  Clone ID: PAT_TA_72877
cctggatccggcgaggcccgaggcatccgcagccacctggactcccggcgacgggtccgatccggaaaccgccctggcgtgctccccggcaacggatccgggtcggcaaccacccccctgcgtggccacgaccaacctccgccgcaggatccgtccgtcgacaggacccccaacgcaagccactcccctgacgccccgatccaagcg

SEQ ID NO: 72878 - DNA, 330 bp, Triticum aestivum
  Clone ID: PAT_TA_72878
gatggatgtacgggatggtggtgcgccacagctcgtggctcgggggaggactgctggtgctccgaatctgccaggcgcctactctacagaagctggcgtccctggaatacaagcgggcggccttcctacaggacatcctacgtatctgttctgttggctggaaactggtgtggccagtgatatttctacccttataacggtaagaactcgttctattttataatcatggtaagtgaccgctcggaaatcttggcaataagcaaattcgctgcttccggattgctcgtcggcgtacttaaattttcaaagccgattcttgaaagctaatat

SEQ ID NO: 72879 - DNA, 681 bp, Triticum aestivum
  Clone ID: PAT_TA_72879
ggaactgcagcttcgagggcaaggtgcgggcggcgcagcgggccggcttcgacgccgcgctcgtccacgacgacgaggacaaggccagcctctactccatggttggtgatcctgagggcatacacatacctgcggtattcgtatctaaaatggctggggaaactttaaagaagtttgctagaggtgaagatggtgagtgctgcataaactcgtcgatggatgagactgcagggacagtgttggtgatgtccttcgtatcacttgttgtcatcatatcagttgtagcttcatttctttttgcccggaactgccgacttttacgccatggagttgataatcgcccaccttacatcaaaaaacatgtggtggaaaagcttccttctgtggtatataaagctccctgctcaagtggcaacaattgtgaagaagcctgtgccatttgtttagaagactatgataatggtgacatgcttagacttctcccatgcaaacatgaatttcatgtggagtgcattgatccctggctgacaaagtggggcacattttgcccagtatgcaaactggaggtactcacaggtgaataagcaggcaagctaggagtaaatctcaggtgaataagcaagcctccgttactgcatatatacaagtagtgctcggcggcggttatatccaagtgtgctg

SEQ ID NO: 72880 - DNA, 267 bp, Triticum aestivum
  Clone ID: PAT_TA_72880
cttatatcggtgtgagtcacaacagagcgagagaaacaaaaaggagatggagatggccatcgacacgccatcgccgtcgccgtccgtctcgccggcgccgtcggcggtcatggaacggcagaaacttcctctccccgtccccacggagaagctctacatggatccaaatcgggatggggggaatcgaggtggtgtggtgctggtggacagcggcagctataatcccaccacctacatgctcctgtacatgttctagcttgcaaagga

SEQ ID NO: 72881 - DNA, 503 bp, Triticum aestivum
  Clone ID: PAT_TA_72881
cattaatacagcgcatcattgaacccaaccaagctgtggtgaatacatatccaccatgaaaacttttctcttccttgccctccttgctatcgtggggaccaccgccacaactgcagttatagttccagtgccacaattgcaaccacaaaatccatctgagcatcagccacatgagcaagctacattggtacagcaacaacaatttctagggcagaaacaaccattttcaccacaacaaccatatccactgccgcaaccattttcatcacatcaaccatatctgcaactgcaaccatttatgcacccgcaactaccattttcacagacacaaccattttgaccacaacaaccatatgcacaaccgcaaccacagtattcgcaaccacaacaaccaatttcacagccgccgccgccgccgccgccaccaccacaaccaccaccaccaccaccacaaccaatcattcaacatattttgcaacaacaactgattccatgcgtggatg

SEQ ID NO: 72882 - DNA, 667 bp, Triticum aestivum
  Clone ID: PAT_TA_72882
cttcattggaagttcgtaagcaaaagtttggtgctgcttcattggatttcaatgaggtcatgatatagtgccagactactagctttagtactacttatttcatgaatgcttctacatatttctaggatgtgcatttctacgtcggattgctgtattttttctcaaaccctgttggacctgtatcatttgtgttgtatgtcatggatccaaaaccagcattttggacatccattggacaatattgtatactccgacttcaattccatgagagtactgaacttggcattgagagtcatcccatagaactgaagttagcatttatctccgaaaccagaacatatagctcactactgaagtagctaccaaaattttgcaaggcgttggaccttttcacatgagaacatatagctcactactgaagtagctacccaaatcgtttcttctttatcggtgtacggtttggccaattccggcgagacgtggctcgagcggatgtcgttgatgcgacaatgagaagatcctctctttgagccctctccctctcgttttgcctctcatgcttcctgcttctttgttctcaagggaggttcactggttcttttgcaggcttgtgttattatctgtctcgtttaaatgtccaaaggtgcatgggaatttctatggaatg

SEQ ID NO: 72883 - DNA, 671 bp, Triticum aestivum
  Clone ID: PAT_TA_72883
caaacatgtggcccaacctcaacaaacattcccccatcaaccagaacgacaggtgccccagcctcagcaaccacaacaaccatttctccagccccaacaaccattcccccaacaaccacaacaaccattcccccagactcaacaaccacacagccatttccccagcaaccacaacaaccatttccccagactcaacaaccgcaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcagcagcagcaacaacaacaacaacaaggcatgcatatctttctgccactatctcagcagcaacaggtgggtcaaggttctctagt

SEQ ID NO: 72884 - DNA, 661 bp, Triticum aestivum
  Clone ID: PAT_TA_72884
ggcagcaaccagcacaagggcaacaaggtcagcagccaggacaagggcaacaaggtcagcagccaggacaagggcaacaaggtcagcagccaggacaagggcagcaaccgggacaagggcagccatggtactacccaacttctccgcaggagtcaggacaagggcaacagccaggacaatggcaacaaccaggacaagggcaaccagggtactacctaacttctccgttgcagctaggacaagggcaacaagggtactacccaacttctctgcaacaaccaggacaagggcagcaaccaggacaatggcaacaatcgggacaagggcaacattggtactacccaacttctccgcagctgtcaggacaagggcaacggccaggacaatggctgcaaccaggacaagggcaacaagggtactacccaacttctccgcaacagccaggacaagggcaacaactaggacaatggctgcaaccaggacaagggcaacaagggtactacccaacttctctgcaacagacaggacaagggcagcaatcaggacaagggcaacaaggctactacagctcataccatgttagcgtggagcaccaggcggccagcctaaaggtggcaaaggcgcagcagctcgcggcacagctgccggcaatgtgccggct

SEQ ID NO: 72885 - DNA, 390 bp, Triticum aestivum
  Clone ID: PAT_TA_72885
tagagaaaggaatacaagagaagatctctaaagggaaccggcctgctcttagtgcacttagtgaactcctcagttctacaaagggtttctacacaggaattgaggagttgcatttgttggaagaaattatcaagaagggttgtgactttaagtcctctttggtgcaaattttgcatgacgtggattcttgcaacgggaatgatcttagtgtgatgtgcaaacctcttctggttgctctaaaggcaacatcagctgctggcttatatgatcagcagatcaaccgtaacattgagttggtattgaacagatatatatggaagaaacgaattcataaaatcttgtacggtggaaaaaaggcatcgatccaacacgtgatacgccttgataaag

SEQ ID NO: 72886 - DNA, 284 bp, Triticum aestivum
  Clone ID: PAT_TA_72886
tttttcttggaaggaaacttatttttgggcctgatgtgaaggcacttataaccaccagatggttaattggcattccaatgatcatttttgctggcggtgtttcttcaccacttggcccatgggtaccaaaatcaaattggaggttgggtggcatctgtatctatcatctttacagcatatattctcgttcttctgcttctcacgtctggacgtgatcctggaattgttccgcgtaattctcatcctccggaaccagaagacattggtgaatcctccaacttatc

SEQ ID NO: 72887 - DNA, 623 bp, Triticum aestivum
  Clone ID: PAT_TA_72887
taaaaatccaccatgaagacctttctcatcctatccctacttgctatcgtggcgaccaccgtcacaagtgcagttagagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaaatccttcaacaaattctgcaacaacaactgattccatgcagggatgttgtcttgcaacaacacaacatagcgcatgcatgctcacatgtattgcaacatagtatttaccaacaggtgcaacaattatgttgtcagcagctgtctcagatccccgagcagtcgcggtgccaagccatccacaatgtcgttcatgctattactctgcatcatcatcaacaacaacaacaacaaccgtcgagcca

SEQ ID NO: 72888 - DNA, 709 bp, Triticum aestivum
  Clone ID: PAT_TA_72888
ctcctctcttccccgccccctcccacgaaaccctagccgccgcgcgtgcagcaaccgccgcgctaccagcccctccacggcttgacgccacagcgcactcctccttccacctcctggccggcgcccaacctctacagctctccttccctccccgcgcccgaaaccctagctctgcaggaggtgcagcagagaggtcccagcgaccacgacggcgcatccatggcaagtccacctcgcggccaggcggagcgacgagtggaggtcaagtggagagcgccttcgccaccggctggcgcatcgacgggaggaggccaggactgggcgacttcgactccggctcctctccgccgtcgcttctccacccaacgcatgctcctcgctggtgtgcagatccacgcccgcgccgactcgacgatggcctgtggtttcgcgggtgtcgtcgcgccacaccactcccggacctgctctaattgtacatatatcatgaacttatgattctactttgtttctgcacatgtctcacctactgtatttttattggtcttgcgaatctgtctaagattgttatgttcttacaggcatttgcagcaatgcagaaacttagccaatcggcaatcgttgtacaaagacagatgtggttcattgagccaattcaacatggaggggctttgtgcagcttggtctcaacatatgcagtcaaagcatcatc

SEQ ID NO: 72889 - DNA, 656 bp, Triticum aestivum
  Clone ID: PAT_TA_72889
ggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaac

SEQ ID NO: 72890 - DNA, 487 bp, Triticum aestivum
  Clone ID: PAT_TA_72890
gtgaatcagtttatatgctgagcattggccatggggattttccttgtgatggtcttactggagaagaatcatctctggcgagcacaaaaacaatagaccatgttgacttactaagagagcaattaaagattttatcaggggaggttgcacttcatacaagtgttctaaagcgcctcaccgaggaagctggaagaaacccgaatagtgagaaaattcagatgaaaatgaagaagatcagtgacgaaattaaggcaaagcagcagcagatatcatctttagaaaaacagatgcctcattccttgtcaaatagtcaagtgaaggttgacaagttagatctttcaccgtcttacggggaactacttgagcaacttaatgagaaatctttcgaacttgaggtgaaggtatcagataacagagtaatacaagagcagctacaggaaaagacaactgagtgcatggaattacaagaggcagttgcttgccttaa

SEQ ID NO: 72891 - DNA, 698 bp, Triticum aestivum
  Clone ID: PAT_TA_72891
ctagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgcggca

SEQ ID NO: 72892 - DNA, 265 bp, Triticum aestivum
  Clone ID: PAT_TA_72892
caaaaaataataattttttgaggggttcgtaataacaacaacaggtaaacaggccacatttccggccgtctctactcctccccggcggcgtgggcccgagatgcaggcgtggttctccggctccgggccctcgccctccttctcctcgtcggcggcgtcttcgcagccgccgccgtctttgctcgcggaatggaactcctacgccgccgaccgctccgtcgaggaggacgtcagcagcggatacgggatcgacatcctggccgac

SEQ ID NO: 72893 - DNA, 704 bp, Triticum aestivum
  Clone ID: PAT_TA_72893
gttcacacaactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgc

SEQ ID NO: 72894 - DNA, 694 bp, Triticum aestivum
  Clone ID: PAT_TA_72894
cagaaccaagtttcactagttaacaccaatccaccatgaagacgggtgctcgtctttgccctcctcgccgttgccgcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcatatcccccagcaatcccgctatgaggcaatccgtgctatcatctactccatcatcctgcaagaacaacaacaggttcagggttccatccaatctc

SEQ ID NO: 72895 - DNA, 658 bp, Triticum aestivum
  Clone ID: PAT_TA_72895
gtttatactcaacattcattgtctgagtttgagtagcatggtatactcaattatgttgtatttatgtatcgtccatcatgtttgtaatctactttgatagtatagcaataaactgcatgtatatcaatgtgtcttttgggcaggtctagttagtgtacatggaagatactttagacttttgttgttttactgcattgtattttggttaattcatatgaacatattcttatctgtaagttggagtagcagtttatactcaaatatgttgtatttatgaatcttgcgtaaggttttcagcctatccaggtctggttcagtaattcaaactattaattgggtagtatagcaatatatatcggaagtacataaatgtatcttttgcaccaggtactgtttgtgtgcacattttatagccgttttttgttttaactattactctgatatgttgtttgtcaatggtgatcattgtcttactaacatatcaaatgtttgcgattactgccttgcaggtcctatttgaggagcaagaatttatcaaacttgctgttaaacagggttttactgaggccgttcaagaaatggaacagcgcagtacttgccaaacgccccttcagaagggggtgtttgacactgctattgttggtcttaaaagggatct

SEQ ID NO: 72896 - DNA, 680 bp, Triticum aestivum
  Clone ID: PAT_TA_72896
ttaagccatgcaagctgcggtcaatacaaatccaccatgaggacatttctcatccttgccctccttgctatcgtggcgaccaccgccacaaatgcacttacagttccagcgccacaattgcaaccacaaaatccatctcagcaacagccacaaaagcaagttccattggtacaacaacaacaatttctagggctgcaacaaccatttccaccacaacatccatatccacagccgcaaccatttccataacaacaaccatatctgcagctgcaaccattttggcagccgcaactaccatattcacagccacaaccatttcgaccacaacaaccatatccacaaccgcaaccacagtattcacaaccacaacaaccaatttcacagcagcagcagcagcaacagcaacaacaacaacaacaacaacaacaacaacaagaacaacaaatccttcaacaaattttgcaacaacaactgattccatgcatggatgttgtattgcagcaacacaacatagcgcgtggaagatcacaagttttgcaacaaagtacttaccagctgttgcaagaattgtgttgtcagcacctatggcagatccatgagaagttgcagtgccaggccatccacaatgttgttcatgctattattctgcatcaacaacaaaaacaacaacaacaactatc

SEQ ID NO: 72897 - DNA, 628 bp, Triticum aestivum
  Clone ID: PAT_TA_72897
gcaggaacgacgacgatgatgccggcgcatccgggctcttcggcgaccttcccgtgctggaggccgacactgccggcttctcctggaatctctgttgctgctcaaggtgttgcatctcctccgcggtctccctcctcggctgctgcgcctcctccgcggctgggcgccagggcagttgggaatcaaacgaagaggtcaaggggaaccacaacggtgagacgcgacgctaaggagtaagacggccggatctggagcttaaggcccttcaccgcgcttgtgttcgtcagattgcaagtaagccctgtagttgtacagaggagaggaagaggcagtcactgagggcgtgctacgtctacgggctcatcttcttcgccatcaacccgcacagagtggagtgaaattgaggtctgggactaccacgatttatactgagccaatgatctactgttgtcaccgttgaggatctgctgctgttgcttctgttgagggccaatgatctgctactgttgatgttgaggatctgttgctgttgcttctgttgagggccaatgatttgctactgtggatgttgaggatctgctgctgttgcttctattgagggccaatggtctgctgttgaggatctgct

SEQ ID NO: 72898 - DNA, 675 bp, Triticum aestivum
  Clone ID: PAT_TA_72898
atttaacccaaccaagctgtggtcaatacaaattacaccatgagcacctttatgatcctcgccctccttgctatcgtggcgaccaccgccacaactgcagttagagttccagtgccacaattgcagccacaaaatccatctcagcgacagccacaacagcaagttccattggtacaacaacaacaatttctagggcagcaacaaccatttccaccacaacaaccatatccacagccgcaaccatttccatcacaacaaccatatctgcaactgcaaccatttccgcagccgcaactaccatattcgcaaccacaaccatttcgaccacaacaaccatatccacaaccgcaaccacagtattcgcaaccacaacaaccaatttcacagcagcagcagcagcagcaacaacaacaacaacaacaacaacaagaacaacaaatccttcaacaaattttgcaacaacaactgattccatgcatggatgttgtattgcaacaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaaaaacaacaacaacaaccatcg

SEQ ID NO: 72899 - DNA, 616 bp, Triticum aestivum
  Clone ID: PAT_TA_72899
gtgtccgccatcatgtaattttaggaccaaattcacagaaaggggtcgcctctatggaattgttgaacaacctgtcaatccaacggattcagttgcacaatattcgatttgatggttgacaatatgcacagcatcttgggagcctccatcatgttctggataaagcagctgacgaaatagtatgctgatcccgtcccttgttgacgatgaatttgccttgagcactgcagttttgtcaatttggtagagcttgctgtcctctaggttttatgtacagagttcttaaaaatgaagcagctgcagaaaagggacatcctgaggagaggtacaccaacgccttccttgggcacggaccagaggactcacattttgtgtagagctcacttactaagtgacgatattggatctggttttggtcatttcggaattgctgttgaggatgggcgacatagctaaaatttgacgtgagaagtgcagccacaacaatgggcagccgaataaaaaatatagggagacacaaggagaatataactggtcatacttcaacaatgaccacactacttatgatggttcaagagaagatatccgtgatactgagcctggtgatgagggcatc

SEQ ID NO: 72900 - DNA, 641 bp, Triticum aestivum
  Clone ID: PAT_TA_72900
caaaccacagctgcggcggcgcgcgcataggaggcgaagcaggagcggatccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgtggaggtaacgtgaagtggagggctctccgtctggacactggtaacttctcatggggtagtgaggcggtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgctggcctgcatttcgtctcg

SEQ ID NO: 72901 - DNA, 631 bp, Triticum aestivum
  Clone ID: PAT_TA_72901
ggcagatgatcttattttctccattgtccaatattgaagcttgggttgcccatcagcatacagccatacacctcatccaggttcatttcctatatactggttagatactacttcatagttgctctaggtgtactttgattagcgtcatctacttgtcccatcatcgacaaggctatatgattgcgagagattaataacttttgtgatacgcgttcatttatgaactaaatcatcagcttgctcaataatacttttggggtactcgtgtggtgtttatggctgatgaaatacgctttgtttaataggactggagacatttctgatgcttaggtcaaaacaccggacctattcttatttgtttgtaaactcagtccagtaatacaagttagcattttgtcttaattgttcttggaattaaaaaggaaaccttcttgttgttcgttctacaccactaatctgtttagccatccttgagaaaggctcgacggttggacgtgaaaactatatttgttctccttttgcttctctggtttagttttaaatttaatctgggttggctgtttgcaattgaaaaaatgtttgtttcatggcttcctgtaaatgttgttaggcactgtagaagcagaaattt

SEQ ID NO: 72902 - DNA, 458 bp, Triticum aestivum
  Clone ID: PAT_TA_72902
gtagagtgcatcattcacgccaagcaagcagtggtcaatacgaatgcaacatgaagacctctctcatccttgccctccttgctatcgtggcgaccaccaccacaactgcacttagagttccagtgccacaattgcagccacaaaatccatctcagcaacaaccacaagagcttgttccattggtgcaacaacaacaatttctagggcagcaacaactacaatttccagggcaacaacaaccatttccaccacaacagccatatccgcagccgcaaccatttctgccacagctaccatatccgcagccgcaaccatttgcaccacaacaatcatatccacaaccacaaccacaatatccgaaaccacaacaagcaatttcgcagccacaagcacaactacaacaacaacaacaacagcaacaacaacaacaacaacgacatctacgaccacaacaacga

SEQ ID NO: 72903 - DNA, 445 bp, Triticum aestivum
  Clone ID: PAT_TA_72903
gctcggcgcccgaggacggcagcggcgaggctctcggtgtgcatggcgttctgggcggcaccctggccggggctcgtgctcatggtcatcctctctgcccccctccgcccggttccctccatcgacccctggctactctatcctcgctgctgcagatctggcgcctcggcggccggaggtggtcctggtggatctagccgtgaggggcgccatcccctgctgtggactgcaaccttgctgccgtgggtgctcgaatcctctccggacccttgtccagatctagaggggctggatttggagcccacctgagagcttctcgatcgcagcccggcaggtggccggccggccgtccgggctgggggctatagtgcggtgcgtagtggtggctctgcgtcaggctccggcatggcgggcggtgcatgtgccccatgccggctattagcct

SEQ ID NO: 72904 - DNA, 715 bp, Triticum aestivum
  Clone ID: PAT_TA_72904
aatcaaaaattaaattctaaaaacctacataggacatacccctaagcacatatagcatctctgttatctcttctggtattaactcgtgagtacattcaatttactcactctcctgctacgttgcagagagcgttgcgtggaaaggaataataggttagggtcaacagtcttcacccaacttagctggaggatttgtgttgaacttattttataatgtgctgttggaaaatagccatgaaagcagagaaaagttggttagataatcacagctttcatgagatctgttattgtcctgatgttcagagtttactttacctggcttgagcaataactatcagcatcggctagaattgttgcaaggcatagcttggcaaaattgttactagttgtatatgaaattgcaggggtttgatatcccacccaaagctacaaattactcatgagtcataattgttctaatcaggcagttgtttaaatttgcgttaacatcaccaatgactgactgtttgggcaaacattgatacttggttatttgtttgagctttgaattatcaagcaatccagctgtttgaagaaacttgggtgtgcattacttctatttcatttaaacttggcttcaactttcattttgttaaatataggaacatgttttcgtagctagaatgataagcatctggtgctgtatcatattaatggtgctagacactgaactgta

SEQ ID NO: 72905 - DNA, 662 bp, Triticum aestivum
  Clone ID: PAT_TA_72905
tcctttggacagctccggatgctaacttacctaagcctgtctcacaactcatttcaaaattctattccatacagttttcgtaatttaattagcttaggaacactagacctatcttccaacaacttctcgggtaccatcccaaagtacttgacaaacttaacctacctcacaagcctgaacctgtccttcaatgagttacaaggttcgataccagatgaaggtgttttcagaaacatcaccttgcaatctctgataggaaacttcggtctgtgcggtgctccctgtttagggtttttgccatgccttggtaactctcaccctgttaataatggacatttgctaaaattcctactaccttcttttgctttaacattggcggctatggctatgtgcctatacctgctgataagaaggaacaatctgaagcagggagaggtaacacctgctgctgatggagttgatccagtcagccataggttagtgtcctaccacgaggttgctcgtgccactgaaaatttcaacgaggacaacctacttggagttggaagtttcggaaaagttttcaagggccaactggacgatggtttggtggtggcgataaaagtgctcaacatgcaattcgagcaggccgtgaggagctttgatgctgaatgtcaagtgtt

SEQ ID NO: 72906 - DNA, 706 bp, Triticum aestivum
  Clone ID: PAT_TA_72906
cataagcttaagcacatcatttaagccaagcaagatgtggtcaatacaaatccaccatgaagacctttctcatcctttccctccttgctatcgtggagaccaccgccacaactgcagttagagttctagtgccacaattgcagccacaaaatccatctcagcaacagccacaagagcaagttccattggtacaacaacaaaaatttctagggtagcaacaacaatttccaccacaacaacaagatccacagccgcaaccatttccatcacaacaaccatatctgcagctgcaaccatttccgcagccgcaactaccatattcgcagccgcaaccatttcgaccacaacaaccatatccacaaccgcaaccacagtattcgcaaccacaacaaccaatttcgcagcaacaataacaacaacaacaacaacaacaacaacaacaacaaatccttcaacaaattatgcaacaacaactgattccatgcatggatgttgtattgcagcaacacaatatagcgcatggaagatcacaagttttgcaacaaagtacttaccagctgttgcaagaattgtgttgtcagcacctatgtcagatccctgagcagtcgcagtgccaagccatccacaatgttgtccatgctattattctgcatcaacaacaaaaacaacaacaccaaccatcgagcaaggtctccttccaacagcc

SEQ ID NO: 72907 - DNA, 637 bp, Triticum aestivum
  Clone ID: PAT_TA_72907
caagcaccatgaagacccgtcttggccagcaccagaagcgcgatgggcagtgaagaccagcagctgcatgaccacactcagccatctccggccatggcgacagactgcaacacagctgctcatccattggtgttgctgctctcctcttgtttgtcatcatgaacacaccgttggtgttgctgctctcctcttgtttgtcatcatgaacacaccgttggtgttgctgctctcctttggtttggctgccatcgggatgattctcacttaaacgctgaacgagatggtttccagctgtgcgcccagtcctgaactcgccatttgtgtcctcctgcagttccacaaggttcggccgtgaacgccaactgacaggactctaaactatgcccttcttatttctgcctgattcaccatggacaagtttcttactggttgagcgcatgaacactctacatagctgaggtgacgatgcagaccaaatcttcttcaagtacagacccataaactgcatcagcttggagtcgggcatgcatgaggtctccttttacttactccatactcgaaggtgcactactgcaggatgctgctaacgcgacactacgatcagagaccctttgacgaaactgtatgcgatgccata

SEQ ID NO: 72908 - DNA, 666 bp, Triticum aestivum
  Clone ID: PAT_TA_72908
gtacagcgcatcatttaagccaagcaagctgaggtcaatacgaatccaccatgaaaacctttctcatccttgccctccttgctatcgtggcgaccaccgacacaactgcagttagagttccagtgccacaattgcagccacaaaatccatctcaacaacagccacaagagcaagttccattggtacaacaacaacaatttctagggcagcaacaaccatttccaccacaacaaccatatccacagccgcaaccatttccatcacaacaaccatatctgcaactgcaaccatttctgcagccgcaactaccatattcacagccacaaccatttcgaccacaacaaccatatccacaaccgcaaccacagtattcgcaaccacaacaaccaatttcacagcagcagcagcagcagcagcaacaacaacaacaacaacaacaacaacaacaacaaatcattcaacaaattttgcaacaacaactgattccatgcatggatgttgtattgcagcaacacaacatagtgcatggaaaatcacaagttttgcaacaaagtacttaccagctgctgcaagaattgtgttgtcagcacctatggcagatccctgagcagtcgcagtgccaggccatccacaatgttgttcatgctattattctgcatcaacaac

SEQ ID NO: 72909 - DNA, 254 bp, Triticum aestivum
  Clone ID: PAT_TA_72909
cggccgtcaacgccaaccgccggcgcgagcttgcgacttcccctcctcccgctgcgtcggcctccacctccgtacctactccccgggtaccacctccctcctctctttggccgcggcgccgcctccgccatagtccctctccccggccgccgcttgcactggataagcagggtccggctcgtcggggcccaaatccggccggcggagcgccgttctggccggattgatccttttagctgacgccgggaggacca

SEQ ID NO: 72910 - DNA, 634 bp, Triticum aestivum
  Clone ID: PAT_TA_72910
gcgcatcatttaagccaagcaagctgtggtcaatacaaaggggccatgaagacctttctcatcctttccctccttgctatcggggagaccaccgccacaaatgcagttagagttccagtgccacaattgcagccacaaaatccatctcaccaacagccacaagagcaagttccattggtacaacaacaaaaatttctatggcagcaacaacaatttccaccacaacaaccagatccacagccgcaaccatttccatcacaacaaccatatctgcagttgcaaccatttccgcagccgcaactaccatattcgtagtcgcaaccatttcgaccacaacaaccatatccacgaccgcaaccacagtattcgcaaccacaacaaccaatttcgcagcaacaataacaacaacaacaaatccttctacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaagccatccacaatgttgcccatgctattattctacatcaacaataaaaac

SEQ ID NO: 72911 - DNA, 595 bp, Triticum aestivum
  Clone ID: PAT_TA_72911
gtagagtgcatcattcaagccaagcaagcagtggtcaatacggatccaccatgaagacctttctcatccttgccctccttgctatcgtggcgaccaccaccacaactgcagttagagttccagtgccacaattgcagccacaaaatccatctcagcaacaaccacaagagcaagttccattggtgcaacaacaacaatttctagggcagcaacaacaacaatttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaacaacaacaacaaccgtcgagccaggtctcctaccagcagcctcagcaacaatatccatcatgccagggcttcttccagccatctcagcaaaacccacaggcccagggctttgtccaacctcagcaactgccgcagttcgaggaaataaggaacctagcgctgcagacgctacc

SEQ ID NO: 72912 - DNA, 441 bp, Triticum aestivum
  Clone ID: PAT_TA_72912
cccgacgcgtcctgctccgcccccatcctccagtctctcctggcctgctcccgcgccgcggcggccaacccagccctcgccgccgcggaactcgccaaggtccgtgccgctgccaccgagtccggggaccccgcggagcgcgtggccttctacttctccgacgcgctcgctcggcgcctcccctgcggcggcgcggcgtccctcgagacggcgtccgacgcgcggctcgccttcgacgaggtcacgctctgctacaagacactcaacgacgcctgcccctactccaaattcgcgcacctcaccgccaaccaggccatcctggaggccacgggcgcggcgaccaagatccacatcgctgacttcggcatcgtgcagggcatccagtgggcggcgctcctacaggcgctggccacgcggcccgaggggaagccatctcggatt

SEQ ID NO: 72913 - DNA, 241 bp, Triticum aestivum
  Clone ID: PAT_TA_72913
cccttctcttcttccccacaccacacacggctgcggctgctggcatggagattgaggccacgcctgcgccagcagtataaaatacagagcggagcaggacctagaccagagagatcttttatacagtagcgcagtactttgtgaggaggggagagaatgatggaggtggcggtggagagcccgcagccggcggcgtgggaccacttcaaggaggaggtggaggtcatggaggcggagggct

SEQ ID NO: 72914 - DNA, 671 bp, Triticum aestivum
  Clone ID: PAT_TA_72914
cacaactagagcacaagcagaaaatcaaagtacgtaatagtgagcgcaaatccaccatgaagaccttactcattctgacaatacttgcgatggcaataaccattggcaccggctatatcaaggtccaccctagcggccaagtacaatggctacaacaacaactagtccctcaactacaacagacattataccaccaatcacaacaaacatttccccaacctaaaaaaacattcctacattaaccaaaagaacaggttacgcactctaagcaatcacaacaaccatttctccagccccaacaaccattcccccaacaaccacaacaaccattcccccagactcaacaaccacaacaaccatttgcccagcaaccacaacaaccatttccccagactcaacaaccccaacaaccatttgcccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgttattggtgtcatccctctggtcaataatc

SEQ ID NO: 72915 - DNA, 662 bp, Triticum aestivum
  Clone ID: PAT_TA_72915
ttaacattatcatgggatcctggacagcacgcaattgattcgggtgcaattttttgcgatcgaggtatccttgctatttgtcaccagcaactttcggtccctaatgcgatcaattcattgtccacttgttatggtattcctcagttcgagcatttgcaagatgtgttcactgtattactacaactatggcgtgcttggttccaattgttatcttcttctgaccagagactattgttctggaacggggtgatgtgcaggaactgtttccatccatcaatcatacgaatgactagctgccaggagttgggtcttaattcctcatatacatcccagcatctacagattgcatggtcattcgtttgggagttctctagtgttggatcaaggaggattgctgtcagcttcttattcgatccagcttatggtttggcagttgttgtatctagtacttggtgctgggttcttgcatattgtgttgccaatacagtatcacttgattattctcaatttgatgttgaatctgcactaggcatgtgtctgccaaccatagtacctccggcctctttccactccagtcttatgccactagctgatgcaaatttgaagtgtactcatgtcaagaaggccaacatgttccagttgctcaacaacaatgacaacat

SEQ ID NO: 72916 - DNA, 229 bp, Triticum aestivum
  Clone ID: PAT_TA_72916
cacaagctagcacacagcaagctcatagcacctcactggtctgggtgatccttctcaaggatcatttggatggccttcttcctcctcctcctgtgcatcctcatttctgcggccatcgtgtcctacgcccaccacgtaatccggcggcaacgccagggctgcgctcatggccgccatgagcaagccgccctcaagctgccccctggctccatgggcctgccttacatcg

SEQ ID NO: 72917 - DNA, 603 bp, Triticum aestivum
  Clone ID: PAT_TA_72917
cgcgggctggccgactcacggttctcatattgtctcttccgcgggacagagccaccccaacgccaggcacgggttcctccgcttcggccgcgacatcccgaggcacgaccacgcgcacagcacgccgctgctgttcactggatcgggctacagccaaagtagcatgtactacatccacgtcttcagcatcagcttgaacgggaaaaggcttaacggggtaaagacggcgatgtttaggcgggatccacaaacccgtcgcggggggttcgtcgtcgaccccgggactcccctgaccaggctggctcgcgcggcgtatgacgtcgtggaggccgaggtcgcggcaaacatgcacaagcagggggcgcgccgctcgacggtgccggtgcaggggtaccgcctctgctttggctcgtggggccacgcgcacctcccgagcttgaccgtgaccctgtacgaagacgcgaccaggctttttatcaagccggaactgttattcatgagggtgaaccatgagcacctgtgcttcgccgtcgtgccggacgaggagatgacggtgctcggcgcggcgcagcaggtggacacgcggttcacatttgacctccc

SEQ ID NO: 72918 - DNA, 611 bp, Triticum aestivum
  Clone ID: PAT_TA_72918
gcgatgatccgatattttgttgctggtatgccatggataacgctgatccttttcaatgcccttgtagtatcactcacgatgttcttctatataaaagctggctggattggcaatgatcccttaactgttgtgattggtccaagtgatccatatgtcagcataggtggacgggaaataaaccaccttcatgctgctgctgtattgatgacagtggtaatgatcattgctttcctgacttcaatagctattgttcggcgtatactgatagcgacatccacaaccgtcctaaaggtggctgcaaaggtcattggtgaagtccatgcactcatcatctttccggtcgtaccatacttcgcccttgctatcatctatatgttctggtttgcggcgacactgtatcttttcagctctggtcaagttctacaaaatgattgcaatgcagagtgctgctcatttgatctcaagctgggaaaagtaaattgtgacagctgttgcgggtacagtgtccattacacccctcatattggaattgcgattcttttccacctgtttggctgttactgggcaacacaattcttcatcgcatgctcttcgaccgtaattgctggatc

SEQ ID NO: 72919 - DNA, 538 bp, Triticum aestivum
  Clone ID: PAT_TA_72919
ctggaatgaagaacagcgaaagtgggaggatagcctgagggcaacgttgtgttccgtcggcggttccggaatcgttataatcgtcacgactcggagcccacgagcagcgtctataatgggcacgcttcaaacccatgagctggcacatctgagtgaacaacactcatgggaattgttctcaaagaaagcatttaagggaaatgtgcgagagcaggcagagttgatgtcgatcggcaagcgtatcgtcagcaaatgcaaggggcaccctcttgctctgagtgcaatggggggtttgatgtgttcaaaaggacgggcctgggaatgggaggccattgcagaaagcaatattggggatagtgttgcaggcaaacaagaaatcatatccatactcaaattgagctaccaacacttatcctctgaaatgaagcaatgctttgccttctgcgccgtcttctacaagaacagtgagatggaaaaaagcatgttgatccaactatggatggccaatgggtttattcaagaagagggaatgatggat

SEQ ID NO: 72920 - DNA, 646 bp, Triticum aestivum
  Clone ID: PAT_TA_72920
ctccgacgtcagtgccatgcccgcagccaaccacgaggggacagcctggcgggccccgccccgccccctgcgccggtggttcacaagcgcaagcccgggagaccccaggagaaaagcctgcccccagcggccaccagagaggagctggaatccagggagtccctggaaggacccttgaaggtgcttgcgctcccggcgccaggggcccggggtgcttatgttgtctcagatgacaagatggtgtgccgcgctcgcgcccccacacggcgtgcaagcgcggtatccaacgacaagatgatggacaggaacgagataacgccggtggttcgcaggcgcaagcccgggagaccccaggagaaaagcccgcccccagcggccatcagagaggagctggaatcccgggagtcccgggaaggccccttgaaggtgcttgcactcccggcgccaggggccccgcgtactcacgctgtctccggcgacaagatgatgagacgcgctcgcgcccccacccggcatgcaaacactgtctccgacgacaagatggtgagccgcgctcgcgcccccaccctgcatgcaaaccatgtctccgatgacaagatgatggacaagaacgagatggcgccgggtccaggggtgccgcgcatgc

SEQ ID NO: 72921 - DNA, 456 bp, Triticum aestivum
  Clone ID: PAT_TA_72921
accatttgttcatccatctatcttgcaccagctgaacgggggcaaggtattcctccagcatcaatgcagccctgtggcaatgccacaaagtcttgctaagtcgcaaatgttgcagcagagtaaatgccatgtgatgcaacaacaatgttgccaacagttgccgcaaatcccccagcaatcccgctatgaggcaatccgtgctatcatctactacatcgtcctgcaagaacaacaacaggttcggggttccatccaaactcagcagcagcaaccgcaacagttgggccaatgtgtttcccaaccccaacagcagtcacagcagcaactcgggcaacaacctcaacaacaacaattggcacagggtacctttttgcagccacaccagatagctcagcttgaggtgatgacttccattgcgctccgtaccctaccaatgatgtgccgtgtcaatgtgcc

SEQ ID NO: 72922 - DNA, 503 bp, Triticum aestivum
  Clone ID: PAT_TA_72922
taccttactcatcgtaacaatccttgagatggcaacaaccatctacaccgccaatatgcatgtagaccccatctaccaaatacaattgacacaacaacaaccattcaccatgtccaaacaaccattctgccatctaccacaacaaactattcatcaacaccatcaaacgttccaccatcaaccacagcatacatacccccatcaaccacaacaacaatttccctatacccaccaaccacaacatccatttacccagccccaacatatattcccccaacaaccccaactaccatttccccaacaaccccaacaaccattcccccatcctcaacaacctcaacaactatttccccagtcacagcaaccacaacaaccttttccccagccccaacatcaattactgcagcctcaacaaccgcaacaatcattcccccagcaacaacaaccgctgattcagctatctctacaacaacagatgaacccctgcaagaattttctcttgc

SEQ ID NO: 72923 - DNA, 466 bp, Triticum aestivum
  Clone ID: PAT_TA_72923
catcattcaagccaagcacgcagtggtcaatacaaatccgggatgaagaccttactcatccttgccctccttgctatcgtggcgaccaccaccacaactgcagttagagttccagtgccacaattgcagccacaaaatccatctcagcaacaaccacaagagcaagttccattggtgcagcaacaacaatttctagggcagcggcagcaacattcttcagggcaacaacaaccatttccaccacagcagccatatccgtagccgcaaccatttctgccacagctaccatatccgcagccgcaaccattttcaccacaacaatcatattcacaaccacaaccacaatatccgcaaccacaaccaccaatttcgcagccacaagcacaactaccacaacaacaacaacaacaacaacaacaaatccttcaacaaattctgcaacaacaactgattccatgcatggatg

SEQ ID NO: 72924 - DNA, 646 bp, Triticum aestivum
  Clone ID: PAT_TA_72924
cggttgacgatgagccggcggcttcatcggccaatgtcggcatcactatgggcaaggcccatgctcactacactgacatggttctggaggagcgggagttcggcaggcgctggctaaacaggcctacaatccttcaccggccaatgccgacatcaccatcggcaaggcccacgctacaccaacatggtgctggaggagtgggaggccgtgttccggcaggcgcaggtcgaacaggcctacaatcttcgcctcctcgacgagcaccggtgcacggatgagctacccgtccccggcgcggccatcatgccggacgtggacatgggtgagcaggaggctctgcttgactcctaccgcgccgcccgcgacatccgccgcgactactggctctaccgccaggcggatttaaaggccgcctacaaggggatcgacgaggtggcggatgaagtttacgggcccgatgacggcaatgaggtggctggcggctccgtggccgcggcatggcgcaacaacgacgaagcaggcatgttcgcgggcgccgtcgacagcgaggcagattagagcatgggagggagccgacgcttgtgtcccaggaaggccaccgctcttgtcctcctgctgaagctaagccttgtggctcatcctcatc

SEQ ID NO: 72925 - DNA, 636 bp, Triticum aestivum; identical to SEQ ID NO: 72858
  Clone ID: PAT_TA_72925

SEQ ID NO: 72926 - DNA, 707 bp, Triticum aestivum
  Clone ID: PAT_TA_72926
caacaaccacaacaaccatatccacaaccgcaaccacaggattcgcaaccacaacaaccaatttcacagcagcagcagcagcagcagcaacaacaacaacaacaacaacaacaacaacaacaaatcattcaacaaattttgcaacaacaactgattccatgcatggatgttgtattgcagcaacacaacatagtgcatggaaaatcacaagttttgcaacaaagtacttaccagctgctgcaagaattgtgttgtcagcacctatggcagatccctgagcagtcgcagtgccaggccatccacaatgttgttcatgctattattctgcatcaacaacaaaaacaacaacaacaaccatcgagccaggtctccttccaacagcctctgcaacaatatccattaggccagggctccttccggccatctcagcaaaacccacaggcccagggctctgtccagcctcaacaactgccccagttccaggaaataaggaacctagccctacagacgctacctgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtgacatgcactatcatgtaagaacccgaactatactag

SEQ ID NO: 72927 - DNA, 471 bp, Triticum aestivum
  Clone ID: PAT_TA_72927
gtcatgacaagggcaaccagtgtactacccaacttcttcggagcatccaacacaatcgtaacaaccatgataagggcaacaatgttagctggtaggacaagggcaacaagctcatgcagccaggacaagggcagcaaccgggacaagggcagccagggtactacccaacttctccgcagcagtcaggacaggggcaaccacggtactacctaacttctccgcagcaatcaggacaagggcagcagtcagcacaattgcaacaatcagcacaagggcaaaaatggacagcaaccaggacaatgtctacagccagggctagggcatcaaggtcagcagccattacaaggacaacaaggatatcaaccggcgcaagggcagtctgggtactacccaccttctatgtaacaatcacgacaagggcaacagccacgacaatggcaacaaccacgacaacggcaaccagtattctac

SEQ ID NO: 72928 - DNA, 238 bp, Triticum aestivum
  Clone ID: PAT_TA_72928
gcaccgttgatgatcataacagctcacgccgccggccctgggtgttgctgccccggcagtagcaacttctaataattattcttgcacgtggtgcatggactacatcgtatcccctgactaagaaacgcgctaatcctgcagtgcctctgcctgcctactacaggcttattgattttcttgtccatattagtgtgaacaaacgcatatcaatgatttatgtacttactcaatgcatcta

SEQ ID NO: 72929 - DNA, 667 bp, Triticum aestivum
  Clone ID: PAT_TA_72929
gcaacttgattcatcctcaagatacataagatccaaaagactaattgatttctttcggtataaattgttcctttgtcctgcttatttctactgtgttaaataatcataggcaatattatgctgctaaatgtagggtttcatgatcacttttgacctgtgttgtaggtagattacacctatttttgtcttgctttgtttttaagtaaaattgagcagggcgtgtgctctgttcaaacaataaacaaaatagagtatcctcatgctgtaaatatacctcagttttttttttcaatggacaaaacacatctcaggttagtgagcttccctgtacactacatctctattgaactatgtgcagttttcagcttgatgtctttgatttaatgtcatcattctaggactggaaaatttagcattagacatattgattcagtaatgcaattaatgcatcataaaaactaggaataatttggctgtgtcgtcctcgatatgttatgacacaaaaatgttgatcattttcacgattgtagacacatcatatgcttcatcatctcactggtctctagagcaaggtatgctcttaacaaaataaattttatcatattatgtattcataaattttctcacacaaatttattcagatataaaatcaactgtacactgaata

SEQ ID NO: 72930 - DNA, 495 bp, Triticum aestivum
  Clone ID: PAT_TA_72930
ccgcgccaccgggaaggaggagttcctccgctacaccgtgggcaaggccgactgcttcggcggcgtcggatgggccatgaccgagttcagctgggacgtcaagtacgccggactccaggtcctcgcctccaagctgctgctggacggcgatccgcagggcgagcggcaccgggtggtgctggagcagtacaaggccaaggcggaacactacctgtgcgcgtgcctgcgcctgaacaacggcagcaacgtggaccggagccccggcggcatgctgtacgtgcgccagtggaacaacctccagtacgcctccaacgccgccttcctcctcaccgtctactcgcactacctggccggcgccggcgcccgcctacgctgccccgacgcaccggcggtcccgccgtacgagctcctggccctgacgcgctcgcaagccgactacatcctgggccgcaacccgctgcggctgagctacatggtgggctacggcccgcgctt

SEQ ID NO: 72931 - DNA, 303 bp, Triticum aestivum
  Clone ID: PAT_TA_72931
catcaatcgagaccatacttaaaccaataccaggtgaggcggggacaggacgcgagggaaaaccttgatcatgcttgccctccttgctatcatggacaacagcggcgctgatcacgcgcaaatcccaaatcccttatgccacgagctccacgcatgcctccgctgccgcctagaccagacctactaccagttcaagcaacaatttctagggcaccaacaaccatttccaccacaacaaccatatccacagctgcaaccatttccatcacaacaaccatatttgaatctgcaaccatttgcaca

SEQ ID NO: 72932 - DNA, 691 bp, Triticum aestivum
  Clone ID: PAT_TA_72932
gtagagcgcatcatttaagccaagcaagcgggggtcaataggaatccaccatgaagacctttctcatcctagccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcc

SEQ ID NO: 72933 - DNA, 645 bp, Triticum aestivum
  Clone ID: PAT_TA_72933
gaagaaactcgccggaggagaggaagaagctcgctggcaggggaccccaccatctatcttagggtcgggatgggggagatggcacggcggtggtgcaagttcgctggagaaaaacctgtcatagcccgaggctagagggatggacgggggcgggggcaagacatgcggtgggggcggtttaggggacggcggtgcggcgaggcggtcgcaggggtggcagcaggcgacccggccagtggcaacatgcggcggaggaagaacaacactggcgatctgtttttaggaagaaggaagaacacgtaatctagactgtttcttttttatctaacgcttgagattgatcctgacaaaatcaactgtctcaaagggaaattttagtcgaccggctccttggcattcccaaaaaaatattgtaatttaattttgattattattattccctccgtttctaaatatttgtctttctagagatttcaataagtgaatacatacggagcaaaatgaatgaatctacactttaaaatatgtctatatacatccatatgtggtagtccatttgaattctctaaaaaggcaaatatttaagaacggatggagtattatatactcctacaattgagctagtaaggttgtgaacatgtttag

SEQ ID NO: 72934 - DNA, 433 bp, Triticum aestivum
  Clone ID: PAT_TA_72934
ctcccctgcctcccccagagctcgttagggttttctcttttttggggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattgcagccaatccctctgctgagggtggtggtcatgatcatgcatttccataccaccatctatatatgtgactgcatctatttctgcacacgtaccttccatattcacacacacatccatttcgaccacaccatccatatccacaaccgcaaccactgtattcccacccacaccaaccaattacacagcagcaccaccagcgccaccaccaccaccaccaccaccacca

SEQ ID NO: 72935 - DNA, 621 bp, Triticum aestivum
  Clone ID: PAT_TA_72935
ctaccaccattatcacatcaacaaccaccgttttctcaacaacaacaaccagtactaccgcaacaaccaccattttcacaacaacaacaaccaattctaccgcaacaaccaccattttcgcaacaacaacaacaaccagttctaccgcaacaacaaataccatttgttcatccatctatcttgcagcagctaaacccatgcaaggtattcctccagcaacaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtaccctaccaacgatgtgccgtgtcaatgtgccgttgtat

SEQ ID NO: 72936 - DNA, 687 bp, Triticum aestivum
  Clone ID: PAT_TA_72936
cacaacaactatttccccagccccagcaaccacaacaacaatgggccccagccccaacaaccacaacaaccatttccccagcaaccacaacaacaatttccccggccccaacaaccacaacaaccatttccccagccccaacaaccccaactaccatttccgcaacaaccacaacaaccattcccccagcctcaacaaccccaacaaccattttcccagttacagcaaccacaacaacctttaccccagccccaacaatcgcaacaaccattctcccagcaacaacaatcattgattcagccatacctacaacaacagatgaacccctgcaagaattacctcttgcagcaatgcaaccctgtgtcattggtgtcatccctcgtgtcaatgatcttgccacgaagtgattgccaggtgatgcggcaacaatgttgccaacaactagcacagattcctcagcagctccagtgcgcagccatccatggtgtcgtgcattccatcatcatgcagcaagaacaacaacaacaacaaggcatacagatcatgcggccacttttccagctcatccagggtcagggcatcatccaacctcaacaaccagctcaattggaggtgatcaggtcattggtattgggaactcttccaaccatgtgcaatgtatttgttccacctgagtgctccaccacc

SEQ ID NO: 72937 - DNA, 655 bp, Triticum aestivum
  Clone ID: PAT_TA_72937
ttcgcaagtggaaaaagcatacaaatattaattctcagtaggaaggtgaagtgttcatatatatcaatgctttcacctcacttgtcatgctgttatgaactatatttttttgtgattgctatatcagaatcaaattgacccatccgatgcttgactgtatcttagcatgcttatcgagtacatcccttatgtcatttttagagataaattcatttgtgtcaagtatcgcattttgccatatgaacatgacaagttgtcatatattggcctgtcaaatttatcgggtgtcaagttcacttgccatgttcttaattctgtttcttctcattttgatgttggtgtgtgtattgttagtgaaaatatgctcaccattttttttaaatatgtgtatgccattaactgatgtcattgttagtaatttgtatttgctttatccgctctgatgagtttgtcaggttcctttctcaatatgcttagatgcttgtgcaacagcagaagtaatggttgattggtccagcctttgtgtcggtttcatatgtatatatgttggcctaactaacattgtgagttagtaatttatgcttcttttctttgggataattatgcctagctggaaacaaagaggagtcaggtatgatacagccacggcggctgg

SEQ ID NO: 72938 - DNA, 576 bp, Triticum aestivum
  Clone ID: PAT_TA_72938
tgaagctgcaggcgctggtccgcggcaacatcgtccggcggggggcggccgagacgctccgatgcatgcaggcgctcgtcagcgtgcagtcccgcgcgcgcgccagccgtgccacccgctcccgccaggccgcggcgcacccgggggcgacgacgccggagaagtacgagcaggcggcatacgagggctcgctcaggcacggccgctccggctcactgaagggaggctcgtcgaagacaccgggcggcgagaggatgagcagggagaggtcagaatcctgcgggaggaactggctggatcggtgggtggaggagaggtacatggacgacgagaagaacgccaagattctggaggtggaccccggcaagcccggccggcacgcgtccaagaggcgaagcagcggcggcggcggccaccaccaatcgtcgtgctcgaccaggacatccgagcagaacagccggagctacgcgacgatgccggactcgccgtccagggactcaaccacggcgcagcagtccgtgcccagtccgtcctcggtgggcatggtcatgggcgcggcggaagccctgagcccgc

SEQ ID NO: 72939 - DNA, 645 bp, Triticum aestivum
  Clone ID: PAT_TA_72939
gggcaacaggggcattacctagcttctcagcagcacccatgaggagggcaacaagggcactacccagcttctcagcagcagccaggacaagggcaacaagggcactacccatcttctcagcagcagccaggacaagggcaacaagggcactacccagcttctcaccatgagccaagacaacggcaacaagggcaaatcccagcttctcagcagcagccaggacaagggcaacaagggcactacccagcttctctgcagcaaccaggacaagggcaacaagggcattacccaacttctctacagcagctaggacaagggcaacaaacaggacagccaggacaaaagcaacaaccatgacaagggcaacaaacaggacaagggcaacagccacaacaagagcaacaaccaggacaagggcaacaaggatactatgcaacttctctgcagcaaccaggacatgggcaacagcaaggacaatggcaacaagggtactacccaacttctctccagcagccaggacaagggcaacaagggcactacccagcttctctgcagcagccaggacaaggacagccaggacaaaggcaacaaccaggacaagggcaacatccagaacaagggaaacaaccatgacaagggcaacaa

SEQ ID NO: 72940 - DNA, 316 bp, Triticum aestivum
  Clone ID: PAT_TA_72940
cacgtgctcccatccatgtgcggcggcgccatcctcttcgaggtcatcccgccgccgcgccgggcctccggcggcatcgtctggcgggcggacaagatgaggagggccaggcccgacgccgccgcggggaggccccgccgcgtgcccgaggatgagttcctgtaggaggagggcgacgcggagttccaggccgacttccaggggttcgtggaggcggatgaggattcccactgcgatgacaatccctttctcgtccgcatgaccggcttttgcggagatggactgaatgcaactgttgctgatgatgatgactgtg

SEQ ID NO: 72941 - DNA, 274 bp, Triticum aestivum
  Clone ID: PAT_TA_72941
cacggatcttgctgttgctggtttcattaacacgcgccaccaagagtgcagacctgccccctctctctccgcgttcgctgccccatctctctccccctcccacgctccggccggcaaatcaaggccttccactggccctcctaagaccaaaccgccccagccacccaacggaggcgacaagcgccctggccgcgggggcactcttccgtccgccggccgcacacgggatccgccacgatccgtgcgcccaacggaactacgatcttttgtggcc

SEQ ID NO: 72942 - DNA, 364 bp, Triticum aestivum
  Clone ID: PAT_TA_72942
cgatggtgcagatgggctgttcgagtatttgcctcacaggggcgcggtgccagcaatcgtggcgcaccctgccgcgccacagaagagaaaagacatatgcttgccacaagttcaacagatcgaacagcacgcatatgggatctcagaaggcttaaaaggaagaaagaccagagcttgaaggttctaaaacataatagatctgttcagtcagcttatttctcacctaggggcagcatgctaccaacaacaagccttgatgacactgaccgagtcttttgtggggatgactgtgataggtcaaacattatcatgcataacaaccacacaggcagatggatttctacattcaaggcaatctggggct

SEQ ID NO: 72943 - DNA, 637 bp, Triticum aestivum
  Clone ID: PAT_TA_72943
tcatccaccatgaagaccttactcatcctgacaatcattgcggtggcactaactaccaccaccgccaatatacaggtcgaccctagtggccaattacaatggccacaacaacaacaaccattctcccagccccaacaaccattctcccaacaaccacaacaaatttttccccaaccccaacaaacattcccccatcaaccacaacaagcatttccccaaccccaacatacattcccccatcaaccacaacaacaatttccccagccccatcaaccacaacaacaatttccccagccccaacaaccacaacaaccatttccccagcaaccacaacaacaatttccccggccccaacaaccacaacaaccatttccccagccccaacaaccccaactaccatttccgcaacaaccacaacaaccattcccccagcctcaacaaccccaacaaccattttcccagttacagcaaccacaacaacctttaccccagccccaacaatcgcaacaaccattctcccaacaacaacaataattgattcagccatacctacaacaacagatgaacccctgcaagaattacctcttgcaacaatgcaaccctgtgtcattggtgtcatccctcgtgtcaatgatct

SEQ ID NO: 72944 - DNA, 339 bp, Triticum aestivum
  Clone ID: PAT_TA_72944
ctctctctcccctcagcaacggaggcacgcaacacggacgcactgcaccgttcccaagatgcactagggccagcccgccactgatggcgatggctatcaaatggcaactacggcgacgttgacgcgctttatcccccaccgctgccgcctcctgagcggccgagatcccgagcgtggtgagctcccttcccttccccacttcctcgataccatgcccatccctaccgccgttctattcccaaggcaacggccccacggtccctctaacctaggattgtcgacctgatctgtcggcgtgcacatgatgatggtggtgccgatctcaatctccctgatttg

SEQ ID NO: 72945 - DNA, 194 bp, Triticum aestivum
  Clone ID: PAT_TA_72945
cctaagccatgttttcctcctccacctccacctccaccggcatggacctcggacgcgcggcggcgtgcagccatggcgatggtggcacaggcgggcttcggcctcacccgcgtcgtcatgctcgtcggcgcgggcgtggccggctccgtcgtcctacgaaacggccgcctctcggacatcctcaccgagataca

SEQ ID NO: 72946 - DNA, 291 bp, Triticum aestivum
  Clone ID: PAT_TA_72946
gacacttctcccgtaccgtccccacccaacctcccatccccgtggcgcgtcgcagaggcagatccactccctcgccatgggcaagattaacatcggaatcaacggctcaggaaggatcgggaggctcgtcaccagcgtcgccctacaaagcgacaatgtcgagctcgtcgccgacaacgacccctttatcaccaccgagtacatgacctacatgttcaagtacgacaccgttcacggccactggaagcacagtgacgtcaatctcaacgacgacaagacgctgctctttgg

SEQ ID NO: 72947 - DNA, 607 bp, Triticum aestivum
  Clone ID: PAT_TA_72947
cgagcacatgaatcaaatccaagtcagtactacctaacgcaaatgcaccatgaagaccttactcatcgtaacaatccttgcgatggcaacaaccatcgccaccgccaatatgcaagtcgaccccggctaccaagtacaatggccacaacaacaaccattcccccagccccaacaaccatatctgcagctgcaaccattttcgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaacaacaagaacaacaaatccttcaacaaattttgcaacaacaactgattccatgcatggatgttgtattgcagcaacacaacatagcgcgtggaagatcacaagttttgcaacaaagtacttaccagctgttgcaagaattgtgttgtcagcacctatggcagatccctgacaagttgcagtgccaggccatacacaatgttgctcatgctattattctgcactaacaacaaaaacaacaacaacaacttatcgagcca

SEQ ID NO: 72948 - DNA, 646 bp, Triticum aestivum
  Clone ID: PAT_TA_72948
cccatcatttaagccaagcaagctgtggacgggacaaatccatcgtgaagacctttctcatccttgtcctgcttgctattgtggccaccaccgtcacaactggatttagatatgcagtgccacaattgcagccacaaaatccatctcagcaacagccacaagagcaagttccattggtacaacaacaacaatttctagggcagcaacaaccatttccaccacaacaaccatatccacagccgcaaccatttccatcacaactaccatatctgcagctgcaaccatttccgcagccgcaactaccatattcacagccacaaccatttcgaccacaacaaccatatccacaaccgcaaccacagtattcgcaaccacaacaaccaatttcacagcagcagcagcagcagcagcagcagcaacaacaacaacaacaacaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcaacacctatggcagatccctgagcagtcgcagtgccaggccatccacaatgttgttcatgctattattct

SEQ ID NO: 72949 - DNA, 433 bp, Triticum aestivum
  Clone ID: PAT_TA_72949
ctcccctgcctcccccagagctcgttagggttttctcctttttggggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtctatgaccataccgagaaggtggtcgacattgttgacaccttccgtcttgaggagcaacctgcttttgacaagaatcagtttatctctcacatgaaccgctacatcaagaacctctctgccaagcttgaaggggatgacctagatgttgtcaagaacaatgttgagtctgccacaaagtatct

SEQ ID NO: 72950 - DNA, 515 bp, Triticum aestivum
  Clone ID: PAT_TA_72950
gccttcacgctctcgcttccggtgacgacgcccgccactccctcgtcgacgagatgacgaagcgcaccaagaaggcaggaatcgttggcaaatatggtaccaggtatggtgccagtttgcgtaaacagatcaagaagatggaggtctcccagcactccaagtacttctgtgagttctgtggcaagtttgctgtgaagaggaaagcagttggtatctggggatgcaaggactgtgggaaggtaaggctggtggtgcctacaccatgaacactgccagtgcggtcactgtcagaagcacaatccggcgcctgcgggagcagaccgaagcatgagtatggacagtttgaaaaggatacctgggattttgtagttcagccaagagtcgagaattatgatgttgccattttgcctatttagccaaatgaacaagaagaaatgtttatctatctgtagttaccttgatactttggtaactggtttggtttctcatgctaaatttgatggtatgcaagtact

SEQ ID NO: 72951 - DNA, 410 bp, Triticum aestivum
  Clone ID: PAT_TA_72951
cggcacgagggtcttgtcatcaggagtgcgacggcttgttgttattgaacaaagtaccagatttgtggaaggaatcatctcattgagagacatttttacatttctccttggatagcatctgtgtagccattccatacatgaaaaagcttgttgtacttggttaaaacgaaataaaaaagttacaaatgtgatagtcatcttctttctccatcttgctttggttcatattatgccgcagacactacataatggaattgcgctgaaagaaaaaacaggcaggtgctgcaggcttgctaaacagaatggagaagtgttcaggtgattgtttcttgctctagtccagctgccaaagcaggctttcagaattgctacttgcgagttaataatgcttcacgatctttttaaatttt

SEQ ID NO: 72952 - DNA, 597 bp, Triticum aestivum
  Clone ID: PAT_TA_72952
tcggcacgagggcaaaccctagcacgccgccgccgccgccactgccactgccccgccgcgcctcggctccaaccaaccgcagccatggcggacgtcgacgtcgaggcggaggtcgccgccgcggggcagcctaagaagaggacgttccgcaagtacagctaccgcggcgtggacctcgacgcgctcctcgacatgtccaccgacgacctcgtccagctcttccccgcccgcgcccgcagaaggttccagaggggtctgaagaggaagccgatggctctcatcaagaggctgcgcacggcgaaaaaggaggcacctgctggtgagaagcccgagcctgtcaggactcatctgcgcaacatgatcattgtgccagagatgataggtagcgtaattggagtgtacaatgggaaaacattcaaccaggttgagatcaagcctgagatgattgggcactaccttgctgaattctccatcagttacaagcccgtcaagcacggaaggcccggtatcggtgctacccattcctccaggttcatccctctcaagtgaagaatccgagggcatgctcgtgtctgcgtcaaagttatctggccctgc

SEQ ID NO: 72953 - DNA, 571 bp, Triticum aestivum
  unsure (1)..(571): unsure at all n locations
  Clone ID: PAT_TA_72953
tgggatgtggggaccgccatggcagaggcgcatgttcggcaggaggagtcagggaggcatgaaggtggacatgtggatgttatcgtggcattgacacatttctctccaccgatgctatataccagggaaaatgtttgtcttgtcggtccatctatatgagaaccttctaagtggaagtcacatggtggagtctcagtatgtcaagtacagtttgattaagtacagtttgattagtatgacaagtcatgtcagcgggatgaatatttacgaggttgattatctcccaggaagacaactagaaagtatgttcgcaatttcatgactaaattatacattatataaattgtgttctacttgaagtttgtcagttaaaatcatgttgactcgcctactgtttagtggctctattttgatcatataattaggtttacatcttgactcgcttgatttgataaattccattcttaccaagggtcatcatttgtatatttcctcttcnggagggtgatctcgtcgcccacggagaagcaatccaaggagaaagatagtaggttctgcgcccaacctctgc

SEQ ID NO: 72954 - DNA, 522 bp, Triticum aestivum
  Clone ID: PAT_TA_72954
tcggcacgaggtcatcgggtgcgcctaaatctggtggcggctttgttcgtggcgatcaacgtcgccggggggaggaagatgatcggcggcggcgaggccggcaccgtgctcctcatctgcgccgacgtcgtgtgcgctgtgctggtcgccacgggaggggcggcgggcttgggtataacggtggaggcccagcggcagattggcaaatccttggattcagtctccaagacattcttcatcagggttgacatctcctgcggcgcgctgttgctcgcatccctctgcctcgtgttcatcgtcatgctatcctctttctcactcaccaagtagctagcatcggcctatctgctttagaaatttgtttaaatttctggtgtgtccaagattgagggtttcagttcttatctggtggcctgcggatgggggtgtggatcttgcatgatccctggctgggctgtacctggccgtcgtgcttgcagtctgtaagtagactttggtagaacttgcctggcgtagcttttg

SEQ ID NO: 72955 - DNA, 625 bp, Triticum aestivum
  unsure (1)..(625): unsure at all n locations
  Clone ID: PAT_TA_72955
cggcacgaggagatctgcaaggtgcccgtctgtcttcttccccacgctattttccaaaagaacctgatggattttcttcttcctcaccattttctccattcccttcgttaccaccacagctgggtgtacgtgcttcatctccagattcgttattttctctgccgataagtcaacgcgagttgaatctccccaccaccgtcgacgctcatctccttccggtgcgacgcgtgccggacgaggcagattggatccctcgccgccaccaccgcgtcgccgcggacacatgctcggagaatctgaatgcctctacaggttancaggtaattggatgngtgttctggggagttagaaaacgaaataggtggaatgattgatgctacaaacatatatattggcactataatgttcttcttaccagctgaagctaaataaaagtagtcttactttgctggtaactgctatcaactgaagcttattctgcatgatttatgagcatgggcaacattgatctctctatatataactcctgaacttttgtccatatttagtttacaggcaaagctttaccgccctatcacttttcctggataaataatgcgctctatacttccatatttagtttaca

SEQ ID NO: 72956 - DNA, 610 bp, Triticum aestivum
  unsure (1)..(610): unsure at all n locations
  Clone ID: PAT_TA_72956
cggcacgagggtctaatcgactcgggaagtcggccaccactccccaaatatcggttcttcctgccccggacccggaggcggccaagtccgtggcttggcgtgcgaatggcggagatgaccagggttgggagcggcggggaaccgcccgaggttggggtttccatggagagtgacccgcttgtgggaggggacgcgccgtcccgcccgaggtgggaagcgagccggtgggcgtccgtggaggctgcgctgaatcggatgagtaaatggctggtgtctggttcttttgcttttgcagctatatggaagcatgatgctgaaattaatgtgggttttgctggggtgcggttggcaactctctgctttcattggttcttaaaaagatgctaaaccatgaaagacctgcaccagctttgcggtctgatcctgngatgccatcgtcccatgcacaatccatattctatgctacgaccatcctagctctttcattgtactactggcttgggacaaattatctgaccatgattcttgggcctgcaactctgttagtggccgcctatctgtcttggctacgagtgtctcagcgccttcatacactaaaccaggtcactgt

SEQ ID NO: 72957 - DNA, 625 bp, Triticum aestivum
  Clone ID: PAT_TA_72957
gaggtcaggcgttgctggagctgggcgccgctgacgtcaaccacccggctgggcccgccgggaagacgccgctgcacgtcgcggccgagatggtctgcccggacatggtggccgtgctcctcgaccaccacgccgaccccaacgtgcgcaccgtcgacggggtcacaccgctcgacatcctccgtacgctcacctccgacttcctcttcaagggcgccgtgccggggctcacccacatcgagccaaacaagctccgactgtgcctcgagctcgtgcagtcggcggccatggtcatgtccagggaggacgcggccggcaatgcgccggtgcccatgtacagcgaccaccatccaggcgcgggcgggcggtggcgtgtacagcagcagcggtggcgcgagcacgagcatgaacctgagcttggacaccaggatggtgtatctaacctagggatggacgtgatgaaccatggcgacggcggtggcgacgacggcgggagcagatcagggcaaggaggcccctcttcgttgttctccccgcatggcttcccatgagacatggctggctgctctactatctccttgtaaggcttagaactaattaatcatatgctctatttatatccata

SEQ ID NO: 72958 - DNA, 541 bp, Triticum aestivum
  Clone ID: PAT_TA_72958
tcggcacgaggcagagatgcatttttctagagatgagctgatcgggtcgacgttcattgcttttgggatcacattgttcgcgtgtttcttctacgttgctatcgcgtccaagctgcttccaccatatgaaaatcaattcctggctgccatccaagatgattggtattactgtctacttgtgcctttgacgcttcctgtaataattgtggctgtctatctgcactggcttagcatgaagatgttcaagcatgcatgaagaagtcatgcagctttcttctaatttcagaatctcagaatcctggtgaaaatcgagaatgcggacagatacgaggatactctggagcattgtggtgctgaactgctgatgctaaaaaactggatgcttgtatgctccaaagccaagatggagataccaattcagtatactgttactttggaacaatcttttctgggcatttgtaacgagccgctgaattgcaagaacaccgcacctggtcgattattggcatgccaaagaaggcacctgcggaggcgctataca

SEQ ID NO: 72959 - DNA, 510 bp, Triticum aestivum
  Clone ID: PAT_TA_72959
cggcacgaggcagggagcaagagctggatgcccaaatttattgtaaagccgaagtctgctagcgcagatcctcataagaaacagaagattgaatccatggctgtccaagacaacgggaaaggcctagatgatgaacaaaaaggtgaatctgcgaagcaaaccaatgttctccagtccctgtgccagaactatgatagcgatgatagtgaatgaggacacccctcttgaagccatgacagtcctggttgccaatgctgtatcagtcatcattacaccagaggttgacatgtagttccccaaaccactgtggcattgtgccatcattgtacatcatatctgtcacaaatctctgattgtcaatggctcaacagcaagcattgactgtaacaaatctgggctatccagataaaactgtgtcattggatatctgaaaagggttaagacttcatttgtaaaaatggatagttgcagaaagttcaatctgcagttttcacaaaaaaaaaaaaaaaa

SEQ ID NO: 72960 - DNA, 487 bp, Triticum aestivum
  unsure (1)..(487): unsure at all n locations
  Clone ID: PAT_TA_72960
gggtcgtcttcctctcgtctagccacgggagctcggggtaggggagactcgatcccctgtttcatggcccgacggatccagtcagatcggctgctccgccggcggccagctgggctcttccccagcagatcttctccaacgtggcggctccagagcagggctctcgcgggtggcagccgcggtagcttcgtcggctggctctggtcttcaagccagctactcctctccggcaagtagggggggcgggggtgcggccccnctccctgctnctgtgggtgcgtcctcacngcgggtcgacggtgtgctttcctttggtgactcctggtggtgttgcgatggtgggattccagatctggccggttctggctcgtcggtgtttggccggcgaggaggtgtgcagcttggtggctcttcagtgctttccggcgtggtggctcttcgagaggtgggtgggccagcggaggtgctatgagtgggggtgctggtg

SEQ ID NO: 72961 - DNA, 621 bp, Triticum aestivum
  Clone ID: PAT_TA_72961
gattcggacgaggccgcttacttgagattgagattgttgccatcccgttgccgatggcggcgatgctcgcgccggccgcgctcccgccccgaggtttacagagtaaggcggttggaaatgcggagtcgcagttgttgctacatggaaaaggttgcatagtggccgacgcaataatatttgcagcaaagagtaatgaaaggaggaggaaatcacaaagtatatctcaaggtccaacatttataagtgaagaagcttcttcttcaggcagtggcgaaaaccccaccaccagccttgaggtcaatgccaatgatgttactactgacgagaaattcacagttgccccaaggaatgcggttcttcaggcttgtactctcacatctagcttactccttgcaggaggtctcgttcttcgtgaggcatcacattttgcatctttgaatggatggccggttgctgaccctatgaatttgtcattcaattttgagacctggcatcttgagttgattgcaggacttgtaataataatatcatctagcagatatattcttctacagacatggccagatttcagatattccagtgagactgcaaatagacaaatccttacttcactggagactt

SEQ ID NO: 72962 - DNA, 675 bp, Triticum aestivum
  Clone ID: PAT_TA_72962
tcacaccggagagcagagcagcgcgcaccagaacgcagagggcaacaagcaagaagagccagagccggtctcccagtctccgatggcggctcgcgtcctcggtgccctgctcgccgccgccctcgccctcgccctcgccctcgcggcccccgcgcgggcgtccaacgacgagggcgacgcgctctacgcgctgcggcagcggctgtccgaccccaacggcgtgctgcagagctgggatcccacgctcgtcaacccctgcacctggttccacgtcacctgcgaccaggccagccgcgtcgtccgcctggatttaggcaactccaacgtctctggctccatcggccctgagctcggccgccttgtcaacctcaaatacctggagctatacaggaacaatcttggacggtgagatcccaaaggaactgggcaacctcaagaacctgatcagctttggatttgtatgccaacaagctcactggaggaatccccaagtcgctttccaagctcaactcactcagattcatgcgcttgaacaacacaagcttacaggatcaattcccaaggagtttgccaagctctccaacctgaaagtcatcgatttgtcgaacaatgatctctgcggaactattccctgttgatggacctttctcaacctttcctctccgaagctttgag

SEQ ID NO: 72963 - DNA, 564 bp, Triticum aestivum
  unsure (1)..(564): unsure at all n locations
  Clone ID: PAT_TA_72963
gaggcaactgagcctggaggagtatcaacttgtaagagactgtctttgcgggcagatgtacgactcgagtcctgtagattttgttagtgatttgggcacccgatttctccttcacccaagtgtcctgaagatgtctcaaccgcctcgtatcctatcatggatgactagaggcattgcctcgggactagacacgctattcattggcaaatttgaagcgcaacgtgcagaatattgggacacactatactcatcagtgcatgttggtccaatactcatattctgttctgaagacgatgaacttgctccgtgttcaattgttcaaaaatttggtcgacgtctgctgnnagcttggtgggtgatgtgaacctagttaaatggcaaaattctcctcatgtaggtcactacaagcatcatcctgaggaataccgagctgcagtaactgagctactcacaaaggcttcaatgctttacatgagcaggaggcaacttaacagctatgatctaggcacaagtgagcatagcgacatgttggcctccgacgtgcataaagctggcacgaattca

SEQ ID NO: 72964 - DNA, 554 bp, Triticum aestivum
  unsure (1)..(554): unsure at all n locations
  Clone ID: PAT_TA_72964
attcggcacgaggggcgtccgcctcctcgcagtcgtcgcaggcggcggcgtcgaccaggcctccgccggtgatgcgccgccgccccaccatcgccaacctcgccgcgcgcaacccgcccgtggccgccagctagccagtacccgtggcggccactccactcgtcgacaagcttgctcgggcagcgaggactcttcagtgcggctgcaccgatcagctagctgtaggccgtacccgtacctgtacgtaggctacctaggcatggatgagtgtgttgcagccaggaaccgtcgtcgcgggatgagtagggtgattcttttctgccgccatggatgagttgcagactgcttgcagcaggacgccattaccgccggcagcagcagttagctagctagcaagagctacgacggagcacgcacggactgacgatggacggcacgcaactggacgctacgtagaaacgaataacgaagcttntgtggtgacttagctacctacatgtacaaaatcagtagtagtaaattaaaagattaattatatattattaaaaaaaaaa

SEQ ID NO: 72965 - DNA, 464 bp, Triticum aestivum
  Clone ID: PAT_TA_72965
tcggcacgaggaagggttgcactcctcactcccacaccgagaaagcttgggatggttgaattataggattggtaggtaaagaacagccgcttcacatgtatttcttatgacgaaggtctcggtcgccctttgcctatggttaacaacagataggttcgggagccgcccgccttcctccaaagagctgaagcagcagggtgcaccgtaggctgtaactgttcgtttgcaccccctcctgtgctaaccagctacaccctgcttactgcactgatgttgtcgtcgactgggcgcgttacaacccttgggtgtggtgaattctttgatttgacctgtactagctgaactgatcttctcgctgctgcttgctgatggtgtaataataggtgtctctggacagttgtcagtcgtgtattgcagaaaatttggtgtagctgttgttcccccctctccagtctcttcttgtc

SEQ ID NO: 72966 - DNA, 580 bp, Triticum aestivum
  Clone ID: PAT_TA_72966
cggcacgagggtaacttcaggttcgagaatatgatgttctacgaaggcgcagccacgacgcgcatcacgccgtgtcgtcgtcgtcaggccctccggcgtcaccatttccggctccgacaacaaataagaacctgcagggatgaagccctgggtaattgccgtgtctgcagcacctcctctagcggtagtagcactctgcttcatcttttactgtcgttggcgaagcagaaggtacataaaaggcagaccaagattacgacgaaagccatgggataacaaattgcgaggaggagatgaaccagattgggaaatggaagcggacctctccgagttttcggtttttgactttcatcagatattagaggccacaggtaacttttctgaagaaataaacttggggaaagggggggggtttggccccgtctataaaggtagtatatgcaacactgaaagttattgggaacttcatttagctttttttcactagttatattggaactgtgacttgtgtatcataaaacagctcagcgcagcaaaataccactgaagaacttctgaatattttctcttcacagggtca

SEQ ID NO: 72967 - DNA, 189 bp, Triticum aestivum
  Clone ID: PAT_TA_72967
gagggagagagaaacctgctcgacacctcgatgaccccgtcgccaacaacgcctgggtctacgccaccaagttcgcgccagggtcttaagctagccggacacggcggcggcgtgccgggacattgtacactactcgtttgtcttgtgacattacatttgtaccatgaacgaatgcaaatattcttgtgc

SEQ ID NO: 72968 - DNA, 548 bp, Triticum aestivum
  unsure (1)..(548): unsure at all n locations
  Clone ID: PAT_TA_72968
cggcacgagggaccgcgagcgcgcggccaggatgctcccgcagctgaagcgcgtcaacgactggctcggcgagatcgggacgcgcggcgaggcgccgccgccgccgccgccggcgcaggacggggacgaggaggccgcggccgctgctgcgtcggccaacggctgcggcgtgcccgaggagacgatcgaacggctgaggaagaagatctacgagttcctcctcaccaacgtcgactcagctgccgcggtgctcggcggcgcggcagccccgccggccccggcgccggcganggcgggaagaagtcgtggacccgtgaggcggcaacgcattgacgggngggattgtgaggcccaattgggcctcgtcgcagctttggatttgtttgggccaaggagaatggtcttggtttgctaatgtagcttgtagggcttttgttgggctttggttcctttaaccctcttctcctcttcctctcttcccgttcaagaaaaagaaaagtgatttgacgaattgacttgtatttataactgatgtttttctttctctt

SEQ ID NO: 72969 - DNA, 617 bp, Triticum aestivum
  Clone ID: PAT_TA_72969
tatgttgaatcaatgaaaactgaatatcttaatgcacaacgccgcattggtaatgggagcgatccatttctggaggcaaacagacgagaagcagctaaacaagaagcagctgccagaagggtccatccaacactgcatttacctacccctgcacagcccatggcacaaatcgctgcaccagctacaactacaagccaaccgcagcaatcttcctttccatctgctgcgacttcctcaagtgccttgtcaacctttagcactccggcttctgctccatcttcatctagtctctttgcaactccaacaactccagctccatcaggcaacctttttggtgcatctggatcggctcagttgaccacaccatttgggacagcctccactcctacattaacatcaacaccagctcctggatttgggactagcactacatctttgggtggaacatctctattttctacaccattcggaggtggagctaccgcttcaggttccagctttggtggggcaacgaaaggaaggtcgaagccccggagtcgacgctagatgtagatgaaccaatgtgaaatgtggatgctattggttctcttgactggtatttccccctatctatgcaa

SEQ ID NO: 72970 - DNA, 485 bp, Triticum aestivum
  unsure (1)..(485): unsure at all n locations
  Clone ID: PAT_TA_72970
cggcacgagagcaaccttacttagctttgcacacacacacacgcaaactatagtagcaacaattgcttagcatcaagaaagctataatgtcgaggcagcaagcgaggagctcgagctaccggaagaaagtggcggcgggggcgtcgtctcaccaccacaaccacggcggcaaggcgcactacggccacggcgggagaccggcaccaaggtggcctgccagggtcatggacgggttcaggaagatgctggtgggcctgttcgccttcccgccgcggccgcccaaggtcaccttctccgccatggccaggggcggggtgggcgaggacgccgtggcgcccaagaggccgtcgtgcagcaacagctccaacctgcagccggtgaacaacgcgcactacgacgaggccatctctngactgcgtcgagttcttccaccgctccgccagggtggacatcaggtcaggggcgtcgacgtcggcccacttctg

SEQ ID NO: 72971 - DNA, 212 bp, Triticum aestivum
  Clone ID: PAT_TA_72971
caggtccgtgtcttagggagcgctcagcttgatcttgcgaggtgtatcgtccttaggttgttataagatgccctgtattccgtattttgacagaactgatgtgttttcatgatcatttatattgctggcttattgtgaacttgagaacagcatggatgtgtgcattgtactgtattatgttatgttcattttgtaaaaaaaaaaaaaaaaaa

SEQ ID NO: 72972 - DNA, 519 bp, Triticum aestivum
  Clone ID: PAT_TA_72972
tcggcacgaggccatttcaggccgtactggtaaatcaactttgactggcactgagatcggagtcgacgttgattcagcccagaaggtctggctggcgcttcaagctctcggcaacattgcattcgcttattcctactccatgattctcattgaaatccaagacacggtgaagtctcctcccgccgagaacaagacgatgaagaaggcgaccctgatgggcgtgacgaccaccacggcgttctacatgcttgctggctgccttgggtactcggcgttcgggaacgcggcgccagggaacatcctgaccgggttcggcttctacgaaccttactggctgatcgactttgccaacgtctgcatcgtggtgcacctggtgggcgcgtaccaggtcttctcgcagcccatctttgcggcccttggagacggccgccgccaagctctggccgaacgccaagttcgtcacgcgcgagcaccccctcgtggccggcaggttcaacgtcaacatgctcaggctgacgt

SEQ ID NO: 72973 - DNA, 439 bp, Triticum aestivum
  Clone ID: PAT_TA_72973
tcggcacgagggatgggaggcatgcccatgagagatgctgctgcgtcacagcctgtacctattggagcattggctactgcactggccaacgcagcccctgatcagcaaagaatgatgcttggtgagaacttgtatcctcttgttgatcagctggagcatgagcaggctgcgaaggtgactggcatgctgctggagatggaccagactgaggtgctgcacctgctcgagtctccagaggctctcaaggccaaggttgctgaagccatggaggtccttcgcacggcccagcagatccagacgaacgcgacgcctgaacagcagcttgcttctctgtcgctgaatgacggcgtcgtttcctcctaagcataacgacgacagcaatttttgatccatatctcagttatcttatctatctagaattgaaaacgacttggttact

SEQ ID NO: 72974 - DNA, 299 bp, Triticum aestivum
  Clone ID: PAT_TA_72974
ttcggcacgaggtatgacctcagcctcaagttggcatttgatttatttttgtcacacactacagctgaccaaggatatcagtcagcaagcacaaaagtcgattgtgaaagagtgtagtagtcatcttttggtgtaagttattttccagctacttttgttggttcatcgtactaggaggatggatctagctagagtagtggaaatctgaattttaattgtaaaggatgtgtttcctaaactacacaaactattcctgtaacaaatgtgataggaatagatagtttacttctactctttgt

SEQ ID NO: 72975 - DNA, 243 bp, Triticum aestivum
  Clone ID: PAT_TA_72975
attcggccgaggagagagagagagagagagagagagagagagagagagagagagagagagagagagagagagagagagagagagagagagagagagagagaggctagttgtagttgctgaaaggcgatgtagttcctgctttgttcttccctccagtgtgttttcagaaatgttgtttcatgtgaacttgtaatgattgccctccttgctgtgtcttgattgcagttgaaaccatatgtagtt

SEQ ID NO: 72976 - DNA, 480 bp, Triticum aestivum
  Clone ID: PAT_TA_72976
ttcggcacgaggtgacattcaaggtcatgactactttcatggcacctccgcctgctgcaactttccttgcattccacccacaagataataatatcatagctattggaatggaggactctaccatccaaatctacaatgtccgcattgatgatgtcaaaagtaagctcaagggacatcagaagaagatcactggactggccttttctcaatcaatgaatgtgctagtatcatcaggcgctgatgctcagctatgtgtgggagtattgatggggtgggaaaaaaagaaatcaagatatattcaacccccagcaaatcgacctggcactttggttggtgatacaagggtgcagttccacaatgaccagacacatcttttggtagtccatgagagccagttggcaatctatgatggaaatcttgaatgtttgcgctcgtggtcaccaagagatgcactcccagctccaatatcgagtgcaatat

SEQ ID NO: 72977 - DNA, 356 bp, Triticum aestivum
  Clone ID: PAT_TA_72977
tgattcggacgaggcctcctcccgctccagagctcgctgcttcggtccacccacccgtaggtcccctcccctcctcctcctccctcccctgttgctgctgcttaacttgcttcaaccatcatctgttcatcatgttcttcttcttggacacggattatggagagaggctcttggattggtcactgaatgtctggatcctctgttgcgtctctcctgctcccgtctgggactggctcctcgatcggggggcagctagagcgcgataggtttttgtttttggaccactcatcagaaaggagatatgcttgctccttcagtccttcagtacaaggattgatagctagcttgatggattg

SEQ ID NO: 72978 - DNA, 489 bp, Triticum aestivum
  Clone ID: PAT_TA_72978
tttcagctcatcgagtagtagtggcacccaatgaaggaatacctattaacggttcagcagctgcgatctcttcaattttacctatagccctaacaactccacgaacttcattattgcatggctcttcgaatcaacatcaatcccaccaacagcctcatgcttcaggaaatgggcagcatcaaggaatacaatcaatggactttttctggcatacaggagtcacctcatgttaaagttgcgttcattagtagctccaaatgtataaaatttgaaaaaagtcaaatacagaccaaattaatatcccgatcagcccataaaaaattcaagaatgaaaatagaaaaatacgaattaaacccgaagactttttttaacaatcgttgctgagaaattctgtaaatcttcgtaatcatcatcatcatacttttaatgtaattgtaattatgtttttgtgctaccatctctatcttaatattaataattatatttca

SEQ ID NO: 72979 - DNA, 366 bp, Triticum aestivum
  Clone ID: PAT_TA_72979
gattcggacgaggctcgtatgctgactgtgaaaagagagcgggaaattgaacaaggaatcaacaagagattgtctaggaaacttgataggaaatggaagcagagcattgtggtcagaccaccaccatctctaagggagaacaaagaggcgtagaaagccgcaaaagagggcaatctgcaaaagttgtttcatgcgagtgttgcaggaaggttcctttgtgatttcaacccttattacattccatgtttacattttgctaagcattggtatccaagtctgaatttcagtcgttagtctcttctgtaaattttgatttatttaagtttacgcttcattctgtgttatccaaaaaaaaaaaaaaaaaaa

SEQ ID NO: 72980 - DNA, 544 bp, Triticum aestivum
  Clone ID: PAT_TA_72980
cggcacgaggagcaaaggtggtaagcgaaatgcagtccaaaaaagaaaaacaagaagcagtcagcaaagagagaaaaaagagtttcagataagccaatccatacatcagaaatacctccagaagatattgtcccacagaataactctcatgttcatgaaggaaacttcgagaaacctgcaggtggtacaagcaatggactctccccaagcaaagatagtaagcaaaagcgagttcaaaatgaggagtctaagaagcagccattgaagagaatgaaaagaggggcagaagaggcaagcaatccattgggaatacccccggaaaattgtgatacagagactcaacctagtatgcaagatacaaatatcgagcagcagacagttgatacaagggttccacggtccccaaacaaaggtaaattgcaaaaggaaggtcaaaggagaaagaagaggaaagaagtgaatagaaggaaaagcctgacagcatttgagtcttgcgtggcaatctggcgtgagacgcagcacaagaatacggtccaggccattg

SEQ ID NO: 72981 - DNA, 583 bp, Triticum aestivum
  Clone ID: PAT_TA_72981
gattcggacgaggctcactccttagaattccctctcctcttcttcttgttcttcttgcttccctccaacttcttcttcttgttgttcttgctgttcttgtggttcttggcctgccatcggcggcgagcatggccaggaaatgctccagctgcgggaacaatggccacaactccaggacttgcaccggccaaaggagactccaggagagtggcggcggtggcgccggcggcgtgaggttgttcggggtgcagttgcacgtcggcggtgcgcctctgaagaagtgcttcagcatggagtgcctatcgtcgccgtcgccgtcgccgtcgccggcgtactacgccgcggtcgccgccgccgcctccaactcgtcgccgaccgtgtcgtcgtcgtcgtcgctggtgtcggtggaggaggccggcgagaagatggccaacgggtacctctccgatggcctcatggcgagagctcaggagaggaagaagggtgttccatggactgaagaggagcacaggaaattcctggtagggctcgagaagctcgggaaaggcgactggcgcggcatttcccggcacttcgtcacgac

SEQ ID NO: 72982 - DNA, 479 bp, Triticum aestivum
  Clone ID: PAT_TA_72982
attcggcacgaggctgtgtggtgtttagtcctgctcctcgtgctcgtcgccgtgacggcggctgaggggaggtccatcggagagtgccaaaccgaatgctttggctccccccgctacacgcagtgcctgtatatgtgcagacttcgcctcgcgcttcgaggaacatatcaagaagcagcagcggcactaggagggaggtgccgttggcccaactgccgttagatggcaagagggtgtttcttcttcctcgttctctccgtcccctcctcttcatcccaacctcctgtctcagatccgcctccctcggacccttctctcctcctccgccctcgccggcggtgaaccgggaggggcccttcctcctgtagctctaggttaactactagtacgtagttccttcatgtagtggctttggacattctgtctcttcgtttccggagaagtcaggggggcgaggaggcgctcctggcttggctttt

SEQ ID NO: 72983 - DNA, 437 bp, Triticum aestivum
  Clone ID: PAT_TA_72983
cggcacgagggggacctgtcgcgggggcagtacgtggaggagatcctccggcggacgccgcagcggcgcgtcggcgagcccgaggagatctcgtcgctggtggccttcctctgcatgccctgcgcgtcctacatcaccggacagaccatcgccgtcgacggcggcatgaccgtcaatggcctctaccccagctcatcgccgtcaggactaagctacagtaattaatgaacaaaccatcgtcgttggtactacgatggattccggcgacgcgtcaaggaatagcttgatgaagaataaagtacttagttattagtaccaataagggggaatacagatgttcgataaaatttggagaatatggacacattattgcacatggataatatagagtttccagcttaattctcgacatagatgacaaaaaaaaaaaaaaaaaa

SEQ ID NO: 72984 - DNA, 241 bp, Triticum aestivum
  Clone ID: PAT_TA_72984
atgcttttcttctagattttatctaaagctgtccttgtaagggttgtgttcaggttgagagttagcaggttgagctgtctatttgagaaccctttaaagttctccaagttttggtgttatgaactcacttgaaacattattatatggagttgaagttagaactgagttaatttgccatatttttgtatgatgatgcgttaatcttatatgctctcgttgcatcttgagcaacggttatgtg

SEQ ID NO: 72985 - DNA, 601 bp, Triticum aestivum
  Clone ID: PAT_TA_72985
attcggcacgaggagaggatgagcccggcgacgccaacgccgaggtcagccctgagatgctcaggcgaatcaaaagggctaagagggtgagccaaatatctgagaaagtggcaactggaattttgtctggagttgtgaaggttactggttatttcacaagctcgctggcgaactcgaaagctggcaagaagttcttcaacatgttgcctggagagattgttcttgcttcacttgatggatttggaaagatttgcgacgctgtggaggtggcaggaaagaatgttttgtccacatcatcaactgtgacgactgggctagtatctcacaagtacggagacaaagctgccgccgcaacaaacgaagggctggacgccgccggccacgccattgggacggcgtgggctgtgttcaagatccggcaggccttgaaccccaagagcgtcctgaaacccacgacactggccaagtccaccatcaaggccaatgttgctgagcttcgcacaaagcacggcagcaagtagttcactcctgccgccgttcgtaactggctagctgcagcaagtagttcactccagtcccagcaagtctttgagcaaagctg

SEQ ID NO: 72986 - DNA, 161 bp, Triticum aestivum
  Clone ID: PAT_TA_72986
attcggcacgaggctcctttgtatgttgtggctccatgtgcgagcacgccgtgtcgtatcacctggtttgtgagatgagttgttgtcaaacttgcttggcttgattggttgtacctgtaagagctgatagttttataaattgcttggactgttctgctgct

SEQ ID NO: 72987 - DNA, 519 bp, Triticum aestivum
  Clone ID: PAT_TA_72987
attcggacgagggttgaaccaattctgttctgtatatcatttcatgcagtactacttgaaggtgttttgtatttgttggaatgatttgttagcaaactataggaatctatgcctctttatgtattaaatactactgcaacatcctgtactcggtttttatttctcttttcattccttgattacatttggtatttatcacttaaagttgattaagatcatagctaatgtattataaccgtatactgatatacccactatgaacattttgtttaaagtaaccacccacatggccacaaccacctctaactgtatacagtggagctatattatttcttaaatcaaatttatgtaaaatggttacctaaagtgtcatacagaatgcttttgttgcttcattatgtgtttatgaatgcctataaattatttaactgtaatctccctgtttttcagcagcactgaacaccacatgcattgcagaatctccaaatacagtgggccctacaaaagctcttgaagttg

SEQ ID NO: 72988 - DNA, 514 bp, Triticum aestivum
  Clone ID: PAT_TA_72988
tcggcacgaggccaggctcaaggatatgaggaggtttgaggaagagaagaaaattctgccgactttcatggctgaggggtatgatccgtctccgtccacctggtgtctgcatgaggcatgggcggaccagggtggtcttctaaggacggttcccactcttcccattcatgtgatgcgtgaaggttcaagagactgtgaggaggcagaggaggagtcgaaccgtaatctgttggagcaagctagactcttggaggaagaggatgaggatctctgtgacacggaggaggccaagattgctttccgtgctttcaaggtcaagtttgctgctttataccgcagcctggctggcactaagcctgtgttcatatatgacccacccagcgacacaattgaggagcacttgacggctaaggagatggagaggcaagcagatatttccggatggccagtttgctctcaggcacaacactttgccactcttgcttttggagtggtacaactctaccaagaaaac

SEQ ID NO: 72989 - DNA, 531 bp, Triticum aestivum
  Clone ID: PAT_TA_72989
attcggacgagggagagagagagagagagagagagagagagagagagagagagagagagagagagagagagagagagaccagataaaaatactacggatacgagtgtcgtgcaaccggatggtgacaagtcttaccatcttactttccaacaaaagttaaagtttctaatgtcgcccaaaaaaccttggatctatttaatctcaggattggttggatttattttgattgcattcattatttttgggttttcgcgattttttgttgattccgaagaacaggaagaatacaacatgtctgcaaatgttgaaaagggtcgagataactcaaaaaattcagacactgcagttagatttttataaacaaacgaccgaagttcaaattgttaattaaccttcagctcgcaacaataaacaagttcatttatgtatgcttcaagttattttcatgtatttagataatgtcagaatattcctaattgattattgtaaattttcatgaaataataataaatatgatgttttgcgattttt

SEQ ID NO: 72990 - DNA, 544 bp, Triticum aestivum
  unsure (1)..(544): unsure at all n locations
  Clone ID: PAT_TA_72990
ttcggcacgaggatttgcagaaagttagtttagctcgaagatttgcgctagttccattgggcccaccactattgacctacaagagcaactgcaaagcaatgctgacagctgttggtgattctgttcggttggttgtggatcgaccatacaaagcgggagaaccaataatcgtctggtgtgggccacagcctaactctagattgctcctcaactacggttttattgacgaagataatccatatgatcgtatagtgattgaggcatccctaaacatagaagatcctcagttccaagagaagagaatggttgctcaaagaaatgggaagctggctatccaaaatttccatgtctgtgtngggtaaagagaaggaaacaattgcagaaatgctgccctatttgaggctaggatacatttcagatccagatgaaatgcaatccatactttcttcagaaggtgatacatgtccagtcagtccatgcacagagcgagcagtacttgaccaacttgttgaatacttggagtcacgattggctgattatccac

SEQ ID NO: 72991 - DNA, 522 bp, Triticum aestivum
  Clone ID: PAT_TA_72991
gttcttcttcacgacgacctccgaccgccgtgttcaatggcgcgcccaccgccgcgctgccggatggcgccgccgcaaacgcaacaaggagcggggcggaggcggtgccggcgccggcgccggcggccgtggagaggccgcggacggagcggatcgcgttccggacgaagtcagagatcgagattcttggcgacggctacaagtggcgcaagtacggcaagaagtccgtcaagaacagccccaacccaagtgacattgggtgagaaaggtcctcgttttccgcgcgcacgcttcccaaactactaaacggaactactaccggtgctcgacggaagggtgcaacgtgaagaagagggtggagcgggacaaggacgacccgagctacgtggtgacgacgtacgaggggacgcacaaccacgtgagccccagcacggtgtactacgccagccaggacgccgcctccggccgcttcttcgtcgccggcacgcagccgccaggttctctcaattaaccgcgcgcgta

SEQ ID NO: 72992 - DNA, 588 bp, Triticum aestivum
  Clone ID: PAT_TA_72992
attcggcacgagggtaacatacaaagtgacccttgcactctggggacatgtccacaggtacgagaggttctgccccatgaaaaacttccaatgtgtcaacatgtcatcaagcttcgtataccctggtgcccctgttcatcttgtgatcgggatgggtggtcaagattatcaaccattctggcagccaaggaaggatcaccctgatgtacctgtctatccgcagcctgagaggtctatgtaccgtgggtgggggagtttggatacacaaaacttgtagctacaaaggagaagttgacactaacgtacatcggcaaccatgatgggcaagtccatgatatggtggagatattctctgggcaagtatctaataacaatggtgttcctgaggtgatcgatgatacaaagctcagcacaggggtcagcaccaaactgaaaatccctctgttctccttggaaattgtaggcagcgtgatgtttgcactgggttctgggtttctctcttggatttctgatcagaaggaagaaagaagctgcacagtggaccccagtgaagaacgaagagacctaaaatcacacactgtatctaat

SEQ ID NO: 72993 - DNA, 530 bp, Triticum aestivum
  Clone ID: PAT_TA_72993
attcggacgaggggggacttaaccaatacaatgctggactgagctacactacttctgactttgttgctgcagcgactctgaaccacaaaggagacaacattgccgcttcctactaccacttggtgagtccaaccacagctgttggaggagagctgagccacagcttctcaaccaacgggaacaccatcacctttgggacgcagcatgccctggaccccctgaccactgtgaaggcgcgcttcaacaactacggcatggcaagcgcactgatccaacatgagtggaggcccaagtcattggtcaccatctccgcggaggtggacaccaaggcaattgagaagagctccaaggttgggctctccctggtcctcaagccctgaggcctgagggtcaccagcttctgcttttgggatggtaggggttaattttttttattatcagcagctggagtccagcaaactgaacttgtcaactttggtgctgatcccgcaaacccaatttgttgcttgttaccgtcccctaactacctg

SEQ ID NO: 72994 - DNA, 530 bp, Triticum aestivum
  Clone ID: PAT_TA_72994
cggcacgagggtctgccagtttcattgtcagatgattgtggtggccgttctcattcagatgctataagagctatttgcttcagtgtgagtggagctttgtttgcatctgctggtgacgacaaacttgtgaaggtttggaagactgattcatggcgttgcatccagactataacttcggagaagagggtcagtgcagttgctattagcaacgatgacctgtatgtaacttttgctgataaatttggtgttgtttggttagtcactttgcgggaagatagtgcagagcaggtttcagttgataacaaacctgtgtcaattcttggtcactattgcagtatcatcactagcatgaagttttcgccagatggacggttcattgctactgctgacagggacttcaaaatacgagtcacattattcccaaagaatcctctaaaaggggcccatgaaatacagagcttttgccttgggcatacagactttgtgtcatgcatcaccttcactagcatatctgaaacccagagctttct

SEQ ID NO: 72995 - DNA, 496 bp, Triticum aestivum
  Clone ID: PAT_TA_72995
attcggcacgaggctgatgctgcatcatctgctaagatatttgctgttcttgctggtgttcaaagtttggtagcctgctctttgagaaaacttcgtggaaaagatgatggaatcaatgcaggagtcgcaggctgttgtactggccttgctttgagctttccaggtgctccgcaaactctgattcagagctgcctgacctttgggactttctcttacatcattgagaagctaaacaagcagcagcctgcgctggcgctccagcctgccacaggtgtgacgggtctgaaggctggacaaagcgttcttcctcccttcacacttcttcttccggatgcgatggacgaattttctaagttccaaaactttttgtcatccaaatttcggggaaactgagttatctttgtggagtgacgcctagttacctactctggaacgtgtccttgtaaatgcgtctatggtcaatcagagtttttttccttgtttatttcttggcgag

SEQ ID NO: 72996 - DNA, 509 bp, Triticum aestivum
  Clone ID: PAT_TA_72996
cggcacgaggctgccacagtgccacttcatgtgctctttggcaataccttccatcccaggttcttttctaccaaatcaaactcagcaggctgaagtagttctactataatcagagcaattcattacagatcaggaatcactgatctgtccctttattacattgggcatagtgatatgtgatcgagtcctaatggcagagattgttagttctgtggttgttcatgaggcagtcaaccaaatcatacatggcttggtgaactggaatgagcgaaaatcaagcacagaggagaacatggagaggctggagatggcacacatcagaagaagctgaagcgtgctgctcaagagtgcgatgacacactgcgcaaatgccggcaacgcatcctggaacaagaagaggcagaacaagaagtaaggaattcctctattcctagacgaatagcccatgccaccaagtcattagtgtcctccttattttacgcaatatcgatggctcatgtagatctgct

SEQ ID NO: 72997 - DNA, 328 bp, Triticum aestivum
  Clone ID: PAT_TA_72997
ccagacgaagcgaatgccacacaaccaaaggaagaacatgaagtgaacattgacagcgttggggaagaatgtgagttgcagccatcccagtcacctcataagaaacaaaaaaaaaatcacacacatgtcaagttggagcccgatggagttctagcggacagcgggtcacttcaagtggaagcccaaactcatgacatacaacaaaaaaatgatcaagattggcatggatatagaagaagaggaagtgaaggtcgttggtgttggcaattttgaagaaaacgttcagtttatgacacttcttagaatgacacaacataataaaccaaag

SEQ ID NO: 72998 - DNA, 588 bp, Triticum aestivum
  Clone ID: PAT_TA_72998
gattcggacgagggctgtttgcttctcataatgatgttggttgcattttgctaaaccaaggagaaaataatcaaataatcttctcaaattatttaaataacacttttatcttgtattgacatgtattggtttgggtggttcggacagtcttttctttgttatccatttctaaacatgtgggctctgttgatgtacttagtggataagtaatatagagctccagcagaaattatgtcttctggtaatttttgttagacatattatctgagttactgttgagcaatttaatgtgcgaatggttggtacaaccattagaagactaaaaaatcctgggaaatacaaatacacacaagcaggtatttttactgcatgcagccttgatgtttttttttcttagaacatcttttcccttttactctcggaaaagatcaaaccatttgcttctgcagtaggcacaatgtatcatttgttttcccattctatgaacttgcttctcgtgtgtattaactggagcaaacaagcttgaagaatgttggcgatggcacaagtaagcttagatcactttgtgcttttaaaagcagcttatct

SEQ ID NO: 72999 - DNA, 620 bp, Triticum aestivum
  Clone ID: PAT_TA_72999
gagggctcctcctgactaccaagcctgccatcttgacactgttccagtcattgggatgagcagtggtgacactcacaatggtggctgcgtcaccagcgccctcgagaacacacagagtgtcatggatggatatcccatggaccagatatggaaggagattgaggcacctcaggcacctgccttgctgggtattgctgaagggaaagagaagacatgcagcagtatcccctgtcatctgccatcatctgctatgtgggactacaaatatcctgaggtattctggaagatggaagatcaagaaatcatgatgtgatagaagatgaagaaaccttgatgttggcttatttggttatggtaaataaggccctcactattgaaagctgaaggaatacatctatattggtcaggccactcggctatctgcctagcagatttgcagtacttgtacttcctagctatgcttgctttagtatgggtttcagtattttaaaatatacagtgatactggaggtatgcttatgatgtatgtatctattagtgtgcaaaaatagtttgtatcagtttgtgggaatagtgtgcaatacaaggacgctctatatgcatcatgtacttatttatct

SEQ ID NO: 73000 - DNA, 348 bp, Triticum aestivum
  Clone ID: PAT_TA_73000
attcggcacgagggatttgatacctttcaacgaaacgattcaaaagatatatggatgattatatgggtgcgtggcaagtatactgcaatgatgatgaagttccagttcatgatgatggatccttttggttttgttaagtgctagggacattgttgatgttgctagatgatgttcctcagttacgttttagtttagttgtagggatgttgatggattctttcagttaaagtttcgcttcgctgtgaagaaaatattgagattatgcagcatatttggatgatgttcctcatgtaatatccactactgtaatccaaaagttttatccaatatatgatttcttcccctcca

SEQ ID NO: 73001 - DNA, 625 bp, Triticum aestivum
  Clone ID: PAT_TA_73001
gttatagccctgaagaatacaagagcacttgtcagaattcaacagcatactgaaaggcttcgagggaaaccatccatttcataattacactgcacgtgccaagtacaggaaggttcttgcgggaaggcacccgagggccaaaggagcaagcttgacgttgaagtccatgtcctctgaaatgggtatggcagaaagctcttctttagaaagcacttcttcagatgatgatgaggacttgaatatttcatcaatcgactctggtgcatcagaaaacatttttgtgaatgatatcctgaaattttctgagagtcgagtgcagattcaagctaggtggctgcatgaacctgatgaaagtgatagattaaatgcttcacatttcagagatatcattacctgttcatgtggagagttgcaaacttcatcaggaattcaatttgtggaattgaccatatgtggggtatctttcatgctacaccagatccggaaaatggttggaactgccgtggcagtgaagcgtggattactacccaaagatatcatagaactgtctcttgcaaagttttctagaatcgttctaccaatagccccttcagaagttctgatccttaaggacaatagtttctgc

SEQ ID NO: 73002 - DNA, 679 bp, Triticum aestivum
  unsure (1)..(679): unsure at all n locations
  Clone ID: PAT_TA_73002
gaggcgatgcagtaccgcctccacacgttctcgtcggccggggattggggatggagcacgcgctccggccgcgtgaaccacaacctgtgcgtgccgctctcccagcaaaacgcggtcgtgtgcggcggcgccgcgcggtggttcttctgcaacaagtcgggcttgcactcgtttgacgtcggtaccaagaccggcgacgtctccatggcaaagctactcaaagtgataccacgtgaccccctcagccccaaagcttacgacgagccgtaccttagcctcgacgccgaggggaggctcacgttgttctcgctgcagttggacggcaaccaggtggatatctggacatggcaccacgacggaaggtgcatccctactttgttgaagctagatccaccgtctaggaagaagaacaaaaacaagaaggctggatgntcgggtggagtacgcgtgcttggngggagaagaacggtacgttgctcatccaggacgatcaacagcgcgtctacgctgtcagtgcaagaccggggtgatgcaggagggtagcggattgtccgctcggtggcgtcggccgtagagagattggcccttggagatcgattggccggcgctatttgtttctcgccttggtgaatggccatgggagtaagattttcttcaatttgtttcaaaaaaaaaaaaa

SEQ ID NO: 73003 - DNA, 600 bp, Triticum aestivum
  unsure (1)..(600): unsure at all n locations
  Clone ID: PAT_TA_73003
cggcacgaggcacaggtagaatcatcgaccgtaagtaggtacgtacattaagtgtgagcttgattaactatggaggtatccaagctggccattgctttggccatggtagccgccatggcactcccctcccaagctcaaaactccccgcaggactacgtgaggctccacaacgccgcccgcgccgccgtcggcgtgggtccggtgacctgggacacgagcgtgcaggcgttcgcggagaactacgccagccagaggagcggcgactgcagcctgatccactccagcaaccggaacaaccttggcgagaacctncttctggggttcggccggcggggactggacggcggcgagcgcggtgcantcgtgggtgggcgagaagagcgactacgactacgcctccaacagctgccgcagggggaaagtgtgcgggcactacacgcaagggggtgtggcgcgcgtcgaccagcatcggctgcgcccgcgtcgtctgcagcaacggccgcggcgtcttcatcacatgcaactataagccggccggcaacttcgtcggaagaggccttactaagttatttatacacacgggcgacgtactggctagta

SEQ ID NO: 73004 - DNA, 437 bp, Triticum aestivum
  Clone ID: PAT_TA_73004
tttttttttttttttttttttttttttaaaaaaaaaacatgtttatagatgaaatataatggtgccgtttacaatacagatttattcctccacatctgcacccagcaaatttacatgacaaagttcgtcagtactttctgaaccaaatgctctccgtagacaaccttttcgtacttggcagcaccgccggttttctcccggcagaactcaacaggctctattgcagcatcaaagtttgactcatagaagaacgcaacagatacacggtaacgaggcgaattgttgacaactctgtgaagtgtgggctgatatattccatttgtccaaaccttcagcatgtcaccaatgttacaaacaaaggttccgggaatcggcgttgcatatatccactcaccggagcggttttgcacctcaagggcacatatgtcatcatcctg

SEQ ID NO: 73005 - DNA, 571 bp, Triticum aestivum
  Clone ID: PAT_TA_73005
gattcggacgagggaatagttttttatattcttatcaaatgttgcatgtcaatgctccttcacctcaccgtgaaattaccaaagtgctcttggttaccttggtggtttcagttgggtcataagtgccacatgctcgtattcataaaattgcaattctgcaacaacctctttgtggaatcaaacaccatctgtccttttcactaaccaatacataccgtttactttgttttgttcttgacttaaattcgtaatttgttctgagcttcaatttcaagtatgcttaacatattttgcagagaatgaaaggtctgcctcttcgtgtttatttggatctggaggctagcaggaaaccaactggttttgaggacatttttataggttaccatgctaatgatgatttacaagtaacatatgctggaaaatctttccacactagccggagttaccatgtatccacagaaaagacaactgatgcacttatctattggtcatctttcaaggtgtcttcctcacagagacaagcttgcagaagatttcctctcattggtgccacaccattccttcggaaaat

SEQ ID NO: 73006 - DNA, 420 bp, Triticum aestivum
  Clone ID: PAT_TA_73006
cggcacgagggcagcagcagcagcaggactccaagggcggcaacgacggcttcttgaaaggatgcttggccgcgctctgctgctgctgcatgctcgacatgtgcttctgagactgagttgccgtcagggatgcatggggatggcgcgtccagattcatcctgcagtcaggcgaatgcgtggagctgtttttctgaatcatgattatgatgcatctttgtttccatctccatcttgtgtatgtttttcccgtgcaatgaatctataatcatgcatggacttcactagttaaaccagctgggattttctggtgttcatgtgcgtgtgcgcttgagctctgaaaacattttcgatcagatttgtatttgtacctcggtttgttccttattatcgccgtactcttcaaaaaaaaaaaaaaaaaa

SEQ ID NO: 73007 - DNA, 383 bp, Triticum aestivum
  Clone ID: PAT_TA_73007
ggcaaaggagatgtcaaaaattaatatgctaaggtcatgcaaaggaagtgtttactggatggcacctgaggttattaatccaaaaaagatgtatgggccttcagctgatatatggagccttggctgcaccgtgttggaaatgctaacccggcaaataccatttcctaatgtcgagtggacaaatgctttcttcatgattggaagaggggaacagcctactattcccaactatctgtcgaaggaggcacaagatttcattggccagtgtgtaagagttgatcctgagagccgaccttctgcatcacaacttttggagcacccatttgttaacagaccactgcgagcttcatttgaatctgcatctcccccagccatcagattat

SEQ ID NO: 73008 - DNA, 570 bp, Triticum aestivum
  Clone ID: PAT_TA_73008
attcggacgagggcttgtgaagatcctggtctttttgatgtactagtgatgccaaatctctatggtgacattattagcgatctatgtgctggtttgatcgggggcttgggcctaacacccagttgcaatattggtgaaggcggcatttgtctggcagaagctgttcatggttctgctcctgatattgctggcaagaacctcgcgaacccgactgctcttatgctgagtgctgtcatgatgttgcgccacttgcaattcaacgacaaagcagaccggatccacaacgccatccttcagaccatcgctgagggaaagtacaggactgctgatcttggtggaaaggcatcgacatcagagtttacaaacgcagtctgtgaacacatctgagaatcggatgtgattctttccttctgattgttttgtcttcctaatttttttgtcgcatatggagaggagctttagctttaagaggttaactggcagcacctcaaactttttgtgggtgtttaacacggtttgagaccgtccaataattttgtcacatttcttgctgttcaaaaaaaaaaaaaa

SEQ ID NO: 73009 - DNA, 586 bp, Triticum aestivum
  Clone ID: PAT_TA_73009
attcggacgaggctgaccaccgcggagccgtccccgaaggaaaccctagcgcagccgccgatcaccgccgcgcacagcatggcgtccccggcacgccctaccgctgcatccgtctcgggcgccttcggcctgtcgcccgaccccaagcgctgctccttcgaccaggcgctccggcagaaggattttcaagagaacagactgttgatgtcatttgttaatttccatgagcaagaaaagatttctaaagaaatcgtaacagacgctatagaaagctgtatgaagaaacaagcagataacttgttgaattcactggaagttatcagcggtaggctgtcacaactggagttatattgctataagttggaaagatccattggagaattacgaagtgatgtgatggattatcataacgaagcaaatctcaactttcagtgccttgaaaagcaagtgaaagaggtatatcttttttatacattgaaatatcaaattactttgctgattttatttgagctctgttgcaagatgcactactgttggtttcaattttttatgtaactagattccatttcctgtttcttatgggcta

SEQ ID NO: 73010 - DNA, 486 bp, Triticum aestivum
  Clone ID: PAT_TA_73010
gagacaacttggtttgataaccgagtctcctcttcgagaacactagatactgcttcatcaagggggggcccatccggagctgaatagatcatttgtcttcgaagatcaaactcttggtttagcccttccaaaaaagtttgaacaagaatgggctgaaaccattcacgaagaagagccaagtcttttggatcattagacttgaaaggacgaaagaactcaaggtctctgtataaccttttcagttcaccagcataatctgttatagacctctctccttgtttaagatttctcatctcatgaagcacccttgtcacttgcatcttgtttgttttgccagagagttgctgtccaatttccttccacacttctgctgtagtttgcaggttctcaacctgctcacggaccgaaggctccatcgaccccaacaaccacaccataacacgctgctcattctgttcccattgctccaattccaatttatcatct

SEQ ID NO: 73011 - DNA, 495 bp, Triticum aestivum
  Clone ID: PAT_TA_73011
tggtgctcgccgtgtccgtggcgtgggagggctccaccatggccgccgactactggctcgcctaccagacctccggcgacgcgttccggcccgccctcttcatcaaggtgtacgccatcatcgccgccgtgtccgtggtgatcgtcacggtgaggtccctcctcttcgccaccatcggcctcgacaccgccaacatcttcttcaggcaggtcctcagcaccatcctccacgcccccatggccttcttcgacaccaccccctccggcaggatcctcaccagggcgtcatcggaccagacgaacgtggatctgttgttgccgttcttcgtgtggatgagcgtttccatgtacatcacggtgatagggcgtggtgatcatgacgtgtcaggtggcctggccttcggtcgtcctcgtcgtacccttgctcatgctcaacctctggttccggaaatatacatctcgacgtcgagggagctgaccaggctggagtcgatca

SEQ ID NO: 73012 - DNA, 477 bp, Triticum aestivum
  Clone ID: PAT_TA_73012
attcggacgaggctgatggttacatagggtggcatcggatatcaagaggtgggcctttggttgtgaatcttactgggaaggataaccagagggtagatgcggctgccgagaagctgacaagcaggtttgaaggacaattttcccaagttgacagttgcaaataaggtgtcagagtacacacctccctatttttgccaaattctttccgcctgaagctctgagaattgtgcaggactaatgatggtgctcaactgctctaaaccgacgaccaaaataaaccaccgagctggtactactcttctgaagctacaaatattatttagggaacataggaattttgtactaggaattggtaactggctgggttctagcatattgtagctttgcatattttgactgggttaagagcccataattatacattccaaatcattatactataatttatacggagtagcataactttactgctaaaaa

SEQ ID NO: 73013 - DNA, 495 bp, Triticum aestivum
  Clone ID: PAT_TA_73013
attcggacgagggggagctctaatcagtgcaggatcttctggtcagtttgagtatgttcagaaactcgcttctggtggctgcgacaacacggtgaaggtgtggaagctcaacaatgggagttggcggatggactgtttccctgccttacagatgcacaaggactgggtgagagatgttgcgtgggcgccaaacctgggccttccaaagtccaccattgccagcgcctctcaggatggaacagttgttatctggacagcagcaaaagaaggcgagcagtgggaaggccaggtgctgtatgatttcaggacccctgtgtggaggctgtcatggtcactgactgggaacatattggcggtgtctgatggcaacaacaatgtgaccctgtggaaggaagctgtcgatggcgaatggcagcaagtgacgactgttgagccataataggtccatagaggtctctagagttgttcctcaccaatattccctaaataattata

SEQ ID NO: 73014 - DNA, 566 bp, Triticum aestivum
  unsure (1)..(566): unsure at all n locations
  Clone ID: PAT_TA_73014
gattcggacgagtctcgatcccctcctctctctccgatgcatccagtcggtagcacccggcggctgccagatccgtcctcccttcggatccaccagctcgacactctccgccaccgccttgcccaccatggcggccagcaaggcgtcccttggcgttcggccatccctgtacggcggcatcatgtcagcggctgcatccaactctactatcgcccgtcggccgcgtacagtgcccatggtgaaagagctacgaaactactgtgtggacgacgcatgcccggacgacagcgacacgatgcgcaatccagccgctcacatgcgctggatggagtaatatttaccgacgatgctcaatatggctgaacctgccggctgcacgcggtacatgctcacgcgcgacaacggtccgcacatgtatngccgcgtcagaggtgtcgctacggctcatcgctgagctgcacctatgagcacatgtttgcgcctgactgccttggcccgctcatggccatcgcagacactgtcatattcaaagattgattgatctggtgctctggatcatagctaca

SEQ ID NO: 73015 - DNA, 372 bp, Triticum aestivum
  Clone ID: PAT_TA_73015
cctcgacgtcgacttcaaggacgtcgccaccggcgggcccgacgcgctctccacccgcgacaagaaggtcgccgcctgcaagaccgccaaggctcgcctcgaggagaggttcaagacaggcaagaacaggtggttctttaccaagctccgcttctagatgcttggcgtccccaatagtgcctgctttagttgccgatttcttgtattggacactctctaagcttatctctgttttcgtattaccatgaagacttcgtgtttagacccggggctctcagagataattttactaagatgtgctattgatgtgttaaatgttgtcatggatagatctggttttaattttgtttgaaatacggcttgcgtgttctt

SEQ ID NO: 73016 - DNA, 376 bp, Triticum aestivum
  Clone ID: PAT_TA_73016
tcggcacgagggttcagtccggcgagcggaagaagctggtggacgccgggtacgtcatcgtcggcaacatcggcgaccagtggactgacctcctcggcgagccggagggcgatcgcacgttcaagctgcccgaccccatgtactacgtcggctagctcttcgatcatacgctcttctacatatatataataccccgatcagggctggagccaaagccaacagcagcaaacgaacggacgcgcgcctgaatgaataataattactgttcatcagtgtatcaaaataaatggcctaataattatacggcaaagggatattattatagagtactgtatgctttgccctgtggcttacaatcaaaaaaaaaaaaaaaaaa

SEQ ID NO: 73017 - DNA, 277 bp, Triticum aestivum
  Clone ID: PAT_TA_73017
cggacgaggtcgtccgtctcgcctgtcctgtctccttccttgtttcttccccaactcgtaagctcctacacgttgcaaggtctttgaatgattacgtactagtaatactgtactcgtggtttagacgttgggagtactaccaaacgatacgatggtttcaactacaactgccggggcaataacaatacactcctgctcctgttgagagtctcctcgtgcactccgtcgccgcccctctccctctctctccggcggctctgccgtccggcgtgaggat

SEQ ID NO: 73018 - DNA, 494 bp, Triticum aestivum
  Clone ID: PAT_TA_73018
attcggacgaggccactgcggcaatatgatctgggcagaggtacctggtcgccgctgtgtgatggaaacttcctcagcgccagcggcctcataccaaggccatacagtcttgtccaccacattgtcagttgttgccagcctctttactggatcagtggacacatctggacccgccaccatcattctgatccttgttgccagcgtcttctggagtgatcagttgatggctattcatctttccaagatctaagttaagtttgaatgtctctgctttgcaggtgatcacacaactttatgtggtttaggatgtactccctctgtaaaatagtactctattgtataaggctttttagatcactaaagtagtgatctaaaaagtcctatattagtttacagaggtagtggtttggctgtgtgtttgcctctacctgtgtggtgtgtgtctgtgtctacttttgttcagacatttgagtctaattcggatgaatttggaa

SEQ ID NO: 73019 - DNA, 561 bp, Triticum aestivum
  Clone ID: PAT_TA_73019
gattcggacgagggtgttttaattggtaagtctatcacatcatgaattatagtgtgctttgcttcgggataccaaatagttgatattttgtcttggcaactacttgatgatttgatgaactagttgatcaatcttagcttgttcttggttgtgtgaacatacttgtttttccttttgtttgcattgggggcgtgtgactgataattcccagatattgacaattgtctttatttgctgtgtttgctgatactgtgcatacggatttatactttctagcagtaaacaggtgtatactggcaattaatccaaaactgcaggaaacaaagaatcatttctttacattgatccactatactattacggtcttatttaaagtcctttcgctcaatggggactcatggatttcttattatttcatgtaggcatcgtcatcgtcgtcttcacattaacttccctactcgtggctgacaggtgattcagtgcttggcatgttccaacaactaaagattgagttaataaattctaccatcctgcatgggaactcatgttgttcgcaacttg

SEQ ID NO: 73020 - DNA, 562 bp, Triticum aestivum
  unsure (1)..(562): unsure at all n locations
  Clone ID: PAT_TA_73020
attcggcacgagggtcgcggcgtccgtcgctgggagcgccgcggtgttccgccacgtgggcacggcggcgcgcggcgcgcagctactggaacacctcctcggccccgcggagttcgacgcggccctagggctcaccgcgctggccacgagggagaaggcggaggctgccctcgagaagggaaacgcggatgaagcggaagcccttctgaccgaggttattgggttcaatgcttgtggcggtctgcatttggtgtacaggagcaggtctaaggcgagattggcaatgggggatatctctggtgcacttgaggacgctgaggaagcaataagaatagctcccagatttcctcaggctcacttattgcgaggcgacgcactttttgcaatgggtgaatattctgttgcggaagatgcctatgcacatgccnttggatattgatccatctattcgccggtccaagtctttcaggggcccgtgtggaaaggctacgagagaagcttgttggtgccaataatccgtagttcattttgaagcttcctttccatcagaagttccatccac

SEQ ID NO: 73021 - DNA, 590 bp, Triticum aestivum
  Clone ID: PAT_TA_73021
cgtcgcagccgtgttccgatgcttgacgtgcgagcaactggatcccgccacggccagctggaatcaagcgcgggcaccagtggtggtgggatcccaacctgggtggtggcaacgatgggatcctagcctaggcggcggcgacggcgagatctcgacataggggccggcggcggcggcgggatccaggtacttggaatgcctctagagaatgcatatgttgtggagagctgctatatctttctcatgttcttttaaaaatgccagaagtggaaattgatgtcatagagtattgtttttacctgtactgttattattctatagtattatgacactctagcagtgaaggcatgaattatctctttctgttttttattgtcttggaacaatatgacagaagagagcagcttaagaaaagtggtctgatgacaaagaacaatatgcagtgtaagtttgatgcctcatcttatttcttcctcgctggtgataaggaccaatacgcagctagtacaatcatagcttcacatgtcgagcttccagtacttgcaagttgtagatttgtagtgcaatggcttattgctagttgcaatatg

SEQ ID NO: 73022 - DNA, 516 bp, Triticum aestivum
  unsure (1)..(516): unsure at all n locations
  Clone ID: PAT_TA_73022
gagcatacactcatccggggtagaatctgatctcgaataagcattgtgctccaccagaagaaaaaactatggagcatctggatgtcttaatcctaacattcgggagtgcactttgtttgatgccttgaaagagcagtatattgggcatcatgagatagtcatccagagtttggtcagatttgaactgatttggcttacaatttgtaattttgcaatcagctttcctacaagcggtggcagacactagcccggcttgggcaagggcgcaactgctgatngaccgcgggtgggtggacaatggaggctgttgaccatcagcagctacgagttcaagttgtcatcataggctcctcaatttttactctcctgcttgtgctgagggaactcgatttcttgattctatctcaggaaaacaaccccaaccttaaaattataatggcatcccacactgtactttcctgaatcatgtcgtatgcaaggactcccttaaatattactccctctgaattacatgcg

SEQ ID NO: 73023 - DNA, 533 bp, Triticum aestivum
  Clone ID: PAT_TA_73023
cggcacgagcttgaatcgatttggcttacggtttctcgtcgatttccgcgtcgaattgaattgctctgtatgtcttgaatcttgttcgcatcgattgtttcttgctgttcttgatgactctgaccgacatgacatcaccagagaggagcagcgggggatgtgcgtcatcgtggccgccgctccaggaggccggctccagcccctacatgtcgtcgctctgctcgccgtccggcatccccgccgtcaagcgatatggcgacaggttcatccccaacaggtccgcgatggacatggacatgacgcactaccttctgacggagccgaggaaggacaagggagaacgcggcgacaccgtcgccggccagggaggcgtacccggaggttgctacctaagaagctgtttaacaaccacaccaggatcctcgctttccagaacaggctgcctgagcctgccaacaacttcctcgcagagctgcgtgccgatgcggcttccatccaggacaaaccggcgaagcagcgtcgatacatccctc

SEQ ID NO: 73024 - DNA, 521 bp, Triticum aestivum
  Clone ID: PAT_TA_73024
gagggtcgacgcggtcaccctcgccgtcgcctccgtgatccagccccccgccgccgtcgaggtccccaccgaggcgcgcgtcgcggtcgccggcgacgagctcttcctcgtcgtcaagtccaagtggatgtacctcttcggcgacgacgtcgacttctccaaggccttccacgtcaaccaccgcggcgtcaatcctgtctggcaggagctcacaggcatcggcgaccgtgcgctgttcgtggataaactccacgggtttgcagtgccgacgccggggttcggaaatcttgagggcaacacaatctattcagtgagcagcaaggatgtgaacaacaataggcgtcacactcccaccacggtgaactacagcgtgtcggcatttagccttgagagccgtatctccaagaaacttgtgtgcctgctcaacgccgggagatggcgaagcgtggtgagacggcatcgtggatcgtaccgagcttggatgaaggctgactctgcagagcttggacatcatcattatt

SEQ ID NO: 73025 - DNA, 544 bp, Triticum aestivum
  Clone ID: PAT_TA_73025
cgtcctccggcgtcttatccccacacgtcgcttgccgcccggagcaggactgttggaggtccacagacggcagtgatggcggaattgtcgacgtcttcggatggattggtggccgaagaagcgaggcagcaggaaccaggccaaggaagctctggaggtagtcatggtttgcaagacacaaaggagcaggaaataagaaaggggaaggcggctcttgtttccactgaactgctgagggaggatctggttcagagtgctgttacttttctgaaacacccaaaagtagtagcatcttcggatggacagaggcgatctttccttgaaaataaaggactcactatggatgaaatagatgaagcgtttcgacgtttacaaagcccatcatcgaattctgtgagctcagatatgtgcacatctcaaggggtgtctgatcattcgtgcaggattactgagcaggagagtagagctgacaaaaattgtatggacgattcaggagaggttgttacctgaagctgaacctgtggcccctgtggtacctcgtcat

SEQ ID NO: 73026 - DNA, 504 bp, Triticum aestivum
  Clone ID: PAT_TA_73026
attcggcacgaggcgcaggccgtggagccgccagcgccggcgaaggaggacgagtcggtctgctccgacgaggagtacgcgatgctgtgccgggagggcttctcacgggaggacgtcgccgccgtcaccatccaggcctacttccgcgcgcacctggcgcggcgggcgttcaaggcgctgaggagcctggtgaggctgcaggcggtggcgcggggcgcgtacgtgcggcggcaggcggaggtggcggtgcactgcatgcaggccatggcgcggctgcaggcgcgcgtgcgctccaggcaggcgctcgccaagcccaaggacaacgacgacaagctcctgctgctgcagaactgatcgatcaacatgcagcacaaaataaatctggaaactgatctgggcttctcgagcgaggcaagtttaaattggttcgcatgatgagttgttcaaacctgcctgggtttgacatctgcgattgttttcaatttcatggtctccttatttatg

SEQ ID NO: 73027 - DNA, 404 bp, Triticum aestivum
  Clone ID: PAT_TA_73027
cggcacgaggctcattatgcagggccgcaacgtcaagctgaatgagaaggtgaaggagcacatcgaggagaaggcggggagagcagtggcgaagcacagccagcttgtgaaggaggtggacgtgcgcctctccgcccgcggtggtgagctcagccgaggtcccaagatttgcaggtgcgagatcactctcttcaccaagcgccacggcgtcatccgcgccgaggaggacgccgagtccacctacgccagcatcgacctcgcctcctccatcatcaagaggaagctcaggaagatcaaggagaaggagaccgacgtccgccacctcaaggggaccaagccccccgtctccgactggccgccatcatcgctcgacaacaacgacgacgacgcccaggccagctcag

SEQ ID NO: 73028 - DNA, 485 bp, Triticum aestivum
  Clone ID: PAT_TA_73028
gcagttctcaaaaaatagatcacaatctaatttgtcctctccttgatccccttcttccaaggattgaatctcttcagttccaaaattcaaatcagtgcacaatcatcatcttaaacaaacacaagatccaatcccagcctccccggatgctttgctcctcaatatttaaatcccctcagtttcaccaagcaccatgatttttcataagaattgagtgttggtcagttggaagatggagaaagtttgaaacaggtcgagcggtcgtcaccatcggcgaggctgcgaagtggacgaacaacactcccttcacgcaggcagagcaagtgtttttccatgaaagagtcaaatactggacaagaagctcacactttgatgtttacatgaggctgaggcgctgagcgattttgatgtttgagaaaagttcctacaaacaaacttgagctctcaaagaactgcaagtgtctgatacatcgccaacctaatta

SEQ ID NO: 73029 - DNA, 607 bp, Triticum aestivum
  Clone ID: PAT_TA_73029
gattcggacgagggacgtggcctccggcgacaggagcccgagttccttggcgagccgtccccgctcagccgaccaagaaggccaggaacgtggtcccttccatccatcctccttctcacggccgttcctcctggccgggatgatttcatggtcgtgttgcagttggttccagttctgaccgcacgcctcgcatccgccgtctgtcgtccaccgtttgctcggttgccgccatggaaaagttaattcttcttcttttttttgtccttccagttttcctgctgatgtgcacctatacatgagcaattgattttctctaaaaaatacatgatgttgttccattcgctttctctaattgatgtggttgagcaattgattttctctaaaaatacatgatgttcttccattcgctttctggtctgatcctaaatatcatgtgtatcaaactaatcattgatactgcaactgaagctagcttcttatggagatagagaattactacactgctgtctgcatgcgtgtgaagctcttatggagataattacttacataccaaaaccatatatgagtccgctgtttattattgttcaccagaatgatgataaatttg

SEQ ID NO: 73030 - DNA, 622 bp, Triticum aestivum
  Clone ID: PAT_TA_73030
gattcggacgagcccgagagatggttcaaaacggccggaggagggtgcttgtcgactctttccatggacgaggacatctcttgtatcccagtacacatgacgaacaggaggaggcggctatggcaccggcggcgagtttttagcgctgcaaactgcaggtgagcctccgaatccaccttttagtttaccctcctcccgtgagcagatgcagggactatggtgaggctgcttatgtatgagcacggcgcggttgtctactgcgaggacggtgatcgtccgggactagagcgatcccgtgtgtccgtcgacgtacataccatgaccgaccgccggcggcgtgcatggttcagagcgtcaaggagccactggctcacctccacctcgttttacacagagagaagatttggagcagctgcagatatatagatggcacagacagaactgccatggtcgcaccattccgctggggttcatttagatggttttatgctgctattaactcgttggagctgcagtcagtttttattgcttcttttttctttggctgatcactcctgttgttctgcctgtgtaatagcgcgcctgtgcgtttgttttctgaactttgcatgtacctctccta

SEQ ID NO: 73031 - DNA, 539 bp, Triticum aestivum
  unsure (1)..(539): unsure at all n locations
  Clone ID: PAT_TA_73031
ttatgtttggggtggcgtgacttaaaagaaagtgaatataaggaatggtccaaaaacttccaagaggctagctgctcattggacaatagagagtttaaaatgtccgaagtttgtcacagcttagagcgagaccttcatattcttggtgttactgctatagaggatcgtcttcaggatggtgtgcctgaaaccattaaattgttgaggaatgctggaattaatgtgtggatgctaactggcgataagcaaaatacagcagttcagattggacttctctgtaacctcataacctctgagcccaatagtcaattgttgtctatcagtgggaaaactgaggaggacatactaagaagcctggagagggcattattaattatgaagaatacatccgaaacaaaggaccttgctttattnttgggatggttgggcactcgaaataattttaaagcattccaaagagtcttttactagatttggcgatgctgtcaaaaacagcaatattgctgtcggatgacacctttgcagaaagcacagtctgc

SEQ ID NO: 73032 - DNA, 601 bp, Triticum aestivum
  unsure (1)..(601): unsure at all n locations
  Clone ID: PAT_TA_73032
agcatggctgcattatataggagtagttgccgaagttcccctctcctctgaagcctcaacgaatcgccgccggtccctccgcccgccgccgctcttctctctatccagcgtgtggtggagatccgttctgtaacaggccatttcatctctgctataactatgagtctagcttgtctagtatgccatggaatgaacagcccttcaaactcctttagaagctactcagtctcaagctcagaaggggaaaaccgatgtggagctgtagtagcttgcctatctcggaaagtaatgccttctggagctgccaatggtgttgggacatcaaaggtgaccccttttcctctaatggctactggtcagggcaccgagggtgctcctcgccttcagcggagccatgctgtttcaagagacctcgtcagaaactggaacttcgatgagattgtttttggaactagagtagggtgctcaccgtttggtctagattggacaganactatcatctggcaggacaagccatcacttgatgaatttactagcatacatctgtgtatccatgtaatgtatcagcagtttagcactcgttccatcaacaagcaaatca

SEQ ID NO: 73033 - DNA, 290 bp, Triticum aestivum
  Clone ID: PAT_TA_73033
tcgcgcgcatgatgatgaccgccaccgccgacgcgcggaccttcttgtgatctgtccgtcggttcagccgtccggctcctccgtccccgtccctctcccccaagcatcaccacggccctgatgcgcgccggagatcatctaatcaaccacggcagccggcgagcgagacgcgatgccgtcttcttccttgtgtcaaagaagactcttttcggcgcgcaggatgataggctaccacctcatctactactagtaggacaggagtgctccattattaattaattattctatta

SEQ ID NO: 73034 - DNA, 610 bp, Triticum aestivum
  Clone ID: PAT_TA_73034
gagctcgcccacccgctcctccatctctaggtctgcccaattctcctcctcgtccaccagtcaactcgccagccgctgccccgtcctgtccccgctggcgtcctcctggtgagccatggctccgtactctccactccacacgcctccaccgggccctaccaccatccagcgcaccaccaccttggcatagctgtgcagctcctccccttcccgcggatgccaccgacaagatcaaagctccagcatccgccttatccccagctacccctggcaaggctccgccgccaccatgatgcctccttccattgggattttgcagtcgtggcatggtagcgtccagtctgttcgccaccgccagccacaagccgttcaacttcacatcactgggccgttagctggtagcctattgcaaaatctctcgctaaaattgattattggccagctttgcctgatgcatcggtcctggtgagacatgaagtactccctcggtgttcttctgcacctacccaagccccccatgggtcccagtaccttgttctcttcttttttttggaactgaagttcagatagaatagaggaagaaaacttcagatagttcttgcatataaat

SEQ ID NO: 73035 - DNA, 359 bp, Triticum aestivum
  Clone ID: PAT_TA_73035
gagggtttcctatgtttgtgcacacatatagttgatatattcatctatgcataattaccataggtttggtcagtttgactgggaactccagcaagagagaggttgttgaacaaaataatttgcaaaggcatagcactgtgtagaaaatggaagacatcggtgcttgttgaaatttgtcttttacctgccaacgacaagttgtagcgagaatgttgtggtaattgtcagcttcataatactcggatgtaatagggctgagatattgttatttcaacgtcacatcgaatctttagacataattataaataattaaatatagataaaaaataactaattgcataaaaaaaaaaaaaaaaaaa

SEQ ID NO: 73036 - DNA, 504 bp, Triticum aestivum
  Clone ID: PAT_TA_73036
tcggcacgagggcactggtaagtccgatctagtatgttattttggtttgcttcaattctagcaaactatgttcttgagccatttggaaaataagcaatttaattttgtattcagttcgagacccagcgcggcgagtccgccaagctccgcacatatcatacagtaattgattttttttttaatttacagatttattagctctaggatagttgaatcttaatctattggtgtatattgaattaatgaattctatgaaggcgctgctagcttgctatgaacgactgctttttaatagtagacatcttcattctttaagagattaaatttgtcatatcttatccgttcatgtgggatatcaatgagaatatgatatgtgtatggtgattaatgtgttcaagttctgcaacaactaaattttggctgaactccgccatgctttgcatcctcctcaatgaagatgacggtggcaccttgccttgtcgttgccggacacggtccatggca

SEQ ID NO: 73037 - DNA, 341 bp, Triticum aestivum
  Clone ID: PAT_TA_73037
ttcggcacgagggtactcagcaacatcgcaggattgattcatttttgttattgcgcacagcaagaactgggcgtagcagctgtcatacaaagattaggtggcctgatgaattgtttttgtagatatgcaagtttcgccaaggagttgtacgtgtacattggctcagttgtagttgcattctttctcggaaacaaagtttctgagcctgtaaataataggtagcgatcttagcctcgggtgtagagagaagtgtataaatgaatggacgtttccggtctcttgctttgctgtaatgctgttcatatgtggaatttgcttttgtaaaaaaaaaaaaaaaaaaa

SEQ ID NO: 73038 - DNA, 476 bp, Triticum aestivum
  Clone ID: PAT_TA_73038
attcggacgaggtgaggaggatgtctccacttcgaaccattcaaacgagaaattgtttgaagaattctctcaactgttagatgtactgccagaacacttgtttgatgagaacttcaacgacaaagaagttcccaaacgcggcaaagggcgcggccgcggtggcagagggcgtgggcgtggcaaccatcaatataacaataaccagcaccaccagaacaaccagcagcactacaatcaccatggcaacaaccaccttggtgggaaccgtggcagcccccaccctgttggcactccaccgcataacctgataaccaagcccgagcagtacccgcagctgccgattggggccaacaagcttccaccaggcccccgcatgcctgatggcacccggggtttcaccatgggcagggggaagccacaagctgtgctacctggtttgtgtgctgttggtgagtcttgatgtaatggactagtgt

SEQ ID NO: 73039 - DNA, 491 bp, Triticum aestivum
  Clone ID: PAT_TA_73039
attcggacgagggagctgcggaggcggaggctttgtcggaggcgacgatcggcggcaggaggcttgacggaggcaaggcgtacgccgctcctttcctgaggagccttaagctcacggcggccgccggctggagcaaacaaccaccaagcccaccaaccctagccggctaccccgaccgcaagttcaccaccatatgttggaatgagagatgcagacaagcagtagtatgttgggctctggttttctcgagttcaagcttaactacgcgcaaatccatcacctcggcattggggacgtggtcagctccgagagcttctccgccgggggtttcctgtggaggattaactgctacccgcgtggggacaaggtagatggcgacaacgagcacctatcaatctacctgcagctgctgaccaaatccaagaacgtcagagccatcttcgatgcttccgtggtgtgcagagatggcacgctgtcttcttcagatgcgc

SEQ ID NO: 73040 - DNA, 313 bp, Triticum aestivum
  unsure (1)..(313): unsure at all n locations
  Clone ID: PAT_TA_73040
ccgtctcttctccagccacgacgacgacgttcctcgctccccgtcggcccggagaggggggncgccgcgccgcagctccggtggcccctagctgcttctcctttctcgccttctgaatcgtcgttcttcttcggagcaaagccatacacatggaggagagtcgccgtcgtcgtgcagacccagcgggtcatcaacggattgaggagagccctggcgaagaaggagccgggcgtgtcctggtgatgcgtgcggatttggcatgcgggaaagccaggcatttttttctcaattcagactcgttttcgctttccta

SEQ ID NO: 73041 - DNA, 653 bp, Triticum aestivum
  unsure (1)..(653): unsure at all n locations
  Clone ID: PAT_TA_73041
gctgccactgatctccagggcatactttatcgctcactcatggagatggttgatgcagttgacggatacaagtttgctgacgaatctacgagcgatgtccgtgtttgctttaggcggaccggcggtcgcggcgagcagccagaacggtttccctgccactcgtccgtcctctccaacaggagcaagtatttcgcggacttgctgggtcaacaaagcgatgcccgttctggtggtagcaataactgcattgaagtccagtgcccgagggctgagtatgaccattatgtcaagttgttgaagtttatgtatctttcgagagattcgattgaggacgcaatcacctccgttaagtcggctctcggcgttcttcgagcagccacctctctcaaatnccgagttcgttgccgaaacctgcataggatacctggaatctgcttcctgggaagaaagggaggaggagagattttacagtttgctcagaccctggccccagaagctgctgcaccccttgttggcccgtttgcaagctcccagtgcgaacgctgtgaagactgttttcatctccgctgtgcgcttcgctgcgtccatggagacttcagctgctcctttattcgatgacatcaagactgctgctcaagagcagattgacttct

SEQ ID NO: 73042 - DNA, 492 bp, Triticum aestivum
  Clone ID: PAT_TA_73042
tggtagcactagcagtgcccgtacactgaacttcagccgagatcaggttgggaatattgcttggtcctatgctgtcattgggcaaatggaccgtccattcttttcacatatgtggaaaactctgagtcaattccaagagcaaagagtttccgatcagtatagagaagacatgatgtttgcttcacaagtttacctggcaaaccagtctttgaagcttgaataccgagatcttggactgtgcttaagaagtgatcttgaggagaaagtaacaagagctggaaagagcaaaaggttcaatcagaagacaacctcttcatttcaaaaggaggttggccgtcttctctatagtacagggcatgagtgggttagagaatatgcaatcgatggttacactgttgatgccgtgttagttgatgagaagcttgcatttgagatagatgggccaacacacttctctaggaatttaggtacaccattaggccacacagcatt

SEQ ID NO: 73043 - DNA, 543 bp, Triticum aestivum
  Clone ID: PAT_TA_73043
agttcttggaaaaaaccagcagacatcattgtaaataaaaccacaaatttctcttcagctgtcctagcagtacctgatgaacttgatgagctggattctcatcaagtgaaggtaaatcagaaagatttaactgcaggagatcaaggattatctttggagcataaagttggaagtaatgggggcaaagcaggaaccacaggttcacctgacaacaatcatctgaagcgtaaagctgaggaagagcttgagccacttgagcttgctgccccactagttcgccctcctgcaccaacgtccacgacccagaggagacccttgagactgagattgtcaactgtggtgcaacccaaacctgctgaaggaacttcatgaatcgagttgcttggagacatggagattattctcttcaagggagggaggccgcctcaagctatccggtcctgtagagctgtgtaacggtagcaggaaaaaggcactgaaatgtctaatagagcaacatgtaaactaaatattgatgtaaaatccaaaattccaagttctaat

SEQ ID NO: 73044 - DNA, 401 bp, Triticum aestivum
  Clone ID: PAT_TA_73044
cggcacgaggctccagtcccagcaagtctttgagcaaagctgccaccgtttccagtcccagcaagtctttgagcttcatctcgttctgtcacgacacagatgcactgcttcgagcagcagcgttcgcttgtaaatttgtgtgctgaaagcctgaaactgaaagcttactctgctctagtgagactgcccttctcatgccgatgttaaagctttattgctgctctcttgccgtcggccgtggctcgaactttattatttttggctgccttacatcttatggctcctaattgacggctaaaatctacttgtagcccttgaactatcacgagtggctgattttggcatctaaactagaacactgatcaaatttggtcctttcaactaaaaaaaaaaaaaaaaaa

SEQ ID NO: 73045 - DNA, 616 bp, Triticum aestivum
  Clone ID: PAT_TA_73045
gattcggacgagggacgactattgggccgccgccgccctaggccaggtgctgaggctttccttggtctcttcgccggcgacgagcaccccaccagtgtacatgtgtacacccatgtccctttactggatccgccccctgtgtagcagatggcgaggataaagcccaagcaattgctaattcaaagcaagacgaagaaggctccatctcggatcagctactctactatcatcacatggaacttgattgtcatattgattgtgctatctctctatgctacctacagccattggcatcaaaggtctgcccaagactttgaaatggagcttcatgaagctgagcttgctgtgagaccggtggatccaaaaatgataagtagaccaagatatgcggtaatgaacaccgcaaagggtccaattactatagaaatatacaaagatgcttctgctggtgttgtggatagatttattgacttgtgcaagagtaatcatttcaaaggaatgccatttcggcatatcatcaaaaattttgtaattcaaggaggtgattttgatttttgatggagctgcccaagaatggataacgaaagctaaagctagtgggaaaaatgatctcagt

SEQ ID NO: 73046 - DNA, 381 bp, Triticum aestivum
  Clone ID: PAT_TA_73046
cgcattccgcatcctccggcctccgcctccagctctccaccacgccagcgccgcctccgccttccaccgcgccggagccgcctcgcctccgttctccaccgcgccggcgccgcctccgtcctccaccgcgccggagccgcctcgcctcgacgcctccgttctccaccgcgccggcgcgccggcatccatcgcgctgcggccgccgcctctgcctcggcaacgacggctacatcctagttggctgttcgtgtacttatttactactgcttgatttgcttcttgcttgatcacaatcggtgaactactgaacttatttactactgcttgtgcttgatatgtgatgtaatgttactcatcaacctagaacttcagttctgagaa

SEQ ID NO: 73047 - DNA, 460 bp, Triticum aestivum
  Clone ID: PAT_TA_73047
tgtaacctgtgattcaacgctcgccatttccctccatttcaacaacaccatatcaagataaaggattttttaccttcattttcatttctttattttccagcttacactttcacctcttgattaataccaccgtcaaccaatctcatcatcaccatgaaacgtgctaccctgtgttcatttggaatcttggttattcttgttcttgccatgtcacctggaagtgacggaggtcgtcgtaaaattttgatggctaaaaaattggccgctctacttttactcaacaagaaacgttacatttttgtagctccatttccattaccagttcctttaccagtaataaccaaagttaaacatattattcacaaagaaaaggtgccagttccagttccagttccagttcaccaccaagtgactaaatatgttgctgttcctgtcccaacgcctgaaaaatcgtggccag

SEQ ID NO: 73048 - DNA, 505 bp, Triticum aestivum
  Clone ID: PAT_TA_73048
gagagagagagagagagagagagagagagagagagagagagagagagagagagagagagagagagagagagagagagaggacatgtggtattgcccctgctgcaagaagcatcaacaagcaatgaagaaacttgatctctggaggctgcccgaagttctggtgatccacctcaaaaggttctcctacactcagttcacaagaaacaagctggagacattcgttgacttccccaccaccgatttggatctgtcatcctacatcgctgacaagagcaagcagccaagcagccattatcgcctgtatgctattagcaaccactacggaaacatgggagggggccattataccgccagcatctatcacgaggaagggaaggggtggtataagttcgatgatgactacgtgactcctatgagcgaagacagtataaagacctcggctgcttacgtgctgttctacagacgagagtgactgaggatacaatacaatggcattttctgcttg

SEQ ID NO: 73049 - DNA, 546 bp, Triticum aestivum
  unsure (1)..(546): unsure at all n locations
  Clone ID: PAT_TA_73049
ggctgcggttgcatatccgtatccctctccaccgcaaccacacaccaccactgcacgtaccaggcatatagcagagcgttgacatctcctcttgtcctcgatcgctgccacgcacacgggcgaaagctgagagagctgagcaagcaaagatggcgccgccggtgaaggtgttcggatcggcggtgttcgccaacgcggcgagggttatggcgtgcctggaggaagttggcgtggagtatgaggtcgtcgaggtcgattacacggccatggagcacaagggaccccaacacctctccaaaaacccgttcggccaaatcccagcgtttcaggatggggacatgatgctcttcgagtcccgagcaatcgcaaagtacgtgctccgtaaatactccaagtcagctcagatcgacctgctgcgagaaggcaacctgcaggaagccgcgctggtggacgcgtggnacgggaggttgaggcacacacctacttgcctgccattgggcccatcttctacgagtgcgtcgtgtaccctgcgaggctcggcacctc

SEQ ID NO: 73050 - DNA, 475 bp, Triticum aestivum
  Clone ID: PAT_TA_73050
gagggtttgctcatttcatggagagctcttctcacaagcgggcgcgggaggtggtggacctcaccgccgccgggcccggagaggcagccgcgttgccggaggcggacgcgaagaggctgcggccgcaggatctcctggacatgctcgatgacgacaccgacgcggccgccgccggcgacctagcgtccgtcatgcggagcctggaggaggagatagctagcttcgacgaggccgtgggggccgcggaagcggcgcctacgcagcagcagcagcagccggagctggggttcctgctggaggcctcggacgacgagctggggctgccaccggctggcgcctccgcctcgtcgtcgtcggaggccggcggcggcggcgggggcctcgccggggcgccgccggagtccgccgagctggacggcggccagatctggggcttcgaggacgagatagacggaggagcgggcttcggtggcta

SEQ ID NO: 73051 - DNA, 320 bp, Triticum aestivum
  Clone ID: PAT_TA_73051
tcggacgaggcttcgttccctgcgtgaaagcttccagaaacaagggaaccggagaggcggagaccaaggaaaggagccgagtcgcttcaaatggtctgatctccggccgagggctctcctcccggtcgatcctccctccctccctccctccctcccttgcatggcgcgcgaggtcccgctcagcatctaggcgggggagatgggcagaagggaagaggcagtgacggacatgcacaaggtcttcagcaggagcatcgtgcacagcgattgaccattcggagcagaacacgagggatgatgaatatgagaggatgggtata

SEQ ID NO: 73052 - DNA, 524 bp, Triticum aestivum
  Clone ID: PAT_TA_73052
attcggacgaggctgtcgatgatgatcgattgctgccaccttgtcaaacatgggccacttgcaattggcatcaatgctgcgtacatgcaaacatacattggtggtgtttcgtgcccgtacatctgtggcaggcaccttgatcacggtgttcttctcgttggctacggcgcatctggttttgctccaatccgcctaaaggataaggcctactggatcatcaagaactcctggggcgagaactggggagagcatgggtactacaagatctgcaggggctccaacgtccgcaacaaatgtggcgtggattcgatggtctccaccgtgtctgccatccacacctcaaaggagtagattctgatcagtagtcccccgaccatcctgtggatggtgcacagttggtgattctgatattatatataagctagaactacgaaatatacttagtttatgctccatctgcgctgttattgcagttatgataagcagcgatgatgtgaagctgcaactgaatgtttgtcctaagt

SEQ ID NO: 73053 - DNA, 493 bp, Triticum aestivum
  Clone ID: PAT_TA_73053
cggcacgaggcttgcgagcatgtttgaaatggaagcggctgtcattttttggtagcagtggacaaccatggcacgcttcttttggtgctccttttatttttatctacttttttccggtttccgaaaaagaagagtgggaagtggtgcgtaccaaacagccagcattgcagcaggaaaaatgtgcgcggcacgagcaagcccagcactagctcaccagcaacgtgctctcgcaagtcaacaatgtgtcgacatgatggttaacatagctactccatcaggacggcggactcttcttcaactaaaactgccttcgtttaatttcacaagtttactctttatctcatcggatgtttgaacacatatatagagtattaaataattaattatatagattgtgattatttttgagaggcgaatattttaagcctaattagatcatattttgacaatatggtgctacaataaatctatagtaaacatgtgcttgtgatag

SEQ ID NO: 73054 - DNA, 410 bp, Triticum aestivum
  Clone ID: PAT_TA_73054
gattcggacgagggagagagagaactactctcgagtttttttttttttttttgatcgaaaacaacctttatattcacgtcaatctggaacatacagggtaccagtggaggtgccgcctgaaagttaagttcagaagctttgcacggggcacgattgagtcaaagaaccaatgaacatttcaatttttccactacccatctgagtcgagaaacatacaactgagcaacctaccgggtgtcacatttacagggtggggaactcgcctccgagggaggcgataaggggctttcttattgcttggatacaatctttacagcatactccctatttcagggtaagggtgcgaggtctttgacttccatgttcagttctcagtatcctctgggatcttgaagaggaactgcggtagc

SEQ ID NO: 73055 - DNA, 538 bp, Triticum aestivum
  Clone ID: PAT_TA_73055
cggcacgaggcagcggcggcggcgacgccgagtcatcccctcctcgcttctctctctgtgcgcacaggctcagccaccagatgtgatttgttaatgtatattgattgttagcctgctcttaggcaaccacagaacaaggactccaaggacaacatttaatcttctaatgttgcatccacgcaaaatgcacactgcagactccaaggacatcatttcatcttctaatgttgcgtccgtgcacaaagcacaccgtaatatgtgcttttgccttaaccactggataaatgctgccaatacagtcaaaatttacaaaggatcctaatttcaaaaaacaactgttttgtggaaagtttccctgaaaggaggctccagccttcgatctactgcctcaaaaagagtagggagataagacaatgttgcagtgcaaacgactgcatcagctcctggaccgacaaaggcaaaatgcagccgctcattattaaccaaaatactaacagagcagcatcaagccatcagccagcttggcagtctacctaat

SEQ ID NO: 73056 - DNA, 597 bp, Triticum aestivum
  Clone ID: PAT_TA_73056
gattcggacgagggacattgctattttggacggttcaagctgcacactctcccaatgcttgaaagcttggctgtcattgacacttcagtgtcttacaatcttagctccttcccatgcctcaaatacttgaatattacccgatgctatggcgtcttcaaaagacgtagagttccctgtatacctggttggaacctcaatatgtttcttgggggcaacccaggaataactgatcttgttgtccgctttactggatatgatagatggtttaagacatggagctccgcactgttgttacctaaactcaggaggctcctgatcgctgatgtgccttcatcctgggatgtttcttggccccgtctcctcatcgaagcggcaccgtgccttgagagccttcacatccatattagccgttgggaagaggatccttgtgatgacatcgtatggcaatcccctaagttctgccacaatcagcttaaggagttggtgataactggttttgagggaacagaaagacagatttactttgttagctttgtcatgaaagtagcaacaaagttgcagtctgtttctttgttaaaaaatgggcttgttcagggc

SEQ ID NO: 73057 - DNA, 693 bp, Triticum aestivum
  Clone ID: PAT_TA_73057
gaggttgcaggtcaccggccatccatcctgcaacccaatctcttctcaatcccgcccctatgaaatctttaaatctcctcttatttcaacttttcacatccagggccgtagtgatgatctcaggtaagccatgtgtgtttctattttccattagattggtgtgcccctttgatctagaaaaagatgtcggatctgcatgttcttttgatctgaaaaaggttgcatcacaatagcattaataattcgtgtttttttgtgggaattactaatttgtgttttagggctctataaaggcttttgatttttgttgtaacattagtattttttctcactatgtatatgtatcaaactcgcattgttattcttggagtaccatgtatacagacctcttttttgtatttcattgcaatgttatgatcagtgatgcaatccaatttctcctcacccaaccattagaactcttcttatttcaagtttttaaatatagatggttgatgcatcatatgaggaggtgtagtatgcatgatggtttcaagaaaggaggcctcgattggtacttgagaccgtcaagttgagcaattacattggtctggtggcaccgcaagttacaatcgaagccctactcgaggcagtctcccgttattcatgccccactccactggtaacatggagtcttctcatttgtaatggcat

SEQ ID NO: 73058 - DNA, 361 bp, Triticum aestivum
  Clone ID: PAT_TA_73058
tatttaccaagcgcttgagaaagttaatggtattgctgaaaatctaagccgggaagtctttagagatactttaatcgaacaagctgagcagggtgttgattacttcacaatccatgctggcgtgcttcttcgttacattcctcttacggcaaagagaatgaccggcatagtttcacgtggtggctctatccatgcaaaatggtgcctaacatatcataaggagaactttgcctatgagcactgggatgaaattcttgatatttgcaatcagtatgatgtggcattatccattggcgatggtttgagaccaggttctatttatgatgcaaatgatagtgctcagtttgcagaattgctgact

SEQ ID NO: 73059 - DNA, 381 bp, Triticum aestivum
  Clone ID: PAT_TA_73059
gattcggacgaggtccgcggcagtcctagattctttgctggatgggatcctaatcatcctagtcaggtgatgcaggacggaggaaaagagcaggagctgcagcaactacagatagtttcccctccgagttcatccaaactgcagtttctccatacagatgaggccatggggctccttgttgtgcccatctgcagcttcctgtcctcctccctcacccacttgcaccttgatgggatctcccaagagatggaacgcttcaccaaggagcaagaggacgctctccacctcctaaccttcctccagcacctccagttttatggattcatcaagcttcagagcctcccttcagtactgcacaagcttaccaacctcaagctatta

SEQ ID NO: 73060 - DNA, 283 bp, Triticum aestivum
  Clone ID: PAT_TA_73060
tggggttggagcagaactggggctcgatcggccgcgccgccctgtcaccatgcacgctcgctcatggctctgctccctgtctcgtcgtggtcactgccgtagtacatgtttagtaggctcgtcgatgtagctctgtacaggtgatggagattattgttaccggcgactcttatcgtcttcttagttacattattatcctattatgatcagatcagctgtaggttttgtatacgctgttcattgattcgtcagactgctatttttcatatatatatatatggat

SEQ ID NO: 73061 - DNA, 518 bp, Triticum aestivum
  Clone ID: PAT_TA_73061
attcggacgagggagagtgggagtcggtggcgctgacgctggcgggcaccgccggcaacaacatcggcaaggtcctgcagaagaagggcaccctcatcctccctcccctctccctcaagctcaaggtggtcaaggcgtacgcgtctaaccagctctggatcagcggtttccttatggacatgtgcggcgccgcgctcatgctcaccgcgctctcccaggcgccggtctccgttgttcagcccattgctggttgcggtctcgcaatactctgcgttttctcccatttttacctcaaggaggttatgaacggcctcgattggattgccatcacgctagctggtctcggcaccataaggtgtggggtggtttgaagccaagaacaaaaagttgatcagatacctcttttaaatataccctggctagtgctctccattgtcatcttgtttgtactgctcaacacatggcttcatatgtataaaaagcaaaggcgcgagcaagagttgactggacctgaagtg

SEQ ID NO: 73062 - DNA, 520 bp, Triticum aestivum
  Clone ID: PAT_TA_73062
attcggcacgagctgagcctaggtagggctacgacgtgttgatcttctaaggccgggcatgacccaggaaagtgtgtccggccagagtaatcaagtgtgttggaaaatgtggtgcacccctgcagggaagattatctattaatagccgtgtccacgataacagacgttcagacttatatcctgatctattacaacagaaaatggatgcttggatatgtggctccgggattactttctcgcagggagtcgaggaaggatctctggacattaagtttacaacatgcttgttaatataaactgctattctttactcttctacatgctgcaaaatgtttggagctgcttgaagatgctagtctttgataggctaggccttcccctttattctggcattctgcagttcagtccacagatacatacattcctttgataccaatgcatacttagaatatatctgatgcttgcgagtactttggatgagtactcacggttgctttgctaccccttttccccttctttc

SEQ ID NO: 73063 - DNA, 469 bp, Triticum aestivum
  Clone ID: PAT_TA_73063
gctcgtcgacagttcggctgccagcgcctcgacgacgcgctcgtcgcccgcgtcgcccgcctcaccgcccgcccccctcaccgcttcctccgccgcggcctcttcttcgcccaccgggatttgaacgagatactggatttgtacgagaagggggagaagttctacctctacacggggagggggccctcgtcggaggcgctgcacctcggccatctcatccccttcatgttcaccaaatatctgcaggatgctttcaaggtgcccctagtaatacagctaactgatgatgagaagttcttatggaagaatttgactgttgaggaaactaaaaggcttgcccgtgaaaatgcaaaagatatcattgcttgtggatttgatgtcgaaaggactttcattttctctgattttaattatggttggaggtgctttttatgaaaacatggttaaagttgccagatgtgtgacatat

SEQ ID NO: 73064 - DNA, 380 bp, Triticum aestivum
  Clone ID: PAT_TA_73064
attcggacgagccgcggcgaggtgcgtggtgttcttgccgccgccggaggcgttcctggacgcgcccgcgccgtcgtgggtcctcgccaccgcgcgctgacgggggccgagatcagccgcggccgtgcgtttagattcgcgagtagttagaactctgtgcagatggctcgctgaactttcttcctttcaacagttttaggatctgatgcgactgttttagatctgctacctttccggtctaattttgtttagtggaattgatccaaatttacaagtttgtgacttgcatttgtagctgggtgcgttggttttcctttggttacatagctttcttagtttcttgttttcatataataaagttgcatcaaccggtttcgtca

SEQ ID NO: 73065 - DNA, 513 bp, Triticum aestivum
  Clone ID: PAT_TA_73065
cggcacgaggtgcttcctgtgctccttaagtgaaggatagccccttactcagattcttggctaccggcgtgttatgttgtaccactggatcaacaagggacgacctctctttggcgagcgaggtgtggtgtctcaccattgaacaggtctttttttttccagcaaacggttgtcgattagaatttggaaactaccacagctacacaggatggcaaagacagtccacctgcagcgctatcacagtgcaaacccaagaggttcgattgaactgcagcgtgcgagggtgcaacctttgcagtgctatcaccaagattaatccagcagctcctgccgagtgaaacagcacaacaagatattgccagatgacaaaaccatcatacacgcagattgaagctatccatgtataatacgcatgctcatgtgcacatcaataccactacttgcattgttccctaatgtatgcagccatcaatggccataaattatacagctaaatgttgctggacctataaa

SEQ ID NO: 73066 - DNA, 296 bp, Triticum aestivum
  Clone ID: PAT_TA_73066
gcaggagcggcgcctcagtgccacaggcagcctgtgccatggcggcggcgtacgtttcacgatcgtgggcaagtactagcttgcttgtttagtgtttggactttggatgcttattttgtactagtactagtacaaggtcgtgattgtgatcactagctcgatcgatgcgagataagtatatacgccacctccaatggtttgacaattttagtttggcatttattgttgtttgccaactcccaattgcaaatgcaaaggaaaaaatatagtcattcccaaaaaaaaaaaaaaaaaaa

SEQ ID NO: 73067 - DNA, 355 bp, Triticum aestivum
  Clone ID: PAT_TA_73067
gaggtgctcatgactgcttcagcgtaatgaagtaccgggaaacctattcccagccaatatatccaattccggacaggagccactggaacaattcatctcccgggttacaaggtgtagtcagcaaggctgatgtgatccttagcccacccaatatccggaggcctcctggtcgacccaagatgaagattctaaagatagagagcatgaagcgtccgaaacggatcattcagtgtggtcgatgtcatcttctagggcattctcaaaagaagtgctctttgcggatctgatgcatatccattgatgtacactgaactttgttttattgataatttaggaatttcattcaaaaaaaaaa

SEQ ID NO: 73068 - DNA, 487 bp, Triticum aestivum
  unsure (1)..(487): unsure at all n locations
  Clone ID: PAT_TA_73068
ttcggcacgagggcaggccgaggcggccccgggggcaggagcaactacaagaccaagctgtgcgagaacttcgtgaagggaacctgcacgttcggcgaccgatgccacttcgctcatggcgagaacgagcagcggaagggcgctgcttgagagccgaaacgcatcttgggcgcggcgcactaattctccattgccttttgtgactatatatatctctgcatctttaggtgattagcctgttgtattgcgattttctatatggattgttacgttttcggttcagcttttgatagatgtctaagaagcaaataacttagtcntttctggggtgtatgccagtgtagagctccctctttcagtatcttcaccctcactttattcatctatagtagtttcatcagttgagggacagtnggagttcattttgcccaaaactgagacccttgaacacttggttggatgatgctacgcttctctgaacctgtgc

SEQ ID NO: 73069 - DNA, 523 bp, Triticum aestivum
  Clone ID: PAT_TA_73069
cgtcacgaggctcaatgaacagagagaggcggcgatcaagtatacatgacatcaccagtgtgaacaatggagatgcatcaacggcacagggtccaatcacaggtcaaacaaatggtcaggctgcaaatcctgggaaaccatctaagcaatccccacagccagcgaatacacctccaggcgtcgatgcttatggcacaacaattggacagccagttggtggccctcttgtctcagctgttggaactcctgttacactacctgtttctgctccacctcatctggcctatggcatgcatgccccggttccaggagccgtagcacctggtgctccagtaaacattgctccgatgccctatccaatgccacccccatcatctcatgggtgagggacacatttcaaatgctgcgtggcgtctaaagaaactacacccataatctcctgtgtcagcgtttaagcgggtgtgctgccatgtctcaataaagcaataccaataaactcttgtacattacaaactgttattac

SEQ ID NO: 73070 - DNA, 497 bp, Triticum aestivum
  Clone ID: PAT_TA_73070
gaggctccatctcgaccagttgataaggcacttcgacttccacttcaagatgtctacaaaatcggtggtattggtactgtacccgttggtagagttgaaactggtacaattaagccaggtatgattgttacatttgcaccagttaacttgacaactgaagtaaaatcagttgaaatgcaccacgaatcattgactgaagctgtacccggtgacaatgttggtttcaacgttaaaaacgtatctgttaaagaattgagacgaggttatgtagctggtgacagcaaaaataatccacctcaagctactgaagagtttgctgcccaggttattgtattgaaccatcctggtcaaatttcaaatggttacacaccagttttggactgtcacactgctcacattgcttgcaaattcaaggatatcaaggaaaaaattgatcgtcgtagcggtaaaaaattagaagataatccaaaatcaattaaatccggtgatgctgctat

SEQ ID NO: 73071 - DNA, 314 bp, Triticum aestivum
  Clone ID: PAT_TA_73071
gctgacacggtgtttgagggtatcattgatgagtttcatcttggagaggtgcaggctgcttgtcttctttctgaatcatgttcctcctgttttctccctgttgggagtgtatagagttctccctggtgggctgtgtaatcagcgggttatcttagtccatgtatagattccagttctgtttccttgagagctgaccctgtaattctagctctattttcctagagctgatacctagagttttccctgtttaaataaagttcatccccaggcccttcaagataacactactccccagattaaaatgtgatggtgtg

SEQ ID NO: 73072 - DNA, 480 bp, Triticum aestivum
  Clone ID: PAT_TA_73072
gtggaggtggttttggtgaaagctctgctgatccatgggttgatgagttccaagaacacatgtcgtctttcaaacaaagttcgggcacctctcgaggggtttatgttttttctgagaacaacccgtatgttggtcaccctaatccaatgcaggaaggacaggagctcttccgcaagggcctcttaagtgaagctgttcttgctttagaggctgaagttttgaagaatcctgataatgctgaaggttggaggttgttaggcgtaacacatgcagaaaatgatgatgaccagcaggccattgcagcaatgatgcgtgcgttggaagctaatccgacaaaccttgaaattcttcttgctcttggtgttagtcacacaaatgaattggagcagggagaagcgttaaggtatctttctaggtggcttcagaatcatccaaaatatggtggccttgtccctccgcagtcaactggattcaccttat

SEQ ID NO: 73073 - DNA, 306 bp, Triticum aestivum
  Clone ID: PAT_TA_73073
gatgacgaaagcaccccaattcaagaggattgaaggcatggtgacatggctatatcgccttgggctggaaccattatttgagtttggtttgccagttttcgtgggggggagaaaagagctagagcctgtcgcagtacaccctctctggatcgcatgcctagtatcaagtattttatgtatcctgtggaatgtggatgctaacaacaatttttttagatgatggtactgataagagaatcagatgttgtaaactatacattcgtgcatgttggcgaacaaaccgttcttaaaaaaaaaaaaaaaaaa

SEQ ID NO: 73074 - DNA, 444 bp, Triticum aestivum
  Clone ID: PAT_TA_73074
gattcggacgaggcgtaaaacggaatctgcacacctacgatcaggatgagctcctggagaagccgagggcctgcattttgtcggcgaagctggccagggaagggttccagttcaagcacaacaccctggatgagatctacgacaatgtcatcgagtacggcaaggccttgggtattctgcccaactgatgagtcatgagacacacacatgacgtttgcatcgtcgatcgctccaaggaccacggcgcgaagcattttgattttcacattttcggggctgtctgtatggagcatgtgcatgctactacttgaatgttcaatagcaaatcgacaggagcaatgtacaaaacacacctcgtggtattgtgttggtcatcagtcggttcaaaaaattgaaagaaggttggctgaataatgtcctccattgctattggttgtacttata

SEQ ID NO: 73075 - DNA, 490 bp, Triticum aestivum
  unsure (1)..(490): unsure at all n locations
  Clone ID: PAT_TA_73075
gagctcgcccgcccactacccaatctcaccctaaccatcatccgctgactgactgaccgactgactctctctccgagagagaaacagaggagtgcaaccaacagagcgggagacttttctttgtaagaggctggagatgaagctgacgattaagagggtacccaccgtcgtgtccaactaccaggaagacgcttggcgagcggccacgcggagggttggggggaggaactgcctcggacattgctgcttgcctgtttctgagcttcctgtctatgctttcaaggcaaatccaacaaagctgcctttacaggaggatgctgttcctactgatttcttcatcaatctcctccttgggcagtgggaggacaggatgacccaaggcttatttcgatatgatgtcactgcatgtgagaccaaggtgatccctggcanaccttggtttcgttgctcaactaaatgaagggcgccacctcaagaaacgtcctacaga

SEQ ID NO: 73076 - DNA, 390 bp, Triticum aestivum
  Clone ID: PAT_TA_73076
gagggtcgtctgagaagtataacgacctcgatgcccctgatgaggaagttactgtccttgactacagaagcttgtaggttcgtaaagtttcctccgtgctcccattggagaatcgggttgccttctcttatgaagacagagatggaaggttacgtacaagtaaaccaatttttgggtcaccctgtagtctgttagattttgttgtaacttgaatggctggaacttcaatatttgctcttgctcctgtcgaaccatatactccgtgaatgcactgctgttactacagttgttagccaacttttttttgacacaatgctgtaatattcatttacaaacatttttttaatttccgattgctgattcgagctgaataaaaaaaaaaaaaaaaaa

SEQ ID NO: 73077 - DNA, 613 bp, Triticum aestivum
  Clone ID: PAT_TA_73077
gattcggacgaggctgctctcatctgttgtttccctctgaagtttcccgtgttctttttaaaattatataaaaagtcatataaatgttcagttatattttttttctaaaaatacctcttatgtctcaattcaccacgcgccttctacctatgtttgtcgatttaattatgtagacttatggcatcgatcaatgcgtacttatgctagatgttgcatttagaaatattagaactgctttttccaagcagggactatgccaccaacatctttacctatgtatttatgatttgtagtacgcatccttttcttacaattttccttgaatttctgtgattttgcagccctgtgttgcctatttagtttatcattttgttcaagtaagttgtagtagtgtaaaaccaaaatatttcttatttgttccaaggcatgtttcctgctcaccaagcaagttgatgctttgtttcaggaaatataggacagataaacagatgactgttttagacaagttcaccctatcgatggcattaaaatcagatgctcaagatggatgatagtaacaactaagcaagtgggtcctccaatgtttcatcatttacggaggagctcataatgt

SEQ ID NO: 73078 - DNA, 493 bp, Triticum aestivum
  Clone ID: PAT_TA_73078
gagggagagaatagtctcgagtttttttttttttttttttttttttatcagctcacatgcttatttggttattacccactgtcacaaaagatgaactactacttgagaatgggtacactaacaaaacatccaccgaaatgaaacagaaaacagttccttgagattctaagacaccaaaagggagtgaaattgcatgatgaaacagaaaataggataaagattgtaatatgaagcgcagatggtgtgactgcaacgggttgcatcacgcgtgcgagctacgaaggatcccgtggaagtagcctccgaccatgaccagggatacaagggacacgacaccagctgggaatatcttcccggacttcttgaagcgcgaccccatcactgacagaagcgcagccgctatacctaaaccgatcgacgatgcaaagacaggtcgcactgggagttgagtatggacgaagtacagaaccagggctgatatgcctcctgcagc

SEQ ID NO: 73079 - DNA, 478 bp, Triticum aestivum
  Clone ID: PAT_TA_73079
agagtgttcttgagtgtgatattgttctcgtatctgctggcagagtaccatacacctctggtcttggattgaacgcccttggtgttgagactgacaagggtggaagaatccttgtcgacaagcgctttatgacaaatgttaagggtgtttatgcgattggagatgcgatccctggacccatgcttgcacataaagctgaagaagatggtgttgcctgtgttgaattcatcgcaggtaaagaaggtcacgtagattatgacactgtacctggagtggtgtacacacacccagaggtggcttctgttgggaagacggaagaacaggtcaaggcatcaggagtggcctaccaggttgggaagttccccctgttggccaacagccgtgcaaaggcaattgatgatgctgaagggttggtcaaggtagtggctgagaaggagaccgatagaatcctcggtgtacatataatggcccctaatgc

SEQ ID NO: 73080 - DNA, 414 bp, Triticum aestivum
  unsure (1)..(414): unsure at all n locations
  Clone ID: PAT_TA_73080
ccagggtaccacccacgaggcttccaaggaggccaacaaggaagtcgccaaggacaacaacgccggcgtcggcactcgcctccaagccgctggcgacgccatcggggacaaggccaaggagcacaagtacgacgcttcggccgaggccaacaagcaggccgccacccactaaaccgcccaactttttcggaaggaatccaccttctctttccgctcgccaaaccaaaccagtcacggttcagatttcgccatcacggtgatgatatcgattgggacttgatttgaggagagaggggaggaaggagggacaggcgttgctttggaggatgggaagggatangtcttgatttccgcattccaccaccatcccttggtttcttctctttttctgttcgggttttcgggctgggagag

SEQ ID NO: 73081 - DNA, 514 bp, Triticum aestivum
  Clone ID: PAT_TA_73081
tattgcaggcaaaaaaagaagtccacaaagttggtatgctggactatccgacgagcggcgagctgagtacatacacaaacagaagatggcccgactcgcaaggaaagcagcaactgccggggtgaatgtccaattgcctacatcatctgcctcgcaaacttcatctggtccttctgtgtgtcgctgctgtcagtatcgggcttactgcttggagaacaggaggagcgtcagggctctttgctgcatctgtgggggtactggccagaagtaggttattgttatccatgtatcacacaagctgaggtggtcacctttgatctaatacccgcgagtcttctatattgtcttcatcctattcgtgctaaaacatactcaggggcgatcgcccacctgaacgattaaatggatcaatattctggacattacaagctgggccagagtgggccatatggaggtacatcaaacataggaagggtggacaggagcaggcacaaaaggacctacaccaatgtac

SEQ ID NO: 73082 - DNA, 490 bp, Triticum aestivum
  Clone ID: PAT_TA_73082
tcggcacgagattttcgctctattctttcatctattgacccaagtattgtattctcaggttagctgtgtttattcacttttttatttcattattactactatttgatgttactttgttcatctgtattaccaacttaacaagataaattgttggagtaaacaaattatacaagtgcaggctttaggccagagattatgtgtgtcgtcaactatatatgtttctatcaggttgaaagagccgctcaattgtatttcccccatcatcgcatctaaagtcatcattctttattaacatttcccatgagaaatggtacttcttatgtgtaacaacaacaatatcagttacttctttttttttttctttttgtgggaaaatttcagccactttcatcatgataccctgtaggactggttaacaactccatcgttttccagctttcgttgccagattgtccaagttttcatcaattaaaattttagtttggggctg

SEQ ID NO: 73083 - DNA, 623 bp, Triticum aestivum
  Clone ID: PAT_TA_73083
tctgtccctccccgatgatctctactctataaaattctgatttgttttgatcaaatttgatatgaaatctttgggggaacaatcaacataaatctaacaatattgctgacaagaacgaacaaatgttgaaaatgggttctggcccggtagattgggtcatgttaattattctatattttaaataatatagatgtagtttgcaactatcatgggttataataatggggaaggatagtacatctatttaaatttatattcgaagcatttctagctgaaatcgaagccttactttgtgaggtgaaatcactctggttaaacaccaactatggttaaggttttggctcttttgtgtgctatgacatgttgatctgattttgctggacgggtaagaaattgaggtaatacaactattgcaatgcatcttactacgtgtttgtatttatttacattgatattttcttactgcttgcctgtcctttctcctctccctgcgccctacttgtgtggtcttgctcttgcttgttgcatgcgcagggaaatttcttcttgtgctgtcctgggtcctgtgtccgccctcacattgttcgcgttaatctgcactccgttcatttgcatggaacatg

SEQ ID NO: 73084 - DNA, 659 bp, Triticum aestivum
  Clone ID: PAT_TA_73084
gattcggacgagcccgtgtgcacgggcaacgcgaggacaccaacgccgcctcccctactgcggcgccgagctgtggggcagcgcagggcggctcaggtgtctcgtcgccaccgcctcactctcctccgcccgttgatgagcaggccgggggcggaagccgcaaagctgggaaatcgagctccgtggcgagggagggcggctccggagtctcctcgccatcacgcccccctgctccgcccgtcgatgggcaggccgagggctgaatcttcgaagccggaggatcgagttccgctgctgcgcacgccaggagcaggctggattgccgaaggccaagaagacgttcttgagcaagataatcagcttcagcaagaacaaggagcaagttcttgataggcaagacacaaatgaggaagaatgcctccttgcagctattgaagaggtggctgacgaggaacatgcatgtttctctgaattttctagtagccacaaagcatttaaggagttgataaagaaagtaaagagctggaagaaaaatgcagattgatccccgtattaactgagagataccttaagcggaaacttctcaagttcttcagcacttacgatcgaacagaagacagcgagaaaacacttctcaacttatccttcaaagtcatcaa

SEQ ID NO: 73085 - DNA, 403 bp, Triticum aestivum
  Clone ID: PAT_TA_73085
gattcggacgagggttggttagacagatagatctctcttagtttcttcttgaatctttcggccttttcttttccccctttcttccaaaaaaaaacgttccttttttgagctgagcctgtccaacaagaacaagaaggaggaatcatccgacgagaccatgtcgtcgtcacgccggagctcgagccccgacagcaacaacaacacggacgtgagcggcggcggcggaggcgggttcgccgcggacgagcggaagcggaagcggatgctgtcgaacagggagtcggcgcgtcggtcccgcgcgaagaagcagcagcggctggaggactggtgtgcggaggtggcccgtctgcaggcggagaacgcggcggcgcagtcccgcatcgcggcgttcgagcgcgagttc

SEQ ID NO: 73086 - DNA, 594 bp, Triticum aestivum
  Clone ID: PAT_TA_73086
attcggacgagggggaggagaggaggaagagggaggccaaggagaaggagcgtgagcgtgctgtcctggttgctgcaggaaggaaggagagacaggcggatcgtgggcgcccatcaagatgggcacggtgatgtaaggattctcatggtataatgtcaaagattgctcaggatgtttgttgaattaaggataagtcattgaaccgggcatggcctgactaccttactagctagatagatgcagatgcatgtggctgcaagaattacaccattcaattgccaaggaaagaatgcttgtgagcagtccaagaacatcttgatcaataacaagaagattgtattctttgttggaaattaatctattttgatcttttgtaaaatactccgtgtcatgtactgagaatgcaacgaaggcatgaagctagcagcacatgtaacacaaccgttgtttgcttgtaattgtaaagctatttacttggtttgccattttttttattaagtttcttcaatgtcagataacttcaacttcctgagtactgttaggagcatcctgaaacatctccctgcaaagttgtattgcatgctactggcatga

SEQ ID NO: 73087 - DNA, 499 bp, Triticum aestivum
  Clone ID: PAT_TA_73087
gtgcacatggatgaaaggccactcaactgtgaatggaagggctgcaagaagacattcaagtggccatgggctaggacagaacacatgagggtccatacgggggtgcgaccttatgaatgcatggtacctggctgtggtcagacattcagatttgtgtcggatttcagccgccacaagagaaagactggccattccagtggtaagaaaaataaggagagtacataacttctaatccctgtgcaggagtacaggttctttctctgaagggtatgctgattgaataactgcatcagattccacttgtcgttggattaacctgcattaggagtctaattcattccattgtttactgactccgcataatgagtcaatttttccagtgccttgggtccaactggcctgttgttgactggggttattccaagtcaattgtatgtgctttagtttatcgccaacgcttggggaagttccttttgtcttcatggttaaattgacatac

SEQ ID NO: 73088 - DNA, 536 bp, Triticum aestivum
  Clone ID: PAT_TA_73088
gattcggacgaggtttgtattgaagcctagatttcaggctagccaaaggaaattttgaagagaactatcaggttttttttttggctgtggatgttatgctaagaagcaaacatgcttctgtttgtttgcacacttccatcacgaaggaatgcaggtaactgtttttttcatgtctaagtttgattgcaggaaagtgatagagtttacatgctcctcaaaatattgaagtctttttatgctctcgaatttaactgtatcttacttcctgctactgctgctaattcagggtactttctgtttggacgatacaatcaaattatgctatttaatttatttcaatgcctcctactgacttatcttcagttttctacattatttattgtcctgtatactaaaacataagggcattgtctcatgcttcttcttttactttctgcatacttatatgatttacgaatgattttgatgccacctttcaggttcctaattgtagccgacctctaatttgtgccagttacaatacactcccgtggctt

SEQ ID NO: 73089 - DNA, 479 bp, Triticum aestivum
  Clone ID: PAT_TA_73089
gagggttcattgaagacagtgttgctgcaaatcattcagtaaatggcagtgccagaaatgcaatcaaaatacttatcctcgatgttgattcatcagatctaagttctgggctgtcttgcccaccagaaaacttcgttgaagatcctttccttctgaaagcaaaggagttcctttcggagggcggcctttttatcatcaatttagtctcgcggtcatcttcagtgagggaaatggttgtttcaagacttaaagcggtctttgaacacctatactcactgcaacttgaagaagacataaatgaggttttgtttgcgtcgccgagcgaaagatacctagaaatcaataaccttgatgcaggagcttccaaattgcaggagttactcaaaattccagtgggatgtagaatcagatatacagaagttgcaaaagctccagtaacagtctcacctgataccgaacaccatccatttgcatccact

SEQ ID NO: 73090 - DNA, 441 bp, Triticum aestivum
  Clone ID: PAT_TA_73090
tacgtcagccagtgtatcttcgtcatcaactccgagcaagccggcagctagcatgggactgaggcgcaggcccgacgaggacagagaaaaggaccgcgagaaaagttccacgggcttcgttacgttcttgatcgggattgtggcagcaggtgctgctctagtgggagcagccgcgtattacggcgccgaagaggaggacaagaatcgtcagaagataaaagacaggaggtaccgatagaggagatcatcgacgacgctacgtatacgtacaccgctacacccatcccggccagcagcttctttaactttcgtgtacctaagccatgtgccatatatgtatctatatatatatatcttcgatgtacgatgtaacatgtatattcacttagcttatgtgtagcagagttgatgtacatgtaactcacatatatatagctatgc

SEQ ID NO: 73091 - DNA, 502 bp, Triticum aestivum
  Clone ID: PAT_TA_73091
ttcggcacgaggcttatttaggggtcatgttgatatgcatcttatcttggattttggacatgctacaactatgtgtttaatcattttcctgggatgaattttgctttgatcatcgggtagtaatctggattaatgatgtgtgcatcctcatctgttagtattttcttttcaaatgttcattcgttaatcttgttctgcatgtcataagagttatatatctggtatggttgtgaaatgtgataatcgatcctacatatgctggttggttgggaggatgcatcagtcacattatgctgtcccttttccagcatatctttcagtaatattttcgtcatattgtttcgtatgtaatcttctcctcacgtacacttatcttagctgcatgttattcgtgaacgatccaatcaaattgaacatgacaaaattgggttttcaaacattggagctcgtagccttcctgcagggtcctgcacgggagattgcggcaattactgtggctgca

SEQ ID NO: 73092 - DNA, 542 bp, Triticum aestivum
  Clone ID: PAT_TA_73092
tcggcacgagcgagttttttttttttttttttacgcaaatcatattcgttcacaagtactgaaagttatcaaacagcctactactactaccacagcacaacgtttcagtctcgggacacgaatgaagtacaccacatttttgaaaaataaaacgcaaacactacggatagttctttttggccacatggtcagaccttaatccagcagtcgtagggaaatgaattatggcaaacgagtctatcccgtcagtaattctcttcttcactgacaatctctgcctcttggtccacgggaacttgaatggctgctttcgagaattgtcaaggcacttcctacaagccagcctatgatacaggaacacctcctccagatttgtcgctgcttccattacacgcctgatatagctcaccatgtactcttcagattggaagccaaatatgacaagcgtaaccagattctcatgatggaagtcagaagcagatgattcccactctacacccttctcctcgctaaacaagcgttccttcctcttctcctcatct

SEQ ID NO: 73093 - DNA, 112 bp, Triticum aestivum
  Clone ID: PAT_TA_73093
ctggtggctctagggctgttctcttcagaacacctatttcaggtggtgtgcacagtgcaaccgctgttcatgatttaccaccaccagctttggctgttcgcaacctcatgga

SEQ ID NO: 73094 - DNA, 534 bp, Triticum aestivum
  Clone ID: PAT_TA_73094
attcggacgaggaaagctttggtacggtttcaagaagtcaccaccagatatacaccagagagagaagcggttgatgatatgctgagagaaagggacaatatccattgctcgttcacaactgagcgaactttggtaaaccctgttggtgcaggtagtagcagtagtaggtataccgtcgagcagagcattcctgagagccctgagaacggtagtgtagatggcaaagacaaatctggcaaaaagaagtggtttaatctaaaccttaataggtccgacaagaaagcctgatgaatcttttgccagaaacgtcatgtgttttcactttgttgtacattttggaaaccctattgtattcatgccttatgagctttttagttcccagttctctgggagttttgtagcatatagggagtttgggtacagcattttattttcatgtattatcccaattgactcttcattgccccatgcctcccaagcaaagttgcatcgacatccaaatttgtgcaatcgcctaccaagttaatatatcat

SEQ ID NO: 73095 - DNA, 541 bp, Triticum aestivum
  Clone ID: PAT_TA_73095
gattcggacgaggacctcctgcctcccgctggtgccgctgctgacgttcctgaggataggacagtgcgtgtcaagttcgtgctgaggaagcagtgcgcctttggacagcacttcctcgtcggcggcgacgaagcggcgctcggactttgggatccggctaaggcgaccgccttagaatggtcagaaggccacgtctggacggcgacgacggatttgccggcgaacaggtcgatcgagttcaagtttctgctgcgagatgcctcggggcatgtccgttggcagcatggcactaacagaactctgcaaattactgaaaccccaaacaccatggttgtccacgaagactgggatcacggcaacaaacagaaagtatcagaggaggaagagctctccatcggggcagaagatgtggaattttcagaggttcttgaaggaacaaatggcgcaatgccggtagataacaatccccaaaagcatgagaatctggagaccgacaggtcggcgtgtggtggttgcagatgctcctctgcagtgggaaatg

SEQ ID NO: 73096 - DNA, 580 bp, Triticum aestivum
  Clone ID: PAT_TA_73096
gaggggagttgtgtgaaccaagctgctggtgggctaccgccgccgccgccgccctcctacgccaccttcgccggcgaagagcgcccgccagcaatggcagcaaagtgtgctctttccgcaccatgcttatcggctcaccgacccctctgccgcaacaggcttgctccatgcctgccatcgccaagaccagcaagagccgttgctctgagagtgagtgctgcaaagcttcctccaggggttgaagtgcccagggtgcagccaaagctgagcgagcccttcttggggttcacccagactgctgagatctggaactccagggcctgcatgattggcctcatcggcaccttcattgtggagctggtgctaaacaaggggattcttcagatgattggggtggaggtgggcaagggtctggaccttcctctttaattaatagccatggtattttcatgtgctggtacggtggtgtattgttggccaaagatgaggatttcacttgctgtcaactacttccgcaaagatatttgggagagtttcagcagctatatatgcttgttaataaccattttcatatggatat

SEQ ID NO: 73097 - DNA, 604 bp, Triticum aestivum
  Clone ID: PAT_TA_73097
gattcggacgagggatttccaagacaggaaactgatcttcagcattgctacaaggtagtaggaaactaaatatttacaccaaagaacctaaaatggtgaaacctgcagcgaatcaacagtaagaaaaagtttactgctatcttatctgtacatcaagtttgggctgccccagtaccacccacagggtaaagtgatttcttccttttcattttcaaggcaaaaaaagaaaaggaaatagaaatgaacagaggtagaacggttctgatttttgttgcatctgacatcagcacagctttccttagttgatgatcctaggaatgcggcgtccaaatctgggatccctgtaatgagcagccattctccttgacacagcagccctagccatggcccctgtaactatatattcatcatcaatttcatcaaatctgatttctctcatgtcaacagatcttgtgggcacttcaagagtaaagctttcttgactagatctgttgctgctccttgttccactacttctcctttcccttgatcttgtccttcttcgactcctcctgaagatctacagaatgctttgcaaaaaatacaggatgtccaccagtttgct

SEQ ID NO: 73098 - DNA, 524 bp, Triticum aestivum
  Clone ID: PAT_TA_73098
gaggcttttcttctgcatcctttctccagtgccttgtccaggaaaacataccaacatttcttgaagcagagatgggtgcagcagagtcatcttccaagctcgctagctcagtccatggctttagcgtcaaggatgcgaggggaaatgatgtggagttgagtaatacaaggggaaggttctgcttatcgtgaatgtggcttcccaatgtggtctgacaaattccaactatactgagttgggatcactccacaagaaatatggcgaaaaaggatttgagatactggcgttcccatgcaaccagtttgttggacaagagccaggtaccaatgaacagattgctgagtttgcttgcacccgtttcaaagcagattttcctgtttttggcaaggttgatgtgaattggcgggaaggctgctccgctgtataagttcctgaagtcagagagaggcggtctgtttggagaaccatcaaatggacttcaccaagtttttggttgacaagatgggcacgttgtgagcagatat

SEQ ID NO: 73099 - DNA, 481 bp, Triticum aestivum
  Clone ID: PAT_TA_73099
gtccggttacggtgatctgaccggttttggcaacacggggaacctcccgattgcgatcatcgggtcggtctgccataccaatgatcatcccttcggtcctggatgtgacaccatgggtatcgcttatgtctcgttcgcacagtgggttgcagttattcttgtgtacactttggtctaccacatgatggagccaccgatgcagttctatgagattgttggtgaggggaatgagatacagcaagaacctgaacagatcagcagcaactacagtagatctctgcttcatgaggcggagtggccagggatggttgacaaagtaactgagcattcaaagacaccattcattgcaagagttttcatgagcatttcaggttcctcacagaatacatttcctgaaattgattttactgaagaaggaacttctggtgctggacctagcagccctaagtcgctcagatgtttggcagagccaagagtggtc

SEQ ID NO: 73100 - DNA, 492 bp, Triticum aestivum
  Clone ID: PAT_TA_73100
ttctggttagcggaccattactagctgcatatgcacacctaaaaaataattgcgtgttgtgaatcttagttaattgtgttgccaaatatggtgtgtgttccaggttcgaggctatgcattttttaaggggactttcgttattttgtcacatgcacagagagttagatctggccatgggattttgattattgcgtcaagaataagttgaactgaatccgtttatatgaagctgcaaaaattcggcacacaaagttccattttttgattatcaaactttttgcgtggaattttcctagttcttacaccagaacaggtttccaagcaagagcatattcttcctgtctggtcgatgtggcgaaaattacttagagttagacttccacatgatgttgtacacttaggtgctaaagcctcgatgcttgcgcactccgacatgctgctgattgcaaaaacaagatcctactatacaaatgccaactattttttgctgga

SEQ ID NO: 73101 - DNA, 563 bp, Triticum aestivum
  Clone ID: PAT_TA_73101
aacaattgcgcaaaacatcaactcaaggaggggatgtacatcgcgagttaaaacaatgcaaatcggagatggctgaacaacactgaacattggtagaatattcgaataggatggatgaatatgataagaagaatgaagaaacaaatcgaaaattcagtacattgttacaagaacttaataaatgcaagacagaaattcaatatttacaatcggcttcttcatcgtctacactttcagtttgctcatcctgtagtactactgcaagtgatctatcattagctatgggaccacctgctttaaattctactaccaatgctgtacgaactagactacatagtcaaggtgaccaaattcctgaaaatactaacaaggattctatggaacagagtgaaccagtagtattcgacgaagtaaagagttctgatgaacaggaaccatccactagtactggtgttaagcgtaaattagaattggctattcctaaagctgctaagcgtgtcagggctgtagctaaaaaatacgcagcattaataacgttaactagacaataattaaattataat

SEQ ID NO: 73102 - DNA, 553 bp, Triticum aestivum
  Clone ID: PAT_TA_73102
gagggtgaagctaaggggttgctgttggctagcattcgagatccaaatccagttgtattttttgagccaaagtggttgtatcgtttggctgttgaagaagttcctgaggaggattatatgctgcccttatctgaggcagaagtgattaggaaaggaagtgatataacactcattggatggggagctcaacttgcagtactgaaagaagcttgtgaagatgctgcaaaggatggggtatcttgtgagctcattgatctaaaaacacttataccatgggacaaggaaacattagaggcctcggtcaagaagactggaaagcttctcgttagccatgaggctccaatcaccgggggctttggtgcagagattgctgcatccatcaccgagcgctgcttccagaggttagaagcacctgtggcgagagtctgcggcctcgacactcctttccctctcgtttacgaaccattttacatgcccaccaagaacaaggtcctggatgctataaaatcaactgtaaattactgaactgctggacctgccgtacatgttcctt

SEQ ID NO: 73103 - DNA, 519 bp, Triticum aestivum
  Clone ID: PAT_TA_73103
aaacagtttctaataaacagtttttcatctcctttttttttgtccgttgtgcaaatcatctcaactctctaatccaaaatgaaagtctatcttattgctttattggttcttgctgttctcggtgctgctttccttccctccgttgatgcccaatatggtcgtggcggttatggccgaggatacggtggttatggacgtggttatggcggcggctatggccgaggatacggtggatacagaggtggataccgaggtggatatggtggcggttatggccgaggatacggtggtggttacggaagaggttactacggttgattcattttcctctaatcagctttgttatcttttttgcttcctcacctaaaagttcatgttcatctgcattctcctttggtttctcctcaagttttcctatttttcagttgtttttaatgacccatccaatccatccgcttttggaccacgttcaaacttgatcctagaagtagtcgacgcaacattaattccctgttttac

SEQ ID NO: 73104 - DNA, 515 bp, Triticum aestivum
  Clone ID: PAT_TA_73104
attcggacgaggggaagctgacaaagccattgagatgttcaaccgctatgacattagcgggaggcttctgaatgtaaacagggcatctcctaggggcactcgcatggaaagacctccgagacaatttgcacctgctttcagagcttatgttggcaacttgccatggcaagttgatgactctaggctggtgcaattgttcagcgagcatggagaagttgttaatgctactgttgtctatgatagagaatctgggcgttcacgaggatttggttttgtaacaatggtgtcaaaggaggaactcgatgatgctatttctgcgctggatggacaggaattggacgggcgccctcttcgagtaaatgttgcagcagagcgaccacagaggggcttttgatgcggtggtacgagagagatggctgcttgtttgtaatgagaacggagacaacggaggagcaatggtacaaattagcggaagctgatgctgtcacaagttgctagatccctcccttagcttc

SEQ ID NO: 73105 - DNA, 522 bp, Triticum aestivum
  Clone ID: PAT_TA_73105
gacaaacaacagttatccgtttcattttagcaaaactttcggaatacaatttaatttcactgacatttgtagtttattgtattattgtattatcatgtcaataccatctgcgggtttaaatattacttgaattttgatgttattttaatgaggttatttaattttcctgacaagtgagtattcctaacgtcatggttgcttcaaaatcaaaagttcaaagttttccagagttgtactacacatcattaccatagaaaatcacacaagggatgaacatgctgcaaaagaaaattcttatcctgcatcacacggttggaacaatacctttctctgaaagtgggcccttgcgttcataaatcctctgctcccctcccaaaacccagcacaacaagctagaagaagggaaaaggcacctcagccatggcgcagcagcagcttgctcctcctccccgcccctcccagaaccttcttgaagcccctctcctctcccttcctctcctccctcccccggcgccacctcgt

SEQ ID NO: 73106 - DNA, 512 bp, Triticum aestivum
  Clone ID: PAT_TA_73106
gattcggcacgaggggtcaacagggacacaccgctgtatagaagtccagctgctccgaaagattatcttcacccgcagccccctgttgttgccttgagctacttgctgtttcactctcttcggtcataacaagggaggtggacttcatcattaattttttgcttaataatgtattagtagacttctccccctattttcttactgcctctgcagcgaagtctagccaatctggaagattgacaaaattgattgcttgcagaacaaatgacaatgacctgattgggagaagtaggtaaatctgagctggctttgacatgtagtagtgtggcttttgcttcatcaaacaagtgcatcatcataaatatggatgtcctgagaggactgctggacaggcaatggctgctgtggtggtgaaagtattatgcataacattccttatttttgctttcaaatgttaatcagattgctcaaactaacagtactacatttgagagcctcaatttttattgcca

SEQ ID NO: 73107 - DNA, 490 bp, Triticum aestivum
  Clone ID: PAT_TA_73107
gattcggacgaggccgatttgagtgacatcgactcgggttgggttatcctcaagaactcggatattgtttccgcggatttggcagccgccgccgtcagtggaggtcagcgtctaggctcttcaacgattcctagctgggcacggtgggttctgggaggtgtggtgtacacggtcgtgccgttctacaacagagttaggcatctcgaagacgagaccgtggggttcgtggagaatgctgtggaggttgtggagcatatagctgaagtaacagagaagctagctgcgaatgtggctaagcaacttcctgaagatgggtctctgcagaaagcagcagaggatgttgagcacattgctgaggtggtggatgatgatgcagagaagtttgaagcagtcgctgaaaagatcgacaaggtctgtgatgagattgatgctgctgtggagccagtcatcgaggagcttgaaaaggaacttgatcagagtacaacgtctg

SEQ ID NO: 73108 - DNA, 461 bp, Triticum aestivum
  Clone ID: PAT_TA_73108
cggcacgagaccgcccaactcgcggcggagatagccaagctgctgggctgcaccacatggacgggcgccggccccggcctcatggatgctgccatccagggcgccctcgaggcaggcaagccggtcggcggcttcaagatcggcaaggaggccggtgaatggacagcctcgaacttccacccttacctgccctcggagacttacctcacctgcaggttcttctcggcaaggaagcacggcttggtggatgctgtagtgcgcaacagctccgctgataaaaccgccatcgtcgcattgcccggcggcattgggacgctggatgagctttttgagatcatggcgctggtcagctggagaggatcgggtcggcgctaccggtcccgttcttgctgatgaattatgactcttactactccaaactgctggagtttctgaatgactgcgaggactggggcacagtt

SEQ ID NO: 73109 - DNA, 433 bp, Triticum aestivum
  Clone ID: PAT_TA_73109
tatccgaagaagtcctggtcacgccaggcggaagctgtggccctgctgtagctgtaggcgcaatggctgagaagagtgagcagaagagagatggcgaggaatttactcatattatctctgtgcgctacgctacaaaggcctgatatatcgagatgaaggcaagcaagttggcaaatattgcaactgcgcgttatcactgtatgtaaatatatgaacttcagacggagaagcgcagattaatcgatattgcaacgaactgtgtgcttcattgtaagtaacaaggtgctacttttctcaaaagaaaatgtactgccactttggtaaattgtggtggactgacttggagcttcgtagactttctgcagtgcactcacgtccagtctaatgatcaatcaataaaattacagtacaaaaagaaaaaaaaaaaaaaaaa

SEQ ID NO: 73110 - DNA, 532 bp, Triticum aestivum
  Clone ID: PAT_TA_73110
gcgccggcgccggcgccagcagtcgccgcggagaccagcgacgacgccatccaggaggagtctccagcgacggccccttcctcagacgggaagcccggatcaggggcggcgccggagctggaggtgcagctgttccggcgcgggcgtccggtggccgtcttccggtcgcagctgggcgggtatacgcaggaccagctggaggtgggcgacatcctggagcagcacggcctcaagtccgtcttcgccttcgaccccgccgcccgcaaacgcggcgtcgccatccgcttcaacccccgcaacggccgctccctcctcacctacgcccctggctccacgatcttcctagacggcgagcccaaggattctttgctgaagcccatcacgaagatggtgatttggggtggctgctatgactgtggtagcagcagtgctactgaaggaggccaagatgccagagtggcttcagtcatctaagctgggcaccgtgagcttcccaccatgggtgctggcttgcatggtcatcgtgttcctg

SEQ ID NO: 73111 - DNA, 517 bp, Triticum aestivum
  Clone ID: PAT_TA_73111
attcggacgagggaccgatgcctacctgagcccctcccgatccggtgatccctctcggcggccgtcgccacctccccaagcggctccgatcccctacaacccgtctccctcgcggcactgttcccatcatgcatggatctggcagcgacatccccttccctgcacctgcgcaaccagcggcggagcccctcccccttggtgatggcttggccaggtccgcgtgaagctgctccaatctgtatcgcctgctcgccgtcgttcgtgggcttcaggtttgttagttgttgattcataggggctggtggcagatccatgttggagacggtgtatccttgttgaagctcatggatttattgttaaatcttggttgggtggttttggattcaggagatttttttttctccaatcttgcgtgtgaagggcaggtcctatttcttcatgcatggcgagttcgatgtgtttgtgatccgaacgccatgggatgtgagactgcatatgcgcttggccatggaagttg

SEQ ID NO: 73112 - DNA, 505 bp, Triticum aestivum
  unsure (1)..(505): unsure at all n locations
  Clone ID: PAT_TA_73112
tcggcacgagggcctcatcctcaccctggccatcctgttcctctggtccaatgccacgactttcatcaacaagtctcctcctaacatccctgaggtgaagatcccagaggacctggctgtgaatgttgcacgttccctgagatatgagatcaacaggggatttgctaccttgagggagatcggccaaggccatgacctgaagaaatttctgattgtgattgcaggactatggatcctttctgttcttgggagctgctgcaatttcctcaccttgtcctacatagtttttatggtattgtacactgtgccggtcctgtatgagaagcatgaggataaggttgatgcttttggtgagaaggccatggtcgagctgaagaagtactatgccatcttcgacgagaaatgcctatcaaagattccgaagggcccattanaagacaagaagcaacattagaagagcacaatcagacaagggtcctgcggggatttatcatgtcttttgatc

SEQ ID NO: 73113 - DNA, 408 bp, Triticum aestivum
  Clone ID: PAT_TA_73113
gattcggacgaggggtcaaggaaagtgaccaagaatgccagggcaggcgcaaagaaccagcctcggttctctcatcgcagaagcccggcccggcgagatgatgacctccatcgttggtggcggtgctgttacccgtcgggtgtttgagtgtcaaaaagatcaaattagccaataggtgaagccagagttctgtacatgtatattaaattagatccgagttgtcacttgacagtgtatgtatgtcatcatgtatgtagagtgataaatctgacgtgtggaagggtaactaaatacagattatccaccatgagcgcatagagatgcgaaagcagagtattgtaagatgtgtacagttagaaaattgttgaaatgtgcaaggcattttactctgaaaaaaaaaaaaaaaaa

SEQ ID NO: 73114 - DNA, 575 bp, Triticum aestivum
  Clone ID: PAT_TA_73114
gattcggacgaggtattcacctccctcgcggcgcagtcgcagaccagcggccgctccatctcacgctccgtcttcctcgagtactatggggtgcgggggccattaggcgacaggctgttccagttggtggcgaaggagagtggcggcagcgatggggtcacgttcgaggatttgatcatctccaaagcaacatatggaaggggaactcgagatgaggttgatgaattcatttatcaactatgtgatgtcacaggagatggtgccttaacaaggtctgatttggaatctgtcttggcatccgttcatgaaactgtatttgcagtgaagaaggaagtcgtggaaggttccaacaacagaccatttgaagcattcctcaactcggcagtactttcagaggatgctgaagcggtctcagagaagtctatgtcattatcagactttaggaacctgtgcattctcttgccatcattgaggaagttccttggaaatttgttgatgccccctgattcaggtagaccagggtttgaagtaccactgcttcattatcctgaaaacatctccactgatttgctgct

SEQ ID NO: 73115 - DNA, 447 bp, Triticum aestivum
  unsure (1)..(447): unsure at all n locations
  Clone ID: PAT_TA_73115
cggcacgaggcagatgttgagcgcaccatcaaagagttgagatccacgccagagctgctgtacattggtgactatggccacattgatttcatcatgagcgtgaaggcgaaggacgatgtttatgttgacttaatgaggtttctcagggcccagcagggaatgcacagtagttattaggacgcatcgtatgcctttaattaaatgtttatactatgatgacagtacgactatgtaaatacgtacatagcatagcttgtaccggccggcgacaagcccaaacagtcaattgcattgcatgtgtgtgggctggnngtgtgtgaatgttctccatttgatgtactgctttctgagtacagtacatgtacatatatgtatgacgaaaatgtggcacaagcaatttggccacatatatgtaataccaaattttaccaaaaaaaaaaaaaaaaa

SEQ ID NO: 73116 - DNA, 526 bp, Triticum aestivum
  unsure (1)..(526): unsure at all n locations
  Clone ID: PAT_TA_73116
cggcacgaggtgcgtgaagcggggtggtgtgaggttcaaaatcaatggtcacgattacttcaatcttgtgcttgtgagcaatgttgctgcagcaggatcgatcaagtccatggatgtcaagagctctgattctgatgactggatgcctatggcacgcaattggggcgctaactggcactcgttggtgaacctgactggaaagatgctctctttcagactaacaaacactgatggacacactattgtgtttaacgacgttgtgccaaaggggtggaccttcgggcaatcctttgttagcaaattgcaattctagcgagcaatatctgccgaccaattaatttatcagggaaagtgggtggatttgtanataattggttgcataaagtgcaagttacggtgttaattgtgtgggggtgctgcttgtagcactgatctaattttacaattcaatttgttcatactcactgtgtaattcatatggtgtacataacgtccaattaattctatcaattgtgtatcctacaaa

SEQ ID NO: 73117 - DNA, 327 bp, Triticum aestivum
  Clone ID: PAT_TA_73117
ttatttaataaggatcaagaataattttaatttttaatttattgacttcagaaaaaattatgtaagcttagactagggttataattattttgttttattttgtgaaaagaattaacaatttgtaaacattttttttttcaaatgaatcattttaagaaaaaaaatcattaagtatttatcaaccatacaattgttaatccaattttttcatttgtcatgtatatgatttattttgatgttatgtataaatagtagcttaccctactattattgaaagtaattttgatgactttatacatatataaatatatatttatatatatatat

SEQ ID NO: 73118 - DNA, 536 bp, Triticum aestivum
  Clone ID: PAT_TA_73118
tcggcacgaggcagacatttaattcaatgataagtgtttttggcaaaggaggaaagctggacaaggctgttgaaatgtttgctgctgcacaggagctaggcttgccgattgatgaaaagatgtacaccaacatgcttaccttatatggaaaagccggtaggcatcaggaggcgtctttaatgttcaaaagaatgaaggaagatggcatcaggcctggaaagatcagcttcaattccatgatcaatgcctatgccacttcaggattgtacagcgaggcgaagagtacattccatgagatgcaggactgtggtcacactcccgactcattctcctatctcgcactgatcagagcatacacagaggctaaactgtacatggaggcagaagaagccatccggatgatgctgaacagcagcacaaccccttcctgccctcatttcagccacctgattttcgccttttctgaaggaaggccagattggtgaagcccagaggatctacaaccaaatgaaggatgcaagtgtggctcctgatct

SEQ ID NO: 73119 - DNA, 626 bp, Triticum aestivum
  unsure (1)..(626): unsure at all n locations
  Clone ID: PAT_TA_73119
attcggacgagggagagaactagtctcggttttttttttttttttttgaagcaaggctttgttatggtttatatttgccatgagatctggcagttttggcacagcttaaaaaatagtggcacgaaagtttcaaactgtagtaacacaagagtattttactagcagtaagaatctcgtgtagtagctggctgcaaagaaaagatgccatgacacagctaaagctgaatctgggaaatgccccgtgaatgtggattccatggaactgaagcgcctccagagagaagaaaagcgacgacgaagaggctagaatgagaatcatgtactgtatatatactactactagtgagtactgagtatgaaaatcatatgttggtgggtggtgcgtcggagtcaggatcccagccgggaggctcgatgttgggccaatcccctcggcatcccagcctcatgtataggctcttcttacctgctagcttcttgtctgccaatgttagctgcttcaaggccacaaggcaaccctgngcaacagctcgtgtgtactccggatcccatccaccaagcttcactactacatcagctttcgcgtacgcaacatttcccgagctcacacttctacgggcctcttc

SEQ ID NO: 73120 - DNA, 395 bp, Triticum aestivum
  Clone ID: PAT_TA_73120
gattcggacgagggagccgacccgcttcgaggcgaatcgagagttagctttccagccagcaatcgaggatgtcgtcggtgcagctctccggtgccggagtcgccgcggtggccttcaccaagaatggcgcgtcttccttcgacgggctccgcctcgcgccgccatctgtgcgagtctgctcctccaggcgcccgtctcgtagcctcgtcgtcaaggccgccacggtcgtcaccccaaagtatacctcgctcaagcctctgggagacagagtgcttgtgaagcttggtgctgcagaggagaagactgttggtgggattctgcttccgtcaaccgcacagtctaagcctcagggaggtgaggttgttgctgttggagagggaagaactattggggat

SEQ ID NO: 73121 - DNA, 578 bp, Triticum aestivum
  unsure (1)..(578): unsure at all n locations
  Clone ID: PAT_TA_73121
gattcggacgaggctcacaatgctaccgctgtgtgttctcggagcggacccggtgctctacgttggtccctctaggatctgggatgtagctcatttgtccctttgggaggaaagaaaatttgttatgaagatcccaaacaaccattgcggatgatattaagctgtgatttgacgcaccaactgatgccgtgctcttgtacctactggtgtctgtcttgatgttgggatcaagcgcacctaattgtccttttgtaccagctctagcatgtgaatccatctgtgcctccgccacctaatacactcactgttgctgctggcatttctgcttggctattgctcgattcaactacactgtcggtcacataatgtgcaacgcattaagctgcaaatgccactcacagggattacaacagtagttgtgggcnttctggtttctctttctcagggcaaaattttactggatgtttggacggattacgtttgctctaacttctgggggaaaaggatatttgccttatgcaattcaagttcataattcggcagagttctaacctcaaaaaaaaaaaaaaaaaaaaaaa

SEQ ID NO: 73122 - DNA, 544 bp, Triticum aestivum
  Clone ID: PAT_TA_73122
tcggcacacaggggtgttaaacctgaccaattcaaggcgatgaacgacgaggggatgccaatttaccagaggcctttcatgaaggggaagctctacattcatttcacagtggagttccctgactcactggcaccagagcagtgcaaggctctcgaggcagtacttccaccaaggtcttcatccaagctgacggacatggagatagatgaatgcgaggagacaactatgcatgacgtgaacaacatcgaggaagagatgcgcaggaagcaagctcatgctgcccaggaggcatacgaggaggacgacgagatgcccggcggagcccaaagagtgcagtgcgcgcaacagtaagcaggcgtatcatcatggcaattggcagggttgcgcttcaagtgctagagtggtctctggttttgctgtcgctgagatgcgaaataggaagctgattctacccctgcaagcagggaatgtatcctttttgctgcaactgaaaaaaaaaaaaattgctacctacgcatggctggctacctttcttttaactttt

SEQ ID NO: 73123 - DNA, 567 bp, Triticum aestivum
  Clone ID: PAT_TA_73123
gattcggacgaggcaggttttgatttcttggagtaggaaaggggggtagaggttgacgctaggatcagtgatatcacaacgagaaagcacgtctattggaagagataactgatcaatatacgagatctggctttcacaaacatgaaaagcacataactgcacaacataggcatagctcgtgctcttgtttatttcctgtgtcaatctatgttgagtagtttgggcaagggctgatagtagtctggtgcagaaactcaggtaattttgttgttggtcaactgatgcttgattcattgcaatagctccgatctaaggtaatccatttaccttttcctattctgcatacattttttcttcaccttttcctattctgaatgttaaatacagtcaattgattagtgtggccatgaacctttttctttacttattacagtcctagctaattttgcatgtcaagtaaattaaaaaaatattttgtcaattctgccaaaattcttaatttctgaattttaatctaaaaagtttgcacaagaatagtactcttcgattatgacctgtgtcctcaat

SEQ ID NO: 73124 - DNA, 443 bp, Triticum aestivum
  Clone ID: PAT_TA_73124
aatattggaaaacaaccataagatagatagcggattcggtgatttggttattatggaggttgatggaacttggtctactatcggaattctgagccataaagcattggacttggacaagcaacaaacaatcaaagacgcgtacgtgactgctccatggttcatagctcttccatggcagcaaccagcggtcccaaggccaaggacaattgttgtaaggaatgtgtttccatgcacctgcatcgacctttaggactggtgagatatttgaagctctacgcttgtgtgcactaaaatggagagcatctcctttttttaatggtgtgatcttgattcttggatcaaactgattcacaagatgacgagcgtggcaatctcggcgggctcgctaaagtcgggggaaggagagaaacaatggggaagggagcataacatggatgtggggc

SEQ ID NO: 73125 - DNA, 639 bp, Triticum aestivum
  Clone ID: PAT_TA_73125
gattcggacgaggaagacaagagcttcaactgtgaacaactgctgcaccgcttaatatattattgaatatgcaagcccgagatgcatggttgtaggttgtttgtactgtcttatttgttatatttggaaatagagtttcaactctgtcctattttgtattctaactgaactgcttaatacgaatttacagatatctgcacattttaatactttcatgttatcctgcaaaatttggacggtgccaaatgtctggttttgacagctacctgttcaaagtatattaaatggacagaaatattaggaataaactagggcatgaattcaaaatttcggaaatcaaacaagtgaaatgtaccgttgcaacacactgtttgttattgcagtacaagtgatgggtagttttgcttgcgcaagtaatagtgtttattgctattggcatgtgatatttttgaccctctgaataaaatacacagagtgcgtggatcatgatgtccttacctagtttctttcctgagggcatggatgatgaagatgatcaatccgcaacacttgaccaggtcctaaatgacacgacaagagtcggttacttcaaaggatacctcaattcagttgcacaagccatcaaggacggagctgata

SEQ ID NO: 73126 - DNA, 508 bp, Triticum aestivum
  Clone ID: PAT_TA_73126
cggcacgaggtgatgttcccgtcataccatcctggcagcaggcgtatatggttgacagccaagccgcactgccaggattttctggttctccgttcggccattcgttgcagccgaacctgttggagaaccattcgctagcaccaatccggcaggtgaatttcttctgacggagacaggattaacagattgatgagcattcatacgattcttgcgttcttcttgatacttccagcttctcgctgtatacacactagcttgactcgaataagtggcggcaggcagtagatgaaatgtatatacagttcgtagctcttgatctttctttttttttccctccttctccaccacctttttttttttttcgtctggtcgtataccacatcgtcccctatgtaaataacggcatggacatctctctcccaaaagaaacaattttgtatgagcgatgttgcagtgatgtggatgagcaccgagttgctgagcaaaaaaaaaaaaaaaaaaaaaaaaa

SEQ ID NO: 73127 - DNA, 647 bp, Triticum aestivum
  Clone ID: PAT_TA_73127
cggcacgaggaaagagaacaaccagacactgcacacatcatcatcttctcccccgagaccgggtgatcttgggttagcttagctagctaaattaagctgcgtgcagcatggggctcctcgaccagctctgggacgacacggtggccgggccgcggccggactccggcctcggcaagctccgcaagtacgcctccttctccccttcctcctcctcctcgacgatggcggcgtcgccgtcgcccatctcggcggcggcggcggcggccgacgcgccggccgtgacgcgcagcatcaccatcctccgcccgccggcgctgtccgtgacgtcgccgcgcggcagcgagtcgggcccctccacgccgtcgtcgccggccagcgtcccggactcccccttcggctcagcaccgacgccgaagggatcggagggctggaagaagctgcgccgtgggggggcgaggatggccgacggcgtggacgccagcgccggcggccagccgagaagccccaccgtatacgactgggtggtgatcagctcactcgacaggtgaaggcgtgatctatctaatcgagcagctaagctctgcatccggcgagaaactgcacctgcacaatatgaagcagctagaaactgaaggcgagcaaagaag

SEQ ID NO: 73128 - DNA, 485 bp, Triticum aestivum
  Clone ID: PAT_TA_73128
ttttttttttttttcagaggccatctacaatcgcaaagatacgaataaaacacatgagtttcatgtttgccatatcaatttcaaataagcaacaattattatgatgacagttgaccagtatcataaacatacatagtcaaccagtccaaataatacctgctactaccattgacctgctgctctctcttgacgcaacttgtctctctcctctttcatcttgttcgcaatctcaattaccttcgggttaaataaacgatccataacatatttcttttcctctgcttgtatttcttttatggcacttgggtatggatttggaggtggcttctttccttcactgcgggcgatttctttcagttccttgaatgctttcttctttgctttcttctgtgtccgatactccatatctgctacagccatcgcatcatcttcactgactccttgctctttcagctccagaacacgccaagcaaaaactcgagctg

SEQ ID NO: 73129 - DNA, 718 bp, Triticum aestivum
  Clone ID: PAT_TA_73129
gaggaaaaaagattccttgttgatatacaccctcactcaaaggaactgacgtcctcgtcggcccattaggaatgttccctcttcgcacacgtatatgcgtccagtccggcacatctctcatgccgtgtgccacaacgggccacatgcgccatgcgccacatgcttgcgcacctgacccgcacatggccgtgtaaccgcgagggtcggctctgataccaactgtagcgcctcggccacatccatcggttcctggccgttacgcctggcaagatctagactggccccacaaaccaacatctgtcttttctacgcactttgtcctcactcatgcacacccgggagcaacttcacagtcagtcacccatcctcaaatcgctccaagccaagcatgcttaactttggagttctttttgaataggctccagaaaagaaggaattccttgttgatatgagtagtctatcattcctatgaagttaggctctcacatccttgttcctggaatgcatccataaatttcactcttccgccagcaagcacaatgacgcatgatatatatacttgaaagtaccatgccgatttgtattattttggtattatgcttgattccaagtatttgtgtacattaatgggtaaagaccaccaagatgaaagatgtacaatccaatttctcgattcaatagaagcccaaagaggtgcatatggtacccaaataagaat

SEQ ID NO: 73130 - DNA, 635 bp, Triticum aestivum
  Clone ID: PAT_TA_73130
cggcacgaggattgaacccgtggaagagaaaccagacagtcctttccaagaacaactgctgctgaagcgatgagtagtgcgcttggtgacaagatagaacaaatggctgatccattgcacgccatgcttctggatatgttgccactcctgggcaagaaagggacagaagatgcaagtagggcacccttgccgaaagctgagaaggatccacctgcaggaggaagttccacatccaattctgagattctggcgccagatgctggtacatccggggttccagccccagacccgaatgcagctcctcccccgaagaagaaaaaagtgagttacaaagatgccgctagtgaacttctgaaagattggtgagagagcttggtcagtgaacttctgaaaaaagtgagttacacttttactcccgtagtccctatcatgtaaatacaacggcatgtaagtaaccatgtttgtagcgtcaccttgactgtttgtcttgttctcagaagttcactagctttgcctggtgacttgttgagaatgactcttaagcctagcaacactgatgttgagttggaccaatatgcatgcggaatgcaaggattttacacgcattttgtattgcattgaagtgggaagtggaa

SEQ ID NO: 73131 - DNA, 590 bp, Triticum aestivum
  Clone ID: PAT_TA_73131
cggcacgagcgttcgtcggccgcgccgacaggctgcgcgccgtcgtcaaggccatgtgcgccgccgccaagcagtgcatgaaggagaacaacatgcacctgggcccctggaggaagcacaagtacatgcagtccaagtggctcggcacctccgagcgggaggcgccgccggcgctcgacgcggtggccgccggctcgctgtcgtcgccggagaagcagcccaagtatagggcgtccatgctgagcttcgacttcggccgggccccggtggtggttgcgtgatgcgtgcatggcggacaacaggaggagtatgatgccatggtgtcacgtgtatgtacccatgttatagaccgtatgccatgccgggcactgtagtaggctagagtagtagagtgtgtaacggggattgtaggttgtacgtagtcaggatttgcaatttcatgaatctgctcttgaagaagagaaatccgttgatggagataaaagtaaaaagttactccctccgttcacttttataaggccttaaagacatttcagacaatgtgcaaaatagcctattttcagttgtctgaaatgacttataaaagtgaa

SEQ ID NO: 73132 - DNA, 618 bp, Triticum aestivum
  Clone ID: PAT_TA_73132
cgctgggcggcccaagccgccgggtacggcgacctcggccgcgccctcctcgacttgcaggccgccgcagaccaggtcttcgacaccgtctccaagcgtaccgccgaggagcgcgagaagctttcggccatttcgatgcgaatcaaagcggccaaggctacagataagtttcccaaaaccaaagatggcacatatttggagaatcttttacagacagcaaaccatccagctctgggaaaccatttggcatctgacaccaagagtgatgaattgccacctccaccaccgagtctactaccaaaacaccttgcaaggactcaatttgtcaacattgacagcttgccttcacctgttcttcaattcttcatgtcatgctcatgcatgaacgcaggaattctgaataccactgcttactgggaagacaaaattgcaatgagttagagaaagcacttagcacatgtacccaataaaaaaaaggcaataactttgtattgtgacccttattgtaaaaagcttaatgagcaattgctttagattggaatgtatattgttcttcgaaatagttcttgattgaatgtaatccttccgaagttgagaactatttcgagctgagttcca

SEQ ID NO: 73133 - DNA, 721 bp, Triticum aestivum
  Clone ID: PAT_TA_73133
cggcacgagccgccgcaaggctccacggatcccggcggcgccctcccttcggtgtgctccttgatcccgccatcacgtcctggatccggctgccccggaccccgccagatccggtagaagttcccgcctactctcggctgctgccagggaaggacattgccaccgcgccacttcgtccttttgacgttgcagtgcgcaagccgttcaccttcgtcgcccatggaataaatgtgccttctacggctccgcccaaaatcacgcccgtgccatgggtgtggccgtagctgaggtgcagctcgccgttgcccgactcctagctaaggcagaggggacagataaaatgctgggaggattggggcaggaccgcaggaggtagcagcaagccttaaggagttggaggcacattactactcatcaattgtcggtactctgctctatgattgaggtgaacatcttctaaaatggtgcttttccacgcatctgaaattcctccggcaacactccccaacagcttgtttccccattgttgtggatcaacgaggatacaatgtgcttctcctgctcgcttgggtcaatgggtgattcggctgctgaagttgactagtaattatctactaaattttccaaggacaatctcgcttctacattttcatatataccagcttttgttatttacatatcagatgctctgactaaatcatcttgtgtgttcagagactac

SEQ ID NO: 73134 - DNA, 758 bp, Triticum aestivum
  Clone ID: PAT_TA_73134
cggcacgaggggcaagcgtgtcacgatcgttggctacctcaaatcagcacttgacattgctgcagaatgtgcagaagtaaatggtactgagattccatgtacaatggtggtccgaacaaagcattggatcataccagactattttgcatggggcgtccacatctcaaagctgtatcttaatcggttttctgagcttcttattcacaagcctggtgaaggcttactccttagcatcttggccaccctcttgactccattgacatggatattttcgaagtttgcagaaagctattattccattccaatgaagaagtatgacatggtgcctgaccatagcctatttgaggctttgattacatgcttggttgccattacacccaaagaccattacaagagattagaagaaggcagcattgttctgaagaaatcaaagacatttagcttttgcaaggaaggtgtgcttgtcgaaggccaatcttcgccgataaagagcgatatagtgatctttggaactgggttcagaggggatcagaagatcaaggagatgttcacttctgaatactttcagagcattgcagtaggctctgcatctacaactgtacctctctacagggagatcattcacccaaagatcccgcagctcgcggttatcggctattcagagagcttggcaaatctctacacatcagaattacgggccaagtggctggcacatttcatggatggtggcttcaggttgccaagcatcagtgtgatgc

SEQ ID NO: 73135 - DNA, 655 bp, Triticum aestivum
  Clone ID: PAT_TA_73135
cggcacgaggcctacccgcgcaatcgtacgattgtaacttaccgctgttcttgatactgtcataatagcgtaaatattataaatcgtttattcgcattcacgtgctttcacaactagacgaaaaaatggaagaattctttgccggcaaaaagttcatcgttaccggtgctaacgcaggaattggggagacgatcactaaacgtctagtgaaattgggtgctcacgtttttgctgtcggacgtgatgcaaagaaattgccaccagccgggcctaacctaactccagtttgtgcagatgtgggcgattggaactcctatgacattattaaaaaattggggccagtccatggcttggtgaacaatgctggagttgcgtttatcgaatctttctttgatatgacacaagaaggatgggataagacattagacatcaacgcgagaggaatcgttcgcataagtcaggcagtagcaaagaacatgttagacgctggaatcaaagggtccattgttaacgtgtcctcgacaatttcagaaagagctattccagaccacacgtcgtattgtgcatcaaaaggtgcagtcaatcaagtgacaagagttatgagtatcgagctgggaaaattgggtatccgtaccaacaatgtcaatcctactgt

SEQ ID NO: 73136 - DNA, 586 bp, Triticum aestivum
  Clone ID: PAT_TA_73136
cggcacgaggactaaatatgtgcataaattgaggccatgctaacatcccgtatttttctgttatcttgaaatattgtgctgatccttttgagttttgataacagtaagagttagttataataatgtgggtatccttgtataggttattcctgatgttgcagcgtttccctgttgagtcaaaaggtcgtcggaaaaagttgaatgaggttggctatgtgaccgccatttgctttggttgcttcttgaccagatgcataatgatgtgcttaagtgcatttaataaagatgctgatcttgatgttctgaaccatccaatcctgaacttcttttactacttgctggttgagattgtacccttgtctttggtgttgttcatcttacggaaactgccgccaaaacgtgggattgcacagtaccatccaatacattagtcaggattccgaaatgtgcatggtccattgctaacagttccatccaattgccaactacaacaaggcaaatgtgagttttttagatgaacgatgagacaccatatacctttctttgtaggttaatagctttcatacgaagtaggtctggcaaatat

SEQ ID NO: 73137 - DNA, 753 bp, Triticum aestivum
  Clone ID: PAT_TA_73137
ttcctggtggtgtgtggactgtattactcacaatcgatatccaaaggagaatacaaaatgtggcttttatttacatcctgctgaaggctcgcctgcgccaaacataactcaagggaagcttagtgctccacggatattgcgaattcataaggtagctaactatgtggttgagaaacttgtgcttgacaaaccggatggaggctctgatagcgcgtttgttatgggattgagttctgctcaatcgcagctctcagcgctagatagttcttcgcggcttggactaaagtcatggcaaaaaacaaagccatgtattgagatattgtgcaataaccaggttctatcaccagagatgagtttggctacagtgcgaacatatatatggaagaagccagaagatttgattcttcattatagagtggtccagtcgagatgatcacggcttcagatgtacatgctcacatggttctccagatatgttcagcatgtctgcacgatagatggttttgttgaagatacccttggcttagagaggaaaccatcatctcactgaggaaatattttgcccttgtgcccccgtagccgttcccagaatcccgacttgtttgcatctttgtaaagttcctgatctcgccctggtagtaagatgtatcatagcacaggtataaggttctctgctggctgccaagcttgtaaatgtagaagattgggtgcttaataaaggtcagatggatatgtttttcaaaaaaaaaaaaa

SEQ ID NO: 73138 - DNA, 583 bp, Triticum aestivum
  Clone ID: PAT_TA_73138
cggcacgagagtatcctgtgcaacgagccaactcgtgcacccagtacaccgagcaattctgggccattggattggaaatagacggactggatgttatcataacgtgactgcgggtatatttacacaatagaccttgtcaagttattgaattgcgcaaaagttctaccgaaattccactccttcccttgctctgtcccgttgtgtacctatctcttcagcaaaactctcaccccgatggctgcaatcccttttccctctatctccacaatctatccctgtccacaacggtgctgactatggcttggcaggaccgacgcacactcctggtcaccgccggtccgccgccgccgttgcaggctcagattcaacgccatcgcaaattcctaacaagctgagttgctttctttattcagatcgtgagttgcatatttatttcacaggcgcaacgaaaaaagagctaagaatattctcctgattactgattacggcggatatcattgaacttcttgtatatatgagccttctcctattgatgtgtgtgcatttgctatgtccaaaatagaaatcagactacagttggtat

SEQ ID NO: 73139 - DNA, 574 bp, Triticum aestivum
  Clone ID: PAT_TA_73139
cgccggcgtcgtctggcggcgtcagcgtcagcgacgtgctctggccttccgccggagcgttcttggccatggcggtactgggaaaaatggaccagatggtggcgttcaagggagtatccttgacgattgcgccccttggagcagtctgctgcgtgctttttagcgctccaggctcccctgcagccaagaaatataatatgttcgtcgcccagattggttgtgcggcttttggcgtattagccctctcgttgtttgggcctggctggttagcaagaggcgcagctctttcagccagcatagcattcatgaccatcacgggtgcctcacatccaccagctgcaagcttgcccctcttgtttatcgatggcccgaagtttcacaatctgcaactttggtacgcgcttttccctggagctgcaggctgcatcgtcctttgcttgattcaagaggtggtgctttacctgaagaagaacttcaagttttgactcaagcagcttgactctatgaattcttgtggcagcaattagattaattattcaatcatgcaccataaattacattgcctgcatttacg

SEQ ID NO: 73140 - DNA, 437 bp, Triticum aestivum
  Clone ID: PAT_TA_73140
attcggcacgaggctgaggcggcggccgtgcggagcaagatggtgtacgctagctcctgcgacggcttcaggaaggagctggacggcgtgcaggtggacctccaggccaccgagcccagcgagctgacgctcgacgtcctcaacgaccacgcatcctgatgaatgatgatgagtgcttgcatcggcgtccatacattacgtcaccgttgcgtacgtacacgtatgcgttcgtatacatggcgtgcaaggtggtactaccgtgtacgggactacgggggtgctttgcaggcagcattggtgtgtaattaatggtgatatataccgagtcgcgtgcttggattgtttcctttccttcctgtaacgttgctgatacgtatactacacgaataaaagtgatgaattggtcgctctttttattaaaaaaaaaaaaaaaaaaa

SEQ ID NO: 73141 - DNA, 706 bp, Triticum aestivum
  Clone ID: PAT_TA_73141
tcggcacgaggtcaggtggaggtggtcgtgctggcgccactgttttgcttcatgctgatgcggtataaaagtgcctcctcggcagatgaggacctgagcgtggccatgctaatgaggatgcaggatccaccgccaccggccagtccgagtgattgcagagaacttggcaggcagatcaattacgaggaggtcaaggctgagctagaatggggtgggcgccaacatgaaggagctggagatatctctatttttgtcagtcattattcaggctctaagcttcccctttccctataccacattacttgatattattaaattcagtatgcttactcaactgtgaacaagttcatgtggtaagtaggatcaacaagagttggctggcaactgctatgtatatgttattatggatcagccaaggtggttaaattttatttttttcctttttcttaatttatgcccttaagtttatgctgttaaatgcatacacataacttagttccagatttaacaagagtacattttacaatgaacttcatagctgatgttgatcataattagtaagtgtacaaagcatttcaaggaatttctgttttgtgcatattgtatattgcagacttgcagtgaagtagtgccatctaagtaccagatgtatgttattttcaaataagcttttcttaaaatggaaaatactaaaaagcaaattgtg

SEQ ID NO: 73142 - DNA, 523 bp, Triticum aestivum
  Clone ID: PAT_TA_73142
tcggcacgagggctgcctgaaagctccctctgtttccttgtcttctccggttgtccggcttcgtctccctccgcctctccgcactcagtcgatggcctcacccggagcagcaaagttcacgcagatggaagccgcgcggcagtccctcatcgccatctcccagtcggtgccggagatcggggcgcccgtcatcaggcctcctagcggcggcgtaggcggatgcggcatggatgagaacgggcacgagaacgtggcggagcagaggtacagggcgaagctcatctccatctccaaccagtcgcccgacgcccggcctacgccgtgccctcccaagaccggcgccgcctaaagagccgtgtgtgtgtgtaacgttgccgcatataggtgtacgtggtgtaccggaactaccggttgtgtgttctgctaatccactcgtggcccaggaaccaggacactgggccttaataatcgccttgaactgccaaagggaatacttgtgttcgagtgtgaaaaaaaaaaaaaa

SEQ ID NO: 73143 - DNA, 542 bp, Triticum aestivum
  Clone ID: PAT_TA_73143
cggcacgagctcgcacgcacgcacgcaccaccaacaccgcaccgctcctcctttccctcagacccacccacagccacaacagcatatatcatcagtccgccacgccgccgccaccgtcgcgacggcacctcggcatcgacctcaacctctccatcagccttgcaccctaccagccggacgacccagcggtgaaacaggaggcagcaacgacggcgagccacaacaatgcaacaacgtccacgtcggcggcgtgcatgtgcttgaaccgcctcgggttccagggcgccggcgagggatgccgctgcggcggcgcttcctccgtgcccatgcagcagcaggccagcacgcagcacatgttcagattcatcgcgccgctagagggcggacgccaatagtagcactagtaacagtaacattcggacatatacctttttaactaaagccacacatggttaattattaattaaactagctagctctctgtatcatgttcatgaggaaattaaatctaccccctttctattaaaaaaaaaaaaaaaaaa

SEQ ID NO: 73144 - DNA, 608 bp, Triticum aestivum
  Clone ID: PAT_TA_73144
cggcacgaggggggttcgtgggactatgggccacatagctcctgagtacataaagacaggaaggccatcagtgaagacagatatctatggatatggtgtcatgctgttagagattgtgacaggagagcgtgcaattgcattccatcctgaccgtatggaagaagcaggggagatcatgctcattgatcaggtcaagctatggatggaagaagggcgactactcgacctagtagatcgcaatctaggtggcgtctacaaccttgaagagctggagaaggttacccagatagcacttctctgcacccacatggaacctagtcaacgccctacaatgtcagaggtcgtgcagatgctggaaggagagattgtcccagcagagcggtgggaggaatggcagctggctgagctccaacgacgacaacagcatgagatgaggcaacagggaaaactattcaacttcagtgaagagtctctaaacatccaggaagccattgagttgtcaactggcagatgagctgtcataagaaagtgacatgattttcactcgttccttaagtagaaaggctatatggaaatttcaggagtacgcactacaaatattgactatt

SEQ ID NO: 73145 - DNA, 309 bp, Triticum aestivum
  Clone ID: PAT_TA_73145
agggaggtagagccgccttctctccctgcctcttccgcggtggtcgaggtgcagcagcgtcggcgccgccaggttctcgatccagtcggatctggcgccggtcgccgtccccgtcgcctcgtcttctttctttccaacccaccgcctccgagcttctgctcctgctacgtctccttctcccttcccgccgcgggagcagtcatcgctgcgccctcgcccccgcacgccgtccttccgcgcgcctcaccagccaccaccagcagcagcgtagggagccaatgggaagggggtccaaggccaaatcctgct

SEQ ID NO: 73146 - DNA, 699 bp, Triticum aestivum
  Clone ID: PAT_TA_73146
tcggcacgagatgaaacttgctaatgcactcttcatgttttatcctgttttattgttgttgcgaactcacagttgatgcaggctagatttactttctatatagcctggctatcaacaaattaacggagaaaggtcttttttggaatgtttccgttcttgtttaggctttctaatgagctactatccatgtgcttgtgtaatgtgcataatttgtagcttaaacattaagcatataacccaataagagtatacaaacatgaaacatgtgccgttaacaacttgagtgatgaaatcttcatcaggtaatgatcaacctgctataaagatcttaatcaaatgatttaatttgccaaaatcacaccgcttttgcaaaaccagttcttttgaactgaagaagagtggagggtaaccttaggtcaataatttgcacctttactagtattggtctgagattttacttttgtttctttgcaacttggactatggtctggaggttttacttgcgtttctttgttccttggactattggactggaatccatgtcctgttaagttatacattccctatgtttggtcagtagtaaatcagttgttcatgccatgtaggatacataccaggtagttctttgttgtgatacttcctgtgtagggagtaatgatgtaacctgcaataaataccttgatcaaatgaactaatttg

SEQ ID NO: 73147 - DNA, 595 bp, Triticum aestivum
  Clone ID: PAT_TA_73147
attcggcacgaggagagagagagagggaggagcagtgccctgggttctttggatgctgatggcgggggcctccaacggaacaagaggcgaaggataaactgaacattctgcgttgtggtgttgatctaaactctgcatgccatgctcgctgattttcaactattgcatttcatttcttcgggtgatgtctcctgtgttgtagtgtaacattttttcttctcttttcattttcccccgtaagttgcactgaaatgtttatctgtttagttctcatgtagcctgtacctgtttaatttatggaaagttattgatcaagacatttttgcattcaaaaggtaatgaatggttcaactgcatttccatgacaataaattggatgctgaaatgtgcatccaacacaatggtattcttgtgcatcaaataataggcataaacattgtgtttttatttgtgtcaataagctccttcagacatatagaaaactaacaggtcaataatgtagtatattgaagttggaaggaatacccagagaatggatccatggacacaattgtcttttgttgcttgggagaagtacatagcctgatctttagtc

SEQ ID NO: 73148 - DNA, 737 bp, Triticum aestivum
  Clone ID: PAT_TA_73148
gctcgtgccgaatggcacgagccaatatgtcataggccggattctgtttgagattcgaatctctgtaggctcgctgttcaagtttcatttatttagttgtctcgtatactccaatatatagccttaacagaagtaaatttcagttacagcatggatcattctctacacaaatccacttaggttgtttatgactagactaacaattcatcaataagctgaaatctgaggatgaacatatacgagctcttattagtactacactctaggcatgatatgcttgttgtaccaattatcttaggaaacaatcttgagttttagaaaaatgacgctggctatttcttccctcacctacgtactatagatgatgagcctttgttatgtcaattacttctttcaccatgaattttgtgtaggtcggtctattattggtggatttactttatatatgctgctcaccaggcaaaaacatttttcagtggaaccgcctttgtggatttatgatactctctgaactgtatactttgtatttgttctggtctttgtagtttattagtgtgatgtcctatatgtttagttactagtatgattctctctgcttgttaagttttggcaatatgtatgtgtactgctatctgtaaatgaaactcccaaacttggaactaagctacgctgattctaattccttgttaagggtttagtatttgtcaatgttattagttagctcttccctttctaca

SEQ ID NO: 73149 - DNA, 609 bp, Triticum aestivum
  Clone ID: PAT_TA_73149
cagtagtgatgcattgcaaaatggaaaaacccatccatctttagtctgctgctgttggcttcttccaatctactaacatcaggttgtttcagtttcttttgaggggtttaagcatgaagggtgcaagtcagttgtgatcagtcctggttgtcctccttcagttcatcatgataatgtggctagagagttgtatgcagtttaagtgtcaatcatgcaagtcaccatcttcggctgtggttgtcgggtcgaattcgtcctgatcatgtcgagcgcgaactgtatctctgtttagcatatcaggcgtacttctgttactgtttggttaaatgctcgagttggcgacatgaaacttagaattatgtgggtcctacgccatttccattttctgaaggaaatattgtcattcagtgttttccttgtctagaaaaacatcatcgactggcagtgtaagagtttctgcctttctggacacaattggaaagtttttttttttcgttttctgtttcgagtctgaattgcatatggattgctccctcttcattcgtttggataaacagtggtccagaatgcattgaaatgtgttgtgggttatactgatcagaaaaaaaa

SEQ ID NO: 73150 - DNA, 375 bp, Triticum aestivum
  Clone ID: PAT_TA_73150
cgcacgagggtgggccgggcccaagtccagcccggcacgttcttgatcttgttccgtcaccgtcaccgcatcttttgttgtgctcgctgaagaaacaacacgagacgagcatgagtgatgagaggaacagatttcgtaccggatttgtggaccttgtttgtttgatttcgtttgcccaagatccaagcaaactgagaaaaacttgtggttaggaataggggaaagagcatacataaagttgggggtcttaatgtaggtcagcagtgtatttgattagagcatctccaagggttttgcaaataaactttgtattactttatttgcaaaaaagagtagaaagtatctctcctaaaaaaaaaaaaaaaaaaaaaaaaa

SEQ ID NO: 73151 - DNA, 535 bp, Triticum aestivum
  Clone ID: PAT_TA_73151
ttttttttttttttttttttttttttgcaattcagaagacacactgacaaactatgccaagacaagtcaatactacaatgtatcaagtctgtcggagtggcgggtacagagtacagagcggacatagtaaaaccatgatgggcaaacaaacagcgccacggacaatttaacacccacgaaaacaatctgatagctagctctttgacagaaagctttatctttccaaaacacccacattatctgtcaagactatatagtttataatacgtaaaggcagtattagtccgaatatccagcttatccagatccataaaagcccctgccgagatgcttcaagccttgttggcaatgttgttggacagccagtcaagcccctcgtacaacccctctccagaagtagcacatgtgctctggatgtaccagtgtccctggcgcaaaaaatgcaggccaagcttgtcagtgatttcagcagcgttcatggcattaggaagatcttgtactctacagtttcgacattaaaccccattgtggggat

SEQ ID NO: 73152 - DNA, 492 bp, Triticum aestivum
  Clone ID: PAT_TA_73152
cggcacgaggcagtcatctcgatccgccgatcagttctgtctgtgttgatcgatcacccgtcgggaacaccggccagatctcacaattgatcaagttcgaccgccgccggccgcgcgcagatcatagtagtccacagtataacgcgggagggcagggggccagcatcatgccgtcgctgatgtcgctgacgccgtggaggaggaagaagagggcggcagggacgacgacgacgactccggcggtggcggtgcggacgcggcggcggggcacctcgtcgctgggggcgctgtggcggcgcctggtgcggacgctcacctgctcgcgccgcccatactactgatgtgtatcggtatcgatccatccatcgatcgatagctcgttgcaacatttggcgttgccgcccgggtgcgtagtagcgatcgagctgcagacagatgccggatatccatccatgcaatgcaagcaattaaactaaaaaaaaaaaaaaaaaa

SEQ ID NO: 73153 - DNA, 702 bp, Triticum aestivum
  Clone ID: PAT_TA_73153
tagtggtcaggtcatacttcctttagcccacacgtttgaccctgaagattccttgaggttataaaattagggaatgccagtaattatcaagacgcactcctgcaccgtgatctgtttctgttacagatgtacaatggggtagacgagaatatggtaggaacttgttcagagctcatctttgcccctatagacgcatcattcagcgatgactctccactgctcccatctggtttccgcatcattccgatcgacgctcctctcgacacatctagccccaagtgcacattggacctagcctccacccttgaagttggaactcccagaagcaggataaatggcagcggtcctggaaatgctgcttctgctggctcaaaggctgtgatgacgatcgtgtttcagtttgccttcgagagccatctccaggacagtgctgcagccatggcaaggcagtacatgcgaagcatcattgcatcagttcagaggatcgcgctggcgctctcctcctcacgcctcgttcctcatggcagcagcatcagtcacactcctgctagtccggaggcaaccacgcttgccagatggatctgccagagttacagatttcattttggggctgagcttatcaaatccggagatggtagcggctgtgaaggagtgctaaaaaccctttggcatcatgccagtgctatactctgctgctctttg

SEQ ID NO: 73154 - DNA, 512 bp, Triticum aestivum
  Clone ID: PAT_TA_73154
tcggcacgaggcgctaatcttgctgattcttggcgtctcgcttgacttgtttggcatgcacatgaacaaatcgttgtatagtctgagctacacctgcgtcaccacgggctcggcgggtctcttctttgcaggaatctatttgctggtggatgtttatttttacaagaagccgtttttccctatggagtgggtgggtaagcatgctctcatgttttttgttctagtggcatgcaacatcgccccaatcctgatacatggcttctattggagggaaccacagaacaaccttttgaaattcatcggaattggaggctgaccgcttcgtcgatgtctacatgatttgttcaggggaaaacaataacacagcatacaccaccgatttcgtcaatagtgcggtgcccacatgtttagagttggctcttactcttacacggagaaagtcaatgtacaaatcatgatctctatatgtgttggtttttttttctttttattacatttcgtcccatcagaat

SEQ ID NO: 73155 - DNA, 772 bp, Triticum aestivum
  Clone ID: PAT_TA_73155
cggcacgaggctcccacctcagccccgttgctctcttcctctgctccgcagcatccttgagcatcgtctaagccagctaacactctcttccctcgtcggactcggccatgagccggtttcccgtcacagagccccgccatggccgccatgggagcctgcgcacgtggccaggaggccacagaccttctccggccaagccgctgacaccagcgcgagcgcgcgagcctcaggatgctccccaacgctttccctcgctgccaacaagcgtccaccggccggaaatcaggttttctccgacatcctctgctctggaatcgcgaccagggacttcgcgcgacaatttgaagttctccaggggtctaattgcacagactgtgactcaggtgaatagtgctataaggacttgtttgtagatgttttgttgaatctttgaaaattcatatctggagtttggtagctccaattttggtgaaccaaattttgttgtgctccttgagatgtctagtttttattaaaaatatgaaactgaccatgttttgtagtaaaataattagttatgatttatgccttttaattatgtttaaaagggagaaattcatatctcattctgtatagctcctattgccctgaaatttttatggtgttctcatgatgttatgtgagtgttgcagtaaaaatttcatgttcagtagatgatatatggttaagttattaatttatcttgtttagtgcttattaaattatctataattaaactaaaaattaataaata

SEQ ID NO: 73156 - DNA, 786 bp, Triticum aestivum
  Clone ID: PAT_TA_73156
ttcggcacgaggggccgacatatggtcctgtggggtcatcctttttgtgctattggccggttatcttccattccatgacaagaacttaatggacatgtataagaagattgggaaagcagagttcaaatgcccgtgttggttttctaccgatgcccggaggcttttgctaaggattcttgatcctaaccccagcacaaggatctcaatggaaaaaatcatggaaaatccatggtttaggaagggcttagatgcaaagctgcttaggtataatttacagtctaagaatgcccctcaggtagacaagaatgcagattctgattcactaagcatcaacataacagcagagagcaagcaacaagaagaaaagaagcctaccaacatgaatgcatttgatataatatctctatcaactggtttggacctctcaggtttatttgaagaatctgacaacaagagagaatacaaattcacatccaccaacacaagctcaacaatcgtatcaaagatcgaagatgttgcgaagaatttgcgattgaagttgacaaaaaaggatggtggtttgttaaagatggaagcttcaaagcctggaaggaaaggggtgatgggtatcgatgctgagatatttgaggttagcccaaactttcatcttgtggagataaagaagacgaatggcgacactctagagtatcaaaaggtcttgaaccgagaaatgaggcctgcactaaaggacatagtatgggcttggcaaggtgagcaatcaaagcagcaacaaactatgatctagtg

SEQ ID NO: 73157 - DNA, 678 bp, Triticum aestivum
  Clone ID: PAT_TA_73157
attcggcacgaggcatatatataggacgccatatggggcaccatggtgtgtgcgtgtgctggtgatgcaccatggtgtgtgcatgtgctggtgattgttcttctccagctgcattatgcatctcttttcaaatcttatgataggtgcttgtgatgccatccagcaaaaccactggttattttgctggtatactgatattaggcccataaatgaatgtttttttttgctttttacattctttggtgatgaagtttgcaatctatgacattagaaaaaaggtatggtgattgtttctatttttcagtatgtgatttttccaatgtttttcaatatgcctattttttacacatctatactccttatgcattatgcatctctcaatagttgagagccttattttattttccttgcaggaaatgctgttgatcaatttaattttgtattacgctactgtaagatggcttgataggagttttgcaatacatactgcactacagtaggcactggcacagtttgagagcacaacatatagagtttccttattcaacacaaaggccatatcgtttcattcaacaaatgggctaataatgccattacatttgacgcatgccactacatttcagaacacaaattcagccatttgtttcagaacactacattcctgaacaaagcatacat

SEQ ID NO: 73158 - DNA, 770 bp, Triticum aestivum
  Clone ID: PAT_TA_73158
ttcggcacgaggctatgttgaggccacgtgacccaatgcagatgcttaggcctggccagaattcagaagagcatagacagatgatgatgccagagtttcagttacaagtctcacagggaaataatcatgctgtgcatttcaacggtccaccatattccaacactggggcatcttcacctgtccaatctttccctgtccagcagtcccaaccacatcagatgccacaacaatcacacatgtatggaaacacacaccttcctcatacccaaggaacaaaccagtcaaatccacagcagcagcaggcttatgctatgcgcttggctaaagagagacatattcaacaaatgatgccccaacaacagcgcccactatctggagccagtgcagtgccagctgtacagaacggctcacagatgcaacagcagagccaaggatctgcaaccggtgtgatcccagctacacagccacagcataagcagcaacatcctgcacaaaatgcacaaggtaacccaatgcttccccatcagccttcagccactacttcacataaacagaagaagcaacagggccagcagcagcctagacaaaatcaacagcaacgaaatcaaggcagtcagcaagctaagcttatgaagagcttaggccgagggaacatggtgcaccagagtcctgtggatgttactcaagctagtggcatttcaacaagctgtaaaaatcaagtttctgataagaatgtgatgcaacagggtccagggcattttgttggtggc

SEQ ID NO: 73159 - DNA, 742 bp, Triticum aestivum
  Clone ID: PAT_TA_73159
tcggcacgagggtaaaaggaagcttcctgttaaaggtttgaaagatgaactcgttaggcgactctttgactccattcagagtgaaagagaagctgaggaaactgaagaagctgatgaggatgtgggagtgaatgtggatgatcagttacctgatgccaatgctagtgaggaaaatacagttactgttacagaagttcatcaggaaactgtggttcatatcactcagcaagttgaagctcctacaaccgaagttggtcaggaatctgctctttctcccactagaggggcccccagtgttgatgttgaagaggcctcaacagccaaaggagaagtacctgaatcatttgctggaacatttgaagaagtgcaagtgcagactgaaagtactaatgagcctcttcatgagaagacctcagacattgacaccaatgaggcagtcattgtcaatgatgcaatcgatgtgaattcagacttgacccctgctgaagtcaagcttggtactatggaagcaagcaaaattgaagaacaggatttccccccagcacctgtagatgccttaacttcagatgcttctggtcctatggatactgatgttgtcacagctgcaacttcagatgctggtcctatggatactgatgttgtcacagctgcaccagttagcgacgatggggagaaactggcacccaaggatgatttgggtaacaaggtgtcaatgtatgatgaagagcacaataattctgat

SEQ ID NO: 73160 - DNA, 689 bp, Triticum aestivum
  Clone ID: PAT_TA_73160
cccttatattttacccaaatcaatatgacctcactgacgaccgatgagcttctgtgctcttcaatcagtatgccacatgcgaatgactgatgaagattttctctactcttaaatccgagtgatcttaatattgcaaaacttccttcgcttccaggttttatgcttcaacttataatgcatgtacttagtataaaggttagtactgcaaaactttcttcactttcagtctcggtgccgcctacgagcacctcaacctgcacaaagattgggagaaaaggatggcaatcaatttcctatgagtcaacatgatcaggtagatatgcagccgacagaagcatttgcttggtcaggggaggagaaggagaactgttgtgtcacacatgaactacaccatgaactactcctctgcttcgttagtcggatgcattattttttgcatgcattgctaaagaagccctctaaagaaattactttacaaaaatgttcaaatcttctctaatggtctgccgacaataatcttctgtgtcattcaacaaacttctatttgtaatctctgatgtgtgttgaatgtatctctagatagtcacaatattttgatgattgcaggttacttttttttattcggcgattgagtctcaatcattccgatgctttagtgttgtgacttgtgagttacttcaacatatatg

SEQ ID NO: 73161 - DNA, 699 bp, Triticum aestivum
  Clone ID: PAT_TA_73161
cggcacgagcaagtggcactgttgggcacagctccatcatctgggaggcctacgagaatccagacgtcaaactgaattttccatgccgagcatgggtcagggtgatgcgtcctttccatccaacagaatttgtccagagtatggtgaaacagtttcacacagcggtgggggtcggtgtgctgctggagggggaaaggaaggagcaagatttggctcaggccttcaatggatatgtcaatgagaacaggtacctgattgtgcttactggcctgtccacaattgaagaatggcaccagatcaagacttgtttcccagagaacaaactggggagccggatcatagtatccacggaacatgttgaagttgcaagcctatgcccggggcgggaaagtactgtatcagagctcaaacaattgtctgctgaacaaaccatctatgctttctaccggcagagctctcatgctgttacatatccatcaaagccaacatctaggtcaaagttatccaacatccctgagaatgagatacaagaagaccaatccaatgctgatgttgatggaaatatgatagcgcaaaagaagttaacacgcgcctacacaatggcaggtgttcttgaggaatttcagtttattgggcgaaagcaagaaaaagaagatattattgaactaattgtaaaacaagatagcactcatcaagttc

SEQ ID NO: 73162 - DNA, 758 bp, Triticum aestivum
  Clone ID: PAT_TA_73162
cggcacgaggtatctatgtcgttgccacaaataatgaaagtgacagagctccctaagttgaaagcctggcctaagagttgggagaaggcatcagtacctagtgctgagagtattggcttatttttcttttcacagaatacgaggtcaaataaagaatttgatgacctagtgaagcatgtcattgattatgatattgttctagaaactgatgttagttttgccaagctgctagtcttcccttctgttgtacttccagctgaatatcgggtattccaaggaaaacactatttgtggggagtgttcaaacgcagtaaagatatggctgaaagagatgccttagtggaacagaattgtacgacatgtctggcagatgaagatgtcccagaacagaatgccttagatattgtgccatgtaaagccctggatcaagaaatggcgcttgttgtgagcgatatacatcatgataatcaaccatcgctaaccacaagccaagtggtagaaagcgaggcttcatctgacaaaggcccatcccatcctgtgattaactcccctgaaagacccatgtacctgattttggatacaagttgcaaggtcctaaagaaatggagctgcgaaaggatggatacgaagttatcgatgctttagttaccctccaaaaagaaaaaaaatccatcctacatgcagtcctccctgttccattttagaagattcagcatccgagccgtttgccttcatcattccacagacagcatcgatcc

SEQ ID NO: 73163 - DNA, 569 bp, Triticum aestivum
  Clone ID: PAT_TA_73163
gcacgaggttataaagctaccaagaatgaactaaatcttggcaggattttacatgatcccaaaagatctggatttaatcaactagccatggatgagagtgataatgaagcagaactaatcaatggagatattcatagtgaatctgaagttgaagagttcaatgttagctctgttcgtaaaatttaaaccattattatcaaagatatacagcttctttatgtattatgatgtggtatgaataacgcaattattatagcagttttattctgattcatttatatttggatgccaagaaaaaaaacggatgaaattctgtgaaatttgtgctctttaaatgtactcatccatctttttttgaaacatcgaaatttcctttccaggaagtttgtttttttatcagttttttactatcaattatcatcattgaacaaattaacagtcataaagcgtgaaacaggactgcaattatgattgtcaagacttcaaaagattcccggacgactgaccacctcacaaattaaaaacaaaagaaagaaaatttaaataaaaatatgaatatatttaaatta

SEQ ID NO: 73164 - DNA, 479 bp, Triticum aestivum
  unsure (1)..(479): unsure at all n locations
  Clone ID: PAT_TA_73164
gagctgcggcggccttgacgtcaggggcaacgtctcctacgccttcaaccagttgttccagtcagccagccagcagaagggatcctgcggcttcaacaacctctccgtggtcaccaccaccgacccgtcgcaggggacctgccgcttcaagatcatgatcgacaccggccggcacgacctcacccaccaggacgactccggcgccgccaaggccgccgccgtcgtggcactctgaccctccctccctccctgtgacattgatgcatgaggacacgcgcgctcaccacctcgacaactagctagcctagctagagctagagaggaaggatcaaacaattctttcattcttttcttcttcttcttcttcttcttcttcttcttctttatacatatatcggctgtcaatcaagctccctgatcgatcggcaaggattagaattnaaaaaaaaaaaaaaaaaaaaaaaaaaaaaaaaaaaaaa

SEQ ID NO: 73165 - DNA, 542 bp, Triticum aestivum
  Clone ID: PAT_TA_73165
ttctccagaccgctaatgcgaccgttgaccctagagctcttgctatatttgagcatgcatcgaagcttgttggaatcgatgaacccaaggctgagataatcaagctgctaagagaagaggatgttcgtgcttcagagcaacaacaacaactgaagattgtctccattgttggatctggaggtatgggcaagacaactcttgcaaaccaagtgtatcaagagctcaaaggacaatacgagtgttgggctttcgtctcagtttcacgaaatccagacatgaccaatatcttgagaaccattctaagtgaagtggcgaagaaagactatgctaccactgaagctgggaatatacaacaactcgtcagcaagatcgtagattttctagcagacaaaaggtaccttttgtctttcatattttttcatttctacttgtcatctttgaatgtataaaataggtatttagatgtcataggaagatattactagtggaatttgttaaaaagttccatatagttctatgttcacaaatctccttcaatacat

SEQ ID NO: 73166 - DNA, 460 bp, Triticum aestivum
  Clone ID: PAT_TA_73166
tgcccttgtatagcgtgaaagtagcaggtcaaataactgaaatggcttgttgggcttgttcaccagccactagcctacttgccagaacagagtgcctactgcttggggtttacactactactgctttcaggggtagcacatactgaattcagtaaaaatttcgagttacccggttcgaccaggcatgtcttttgaaggtggggagctggatacaccacctcctctctgtaagcatctttggatcaagatatattgatacaagtagtcatacatagggatagcatatcgtgcgtgcatacaaggtccaaattttgtacgtttgaatattacttgtttcctcaggcctctggcaatcaagactggtgctgcatgctacttttgtaacatttttttagcactgtcacagatgttcagacctggaaagcaattcagttgtctccaaaaaaaaaaaaaaaaaaaa

SEQ ID NO: 73167 - DNA, 599 bp, Triticum aestivum
  unsure (1)..(599): unsure at all n locations
  Clone ID: PAT_TA_73167
gagagcactttctggcaatggaccaagccaacggcggttgctccccgtgcatcgatgacatgatggcgtccccttctatgataccaatcactgctgttgccaagttactggatggctatcttgcagaggttgcaccggatgtcaatctgaaacctccgaaattccaagccctggcatctgctttgcccgagtatgcccggccgctagatgacggcctctaccgtgccatcgatgtgtacttgaaggcacattcctggctatcagaagcggaacgggagcagctatgccggctgatggactgccagaagctgtccctggaggcgtgcacccacgcggcgcagaacgagaggctgccgctgcgcgtggtcgtgcaagtcctcttcttcgagcagctgcagctgaggacgtcgatcgcggggtgcctgctggtgtcggacaacctggaagggtcgtccaggccgctgcggagcggctgcgtggcgatgtccggcgaggccngggggtggtcggcggccgtgagggagaaccaggtgctgaaggtgggcatggacaacatgcggatgcggctggcggagctggagaaggagtgctcggacatg

SEQ ID NO: 73168 - DNA, 673 bp, Triticum aestivum
  Clone ID: PAT_TA_73168
gcacgagggccccgcccggcccaggcaaacgcgcacggcagggaggagacatgcccatcactagtggctgatgagacggcggcggtgcatttccttctgtggggcaccgagtgtgatgccttcgagcctggggacatcgtgcggctcacgagtggcatcttctcgtaccataggggcaacaacctgttcttgcgcgccggcaagcgaggacgagtggagaaggtgggcgagttcaccatgatgttcgtcgagacgcccaacatgagcgaggtgaggtgggggcctgatccaggcgacccaaggaagatggtgcaggaggctgtcgtgtcgccctactcccaagtcttcaagccgctgcattgatgcctatcatttcaggcttccagctcattgttgctccaagtctcattaaatcttatacaatactaaccgtggtagtaaattatgcaatactaaccacttgctgaattttgtatgctttctccttaaagtatcactgggccatcgttttaatgtcttgagatatttctcatgtaaacggagctcatagaagatttagcaagccatataccaagctgtgttgatgtgaacaacagtgtaactttttccctgaaaggctcaaaatacaactgaagttgtaggcaagagtttgattaaaaaaaaaaaaaaaaaa

SEQ ID NO: 73169 - DNA, 688 bp, Triticum aestivum
  Clone ID: PAT_TA_73169
ttcctcccgggacgacgacgactcggagatgtaccggaaggaggagaaagagcaccagcacaaggagcacctcggcgagatgggcgccctcgccgccggcgccttcgccctgtacgagaggcacgaggcgaagaaggacccggagcacgcgcagcggcacaagatcgaggagggcgtggcggcggtggcggcgctgggcagcggcggcttcgcgttccacgagcaccacgacaagaaggaggccaaggacgcggcggaggacgccgaggaggagtccggacgcggcgaggggaagaagaagcaccacttcttcggctgatgatggagctgctgctgctcttcgctactccaacaagcagcatgcatgcttgcatgcatgcagcagccagctggagaataaaaaaactcagtgtatccgtttatgtatgtatgtatgatgatgtgccggtatcactgtgtagttatactgtgatggtgtgtctgtgtatgctgttagctttgtgcactgtggagagtacgtgtagtgtgtgtttatttggtgcatggttacggacttacggtgtgcatggctgcatgtgcatttgcctaataagttgtttttcactcctatgtggtatatatatgtaaatgttttaattttcacttgacttttcttttatcaagactttgagaataaaaaatttcttct

SEQ ID NO: 73170 - DNA, 649 bp, Triticum aestivum
  Clone ID: PAT_TA_73170
aaattgcatccagggacaaatctgtctgagttaagtaaaacggctgatggcataaaagttgtaactgataaaggagaagagctcattgcagatgttgttctatttgcgacagggcgcacaccaaactcccagagattgaacttgcaagctgcaggcgtcgaggttgaccagattggtgccatcaagaaaactgtgtttggtggccaggaagttaagcctgactatggagatgttccttgtgctgttttctcgcgccaggagaagactgtcatgaaactggtagttgatgctgaaactgatagagtacttggtgcatccatgtgtggaccagatgcacctgaaattatccagggcattgctattgcgcttaaatgtggagccaccaaagcgaacttcgacagcactgtcggaatccacccttctgctgctgaagagttcgtgaccatgcggactgtgacaaggcgcgtgagcccgacatccaagccaaagacaaacttgtaagcaagagttgatgttctggggaatgttacacaacacaaatattctggtttcattttggtaattctacgtcattcaaactggaacactgtatattgaaggaatagggtttttgcatgacagtccacacaaaataatgaaagctcaagct

SEQ ID NO: 73171 - DNA, 508 bp, Triticum aestivum
  Clone ID: PAT_TA_73171
aggtgcatttgtcatggacccttggtggaatcctgccgtggaagagccagctgtcatgcgcatccatcgaattggtcaaacgaagactgtttctatcagaagattcattgtgaagggcactgtcgaagaacgcatggaggccgtccaggctcgaaagcagcgaatgatttctggagctttgactgaccaagaagtccgcactgcacgtatagaagaactgaagatgcttttctcttgagacgaaaaaaagggctgttgagcatctgatggtcggcatgcttgcacattgcatccatggctaaaacaagatggccggtgtcctttttttctcaaagccagaagttggaaggtaaggcgagggtaggaaatttgcaccgcccaaatatcttccatcttcgggcgtttagctgttgttgtacgcgtggtttgtatatcatgaacaaaatttgagtcagcaatcggcagaagaaaagtttcttttgtaaaaaaaaaaaaaaaaaaaaaaaaa

SEQ ID NO: 73172 - DNA, 624 bp, Triticum aestivum
  Clone ID: PAT_TA_73172
tcggcacgagggtgcactgcagggccgggtttctgacgccggtgaggaacctgctgggcttggttcggggtcccaagtacgacggcgtgttcctgcacgacaagatcaagagcctcacccacgacgtcaaggtggcggacacggtcaccaacatcatcgtgccggcgttcgacgtcaagtacctgcagcccatcatcttctccacgtacgaggccaaggccgacacgctcaagaacgcgcacctctccgacatctgcatcagcacgtcggcggcgcccacctatttccccgcgcacttcttcaagacggaggccaccgacggcaggtcccgggagttccacctcgtcgacggcggcgtcgcggccaacaaccccaccatggtcgccatgtccatgctcaccaaggaggtgctccgccgcaaccccgacttcaacgccggcaggcccaccgagtacaccaactacctcatcatctctgttgggactgggtcggccaagcaggccgagaagtacaccgcgccgcagtgcgcgaaatggggactgattcagtggctctacaacggtggattcactccgatcatcgacatcttctcccatgccagttctgacatggttgacatccatg

SEQ ID NO: 73173 - DNA, 670 bp, Triticum aestivum
  Clone ID: PAT_TA_73173
attcggacgaggctggcaaatgatacccagggaactgttgaagctgcaaaatggttgcacaaagtggtcgacaggcccaatgtctacataaagatccctgctaccgcagaatgtgttccttctatcaaggaagttattgctaatggcattagtgtcaacgtcacacttatcttctcgattgcaagatacgaggctgtgattgatgcttacattgatggacttgaggcctctggtttgagtgacctatcccgagtgaccagtgtagcgtccttctttgtcagccgagttgacacacttattgacaaaatgctcgagaagatcggaacacctgaggcacttgccctcagaggaaaggctgctgtagcacaggcaaagctagccaaccagctttaccagaagaaattctctggcccgaggtgggaggctttggtcaagaaaggtgccaagaagcagaggttgttgtgggcatctaccagtgtgaagaaccctgcatacccagacactctttacgtggatcctctcatcggacctgacaccgtttctaccatgcccgaccaagctctgctggcattcatcgaccacggcacagtttcgaggacaatcgacgcaaacgtttcggatgctgaaggtgtatacagtgccctggagaagctgggtatagattgggatg

SEQ ID NO: 73174 - DNA, 537 bp, Triticum aestivum
  Clone ID: PAT_TA_73174
attgcctaccttcaaggtgaggaaagagaagcttggtgacagaatcacagcacttcagcaactagtctccccttttggaaagacggatacggcatcggtgctccacgagaccatcgagtacatcaaattcctgcatgagcaagttggttctctcagtgctccttacctaaagaacaggcagcaagtgccccatcacaaggtcttgagggatggaggtgaggcggcggcggcaaacggagaactcaccggccgagggctgtgcctagtcccgatatcgagcaccttcgcggtggccagcgagacgcctctcgatttctggacaccgtttggaggccctgcagccttccggtagtagatgtgtatctcatccgggagctagctagcagctcttactaattagaataatttgaaagttctagctaattataatatcaagtgctaactcacatcacatgcagtagttactagtgagcacatatatatatatagcaatctatgactgaagtatggagtatatatatatatatatagttgaat

SEQ ID NO: 73175 - DNA, 547 bp, Triticum aestivum
  Clone ID: PAT_TA_73175
ggcgtgctccggggagctggattgggggcgttcgccggagctgtgctctccattgaggtcctcgaggcttctcgtgcttattggtgctcggaccggctgggctctcatggcacatcctccatggcagatttcatagagcagctcctccaagcgcggtttgtgcaagagcaaattgtaccttcaggatatgcaacgcatcgttggcaggtcagcatttcagattttggtcatgatgatctgtatgatatttttggagattgttcatccaaagggctttcacgggagtcactgaataaattaccacactatgtggtcactgaccaaacacggaactcgtttggtgaagacctctcttgcactatctgcctgcaggatattgtaaccggtgaaacggcgaggagattgccgaattgctcccacactttccaccagccttgcgtggacaaatggcttgttggccatgggtcttgccctgtatgtaggcaatgtgtgtaacaacagaaggtaaaaaaaaaccctgcattctgcaggctctccatcttattag

SEQ ID NO: 73176 - DNA, 707 bp, Triticum aestivum
  Clone ID: PAT_TA_73176
cggcacgaggccccaatcttgtgtcccgttgtcccctggttgtcctctctctcagatcccactgcgactacatcgttcaacgatcgcgcgtgaatctaaacgtggagctacagcgcaacaaccaaggtacaaaagataatctacatgtgcaatattagtcgtaatcaaatttccatatcattcagcgtttcataattatcactgccttaaaatatccctagtcacataatattcctggatttactttaaattgcttgaattacttaattattattatcattgccagttaatatccctgataaacagcagtattatcatccctagaagtgcatctcacattgactcaagttgattaaagttacgcttggtaattggtttaagagcagctggaatactacgcaattgttctaacgaatatctagtacttgctttgaatacttaaatatatccataagtcggtgtagtggtaatatttgcttccgagattatgtgctcagctatatactccgaactgtcaactatcagtttggaagtatgttatgttggtcaaatactattatgatgtttccagcatacgattggagaactctttgtccaatttaagtgaaataagctcttgttcttgcccagaatttacagcgctcgtgcgccttaatatcaactaattgtgtatgatttaaccgctcagctctttcactttgcccttt

SEQ ID NO: 73177 - DNA, 650 bp, Triticum aestivum
  Clone ID: PAT_TA_73177
ttgcgaaagagaaagctccttgtattatatttattgatgagatagatgccattggcaccaagcgatttgatagtgaagttagcggtgatcgagaagttcagcgaaccatgttggaattactgaatcaactggatggattcagcagtgatgagagaataaaggtcatagctgcaacgaaccgtgctgacatccttgaccctgctctgatgcgatctggacggttggaccgaaagattgagttccctcacccatctgaagaagcaagagctagaatcttgcaaatccattcaagaaaaatgaatgtaaatcccgatgtcaactttgaagaattggctcgctcaacagacgacttcaacggagcacagctaaaggcagtttgtgtagaagctggtatgctcgctctacgccgggatgctacagaggtaacacatgaggacttcaatgaaggaatcgtacaggtccaggcgaagaaaaagtcaagcttgaactactatgcttaagctatactttatgcaaaaatgtggaccacaagttgtttgtaacactactgtatggatgatcgaagctacgtttttacgtttgctttgagagtgcaagtttttaacattatcaaagatttttattcagcctcaaaaaaaaaaaaaaaaaaa

SEQ ID NO: 73178 - DNA, 666 bp, Triticum aestivum
  Clone ID: PAT_TA_73178
tgaccctgaatcacatgtgctcctagttgatagtttcctgaagaagaacgagcctgctgatgcaaagaccgcattggacagcatgatgcaacatggtcacttgccaagcccagctctgtttaagtctgtcatggaggcactgttcaatgatggtcggattcagaccgcaagcagggtcatgaagagtatgattgagaagggggttactgagaacatggacatggcacacaagatactggaggctctcttcaccaggggccatgtggaggaggcaatcggccgtgtcaatctgatggtggaaaatggctgtatgcctgatctagataagttgctggttggtctttgtgacaatgatagagtgatggaggcgcagaagctggctgattttgcattggacagggacttcgatgttagcttctcgacctatgacagagttctggaggccctgtatgctgaagaaaagacattgcctgcgtactccatgctttgcaagatcaagaacaaaggaggtgttgtcgaccagaaaggttgcgatgctttgatggagagcttaaaatctgaaggatactcaaagcaagcagatattttgtctaggatcttggcagagaattcacagtcaatgtccaagagggggggcaaaaaggttgccatgggtgcttagtgaac

SEQ ID NO: 73179 - DNA, 725 bp, Triticum aestivum
  Clone ID: PAT_TA_73179
cggcacgagaaaaatctaagttcatggcacatcaaaactgaaaaacatgtctttccttatcttctatgggatgtaaaaaaggtgaatcaagaggcacctggagtctacagagtaaggaaattggattatatggactcactgcattctcttgtgcgcagagccacatgctcgacatcttcgcatgcgtcttctgcagcacatccatagtatgcctccttgaggccataacgaccttccaattttctaaatccgcgggctctccacatccaaactcttcttttttgaataaaaaggtattatcactttctaccaggcatgatcctgggtgaccggagtcaattacatgaaggtgatattagtgccacataaaacagtgtgacctgttatcaccagaccgctgaacaggatgctttacaaaggcgaaaggcaaaagaaagagagaaagaaataaggttcggtgatcaacaactatctcagtgaatttgcccaagacaacatagtatgtgtgtcttcctctctgacagcacgcgagctccagagtgtgatgagttcggccaactcagcaagcattcgagcaaataaattataatccacagctgagagaaaaaactcaagaagtactcaggatgatttggccgatgcccaaagtccagccttctgccaaaagttcttaaactgaacaattgagagaatgataggtagacagacacagcttgtcaacattc

SEQ ID NO: 73180 - DNA, 633 bp, Triticum aestivum
  Clone ID: PAT_TA_73180
cggcacgaggcagccaccaatgcttctcgagcttgcaaggttttacagggcagaggtcgcagccagggggagagcaatcacacttctctgtctggctttcacctggaggcttgcctgcagagtgggtgaaacatcttggcagatcattcaggagcctgctgcgtagaacaagggacatgaggctgaggctgcagttggcaactctggcgacaggcttcattgacgttctagacatttgcaatagagttttggataaagtcccggacaatgctggcccgctgatcctaaggaagggccatggcggggcataccttcctctcatgtaaatatttcccttttcttttttagatgcattgggttcagaactttttggcagttaggctatcttgaaaggcacatgaatcttgcaagattatatcagttttcgttggttcggcatcttgacagaagcttggctgtagtcttcgacttggattctcatcgatgatgccatggaagacttttctgattgtatgtacagcagtttgagggaagccggcataggtcggatttttttcagcttcatccggcaggtgttttctcacacataatatactggatgcttgtaattttttttaccgtgcccaaataatt

SEQ ID NO: 73181 - DNA, 487 bp, Triticum aestivum
  Clone ID: PAT_TA_73181
cggcacgagtgacaatgaagatactcaaggaattcaaagctcacggcagtgcggtcacatcattcgcccttcacccgactcaaccgtttgtgctgtcggcatctcgcgaccaactaatcaagctctggaacttggagaagggctgggtgtgcatcaggacattcactgggcactcagccacggtgaaccaagtcaagtttaatccgcatgacaacaacacttttgcaagtgcttccggggacggcacagtgaagacctggggaattttttctcccactcatttcaccagcctcaactgccaagaggggcagcgctctgttgattactatcccacgggtggtgatcagcagcagcagcactacatggttacaggatcggaatggcagttgagaccggacaatgcgacggcacgcatctgggatttgcgaacacagacatgtatccgtgaaatcaaggggctcgagtcatactgtgaagttggtgtgat

SEQ ID NO: 73182 - DNA, 683 bp, Triticum aestivum
  Clone ID: PAT_TA_73182
cggcacgagccgcctccggctcttcattgccgggtgcctctacgtcgacctcttcagttgagctcctgactgagcagaagattacgcgccttcggtgcttgctcgctgcatgctctggttcttcaccgacgggttctgctggttctgctactgactcctctggcattgtgagaccaccttcaacacagtcaggctggactgtgtaggacaacaccccctccggccccgtggaggaacaaccacaaagaaggtgaaccgtaattgtcttgtttgctgtaacaataatgttccatgcaagcccgctaaagttactgttgatgttgtcagccgtgtcgtttaaattcaccttatattcagtatcatggaagagaccactcatggtgacgttgattgcatcacgcacacaaggcacacggatcagcaagtcctctgaaccagagagccgcttgatgggctgggtgggagatgtactgccattgaagagggaggctatctcggacaggctgcgcccttcaggagtcacataaagaaacaaggcggggaagaagaacaaggaatgtctggccatggggaactagcaactggagaggcaactagaatttggttgcagacggtaattcggttgcagagggtaattcatctggcactccagaatttggcttttaatgcttgtatggtacttc

SEQ ID NO: 73183 - DNA, 522 bp, Triticum aestivum
  Clone ID: PAT_TA_73183
gaggtcggcttcttcgcgacatactgttcttgaaggatccgcacacgctgttcaagcgggtgaaccacgcggagacgcagcgcaagcgcatcgtgcaccagaggcttagcctcaacgacgtcaagttcgtcaagaacgccatgaaatgcgtaagagcctttgttttctcattttccttgagatgctctatgcaatattctgagtggcatgttgaaatgttcagtattctttaacatgcatggccttagacctcacgactgttagctaaaactattttgtaaaaatatggtatgaattttgcgtactctcttgaaaaataaaggcaatttccaatgaatagtagcaccagcattttaagatacatcaacccctggatttaagaactaaactacaccgtgcgtatgttcttcatttgttgtagctaaacttctttcatctcctatatccaaatagttagcctcattactagatttttctacatatgtgagctttcacgtcacctcaattattcatagatgtccg

SEQ ID NO: 73184 - DNA, 673 bp, Triticum aestivum
  Clone ID: PAT_TA_73184
cggcacgaggcgatcgcggctgctacgatggcgggcagtgaccgagatctcaagattgaggctgctgcgattggggatggtgtccgcgatctcatgattgaggctgctgcgatgaggggaggtttcaatatggggcctgctgcggtggggggaggtgaccgaggtctcaagatgaagaagaagccgatacgaccggaggagggtgggatcttgaggctgaagaaggaggcgaaggcggcgtgggatcactggttcctgactcgcaggaaggccgcgcagccgcaggaggaggacacgcaggcacccagggtggggaataagaggaagaaggttgtcaagatcaagctgcctaaggagtacgtcgatcacatggccgcatgtcccttcacgatctgcgcagacttctctgacgaggagcttgcccggcgtaccccagagttccgcgaaatctacgctgctgggaggtttctcgagaccaagaatcgtgagtactggaatgcccttatcgctcagcagaaaaatttcggatatgctgaggatgagaatgaggtcacggatgatgatgatgatgatgatgatgatgaggtggtgaagaattagcgcagcaggaagcaaaagggttctatagtttatatataatttaagtagtctgtgttggtgcaagatatatagc

SEQ ID NO: 73185 - DNA, 749 bp, Triticum aestivum
  unsure (1)..(749): unsure at all n locations
  Clone ID: PAT_TA_73185
ttcggcacgaggaaattacatgtgatgttttttgttggctcatatgaatgtatttttttcctattgtgctatcgtgcgttgcacgtgcacacttactagttttaataggcagtcaagttcatccttcaaatgatacagaaggcagtcaagttccatcctctaatttcttgtgttctttgtaggaccaattaggatgtatacctgaaggagtgaatctactggttcagctggaaattgatctctatttggtttctgtttttgcgtttggttttgccggctgctcgtccttcgtatgctcatccatcttggctgctctgcttgcctgcttctcctctctaactcaggttctgcgatctcttgtgttgctgcgtcccgatcttctgctttgtttcatctctgttctgtcatcgaggttagcttgctttctgtctagctaaaatgcatatttcctttcctatatgtgttgtcatggtgtttaaattactgatcattttaattttctagatctggcacgccatcgtgtattgttcggcctcgtcccacttatatgtcatgcttgtgtgtgaacagaatgcgtccgcttatttcagtcgttatacatgttttggaggtcgtggtggcggcgtantgcggtgtgctttatgacgctttcgtacctgtatgaggttgcagaggacgtgtctgtacttgctggggtagaattcaaattgtgagggatggttgtgcttagatttggtcgctgctggtcg

SEQ ID NO: 73186 - DNA, 693 bp, Triticum aestivum
  Clone ID: PAT_TA_73186
cggcacgagggccgttggtagcggtacagagacccttcaatacgtgagtcctgcacgcacctccgatgatccgaacatgccggcgacgacgccatgtatatgtatctctcgctgtgtctcctgtcctgtggtaaatgaaattcctttcgcctgctgtgctgctgctgctgctgctgctgcaggggaacgggcaaagggcgatcgagacgttctcggcgacggacctgcgagactgcccggtggcgcggctgcagccgtggctggggatcagcgtgacggagttcaagaggaaggtggcggagtaccgggcgagcaccaagcccgtggtgcccggcgccgacgccacggacaccggcaccccggccgacgacacccccgcggccgtcgtcgccgcggacgacgagccgagcggcgagcagcaggaggaggaggaggagccggcggcgctggtgacgtgctccccggagagcaccctcggcgaggcgatcgaggcggtggcatcgaggcacgtgcacctggctgtgggtggtcgacgaggaagggctccttcacggcgtcgtgtcgctcaccgacatcctccgggcggtgcgggacgccgcgctcggcgaggaccgggagctgcacagcatcgtgtcgtgagtcgtgactcgtgacgtttggcagtagtagtgtcatccgcctgccgtgctgctg

SEQ ID NO: 73187 - DNA, 533 bp, Triticum aestivum
  Clone ID: PAT_TA_73187
acaactattatattcccagaggaccacattatgccaagattatttacaccctcccttgctaagaagtatgaggaactgtatcagcaaaatggtgtcaaattcataaagggggctcttatcgacaaacttgaagctggctctgatggaagggtgtcttctgcagtacttaaggatggatctgtagttgaagctgatacagtaattgttggtataggagcaaaaccagttgtcagcccctttgaagctgttggagtcagcgctgaagttggtggaatagaggttgattccctgttcagaactagtgtacctggcatctttgcaattggagatgtagcagcctttcccctgaagatgtacgatagagttgctcgagtggaacatgtggatcatgctcggaaatctgcacaccactgtgtagaaactctcctaacatcccagacaaaagcgtatgactaccttccatatttctattcaagagtttttgagtatgaaggaagtgcgaggaaaatttggtggcagttttatggtgataa

SEQ ID NO: 73188 - DNA, 545 bp, Triticum aestivum
  Clone ID: PAT_TA_73188
cggcacgaggttatactttaaacataacttgtatctagtctcttttcgtccaaatcttgcccttccttactgaaattgattgtggagcgtgtgggttgtgagtttcactgtttgacagcaaagtggactattgatccttacaagtggtgaaggggggccactgtgctgattgaagatcttgcaatctgaccaaccttgacatcaaacttcgtatgcagctgcagttctttcagtaggttgaacctgcaaaatgtattctttagtttatcagaatttctgtcatccaaggatggcccaatatttgcggtgaaattggcagatgccacatgccagtatttggattgctttgcatctagtcactgatgacatctgaatgtggatgcttacaggggttggattatttgttgtagaactctagtttccttaccaccaacacaaaccttatgaatggtttggcaacattctagatatcatgtatatattctacactgtttgttgcagtttttttgtgctattaccaattgaagaagtttggtcaggtaaaa

SEQ ID NO: 73189 - DNA, 684 bp, Triticum aestivum
  Clone ID: PAT_TA_73189
gtaagagaagtaacttgagattaagtcggtctatcaagtgtcaacaaacacttgaacattcgttgcacacgttcttgcataatttcgcgaaatttgtggtaaattgcaaaaacaatttctcactccggctacctctgttttcagtttagggctttaactggaaatggagccttttaattttagtttaaagttttaattgcaagatgggaggtggatgcccgcacggatccggcgcctccgaccttggcatccacaaggaggagcggcgacaactctggacccgtctgttggtgctgctgattctgcttggacggacatgctgcctcttccatgtcgactacatgccatggtgagctctctgctccctgcatcttacagtagttggcctgagactatagttgggctggaaattaacttcttcagtttgatttgtaagatataataccagtctaaatcagtggatcatgggtgatatgagattctaactaattccttaagtttgattctttaaccatatgtgtaagtcaaatcctggttcattgcattttaacaatgcaagttgtaccatgagtcattcaacaattacaggatattgtggctttatggatattatggtgcgatctgcaactcactaagcaaagatagtacaatattacaggattactgtacaaatgctataatcct

SEQ ID NO: 73190 - DNA, 779 bp, Triticum aestivum
  Clone ID: PAT_TA_73190
cggcacgagggcatccagatacggcttgattctggacacaagacatgccctaagacacagcagctcctctcccatacgtcactgacaccaaactttgtcctgaaaagcctaatagctcagtggtgtgaagccaacggcattgagcttccgaagaacaaggcaaactcccgagacaagaaagcagcaaaaagctctgactacgaccatgctggtttagtctccctaatgaacaggctgaggagtggcagccaagatgagcaacgtgcagctgctggtgagatccgtttgcttgcaaagagaaatgtcaacaaccggatatgcattgctgaagcaggagcaatccccttgctagtcaatctactttcctcttcagatccaagaacgcaggaacatgctgtcacagcgctccttaatctctctatccatgagaacaacaaggcaaacattgtaagctctcatgctatccctaagattgtggaagtgctcaaaactgggagcatggaagctagagagaatgcagcagccacattatttagcttgtccgttgtagatgaaaacaaggttacaattggtggcgctggcgcaatacctccactcattaatcttctgtgcgatgggagcccaagagggaagaaagatgctgcaacggcaatttttaatctgtgcatataccagggaaataagatacgagcagtgaaagctggaatcgttatccatctgatgaacttcttggtggaccctactgggggaatgattgatgaggcactcactcttctggc

SEQ ID NO: 73191 - DNA, 638 bp, Triticum aestivum
  Clone ID: PAT_TA_73191
agtgggtctcgaccagaacgtggacgagtcggacctagacaaacttcccttcctcaagtgcgtcatcaaggagacgctccggttgcacccacccatcccattgctcaaccatgagaatgccgaggactgtgtcgtcggcggctactccgtgccccggggctcccgcgtcatgatcaacgtctttgccatcggtcgtgacgccagcacgtggaaggacgccgacgcgtttcgaccttcaaggttcatggagggggaaggggaggccgctggggtcgacttcaagggtgggtgctttgagttcctgccgtttgggtccggccgccgctcgtgccctggcatggcgctcggcctgtactcgttggagctcattgtcgcgcagctcgctcatgggttcaacttggcactccctgacggcatggcgccgtcggagctcgacatgcgtgatgtcttcggcctcactgttccacgtgccaccaggctctgcgtcgtgcccacacctcgactcacctgctctttggtcgctgatgatgatgccgcgcaccaggcatgatgtcatgcgtgcacctattgtctttgtgtgccccaccgcctgagtttggtggggttctctttgcctttttcttcttctattttctgat

SEQ ID NO: 73192 - DNA, 570 bp, Triticum aestivum
  Clone ID: PAT_TA_73192
ccttcaggtgcactgctgcgtcgatcccggaatgatggagtcaatgactagtattgctccaagtgtcgggtcaactacaacgatgggactataagatgatgctaacaatttttccatgtacttctgttgtacgaccgctcgtgaaggcggagtgcgtgcggctggaggggattgctgtggaggtgactttttttacatagggagagagcacccagctcatcctccggagcagtggcccgggcacgttgggccaacgacgatgcgcggggaaactggttaaaacgaccatggtgcgtgcggcgggacgatcaattaatctgatgcgttcatacgtgagatcccatggttgacaacgtcaaatcgctgtggatggctgtagctagctccgttttactgtattgtaattgctcctcatagattaaaacatgttgagtatgtttgcaaacctttgacttttacttgtttattattttccagcacagcccacccatgggagcggacacttcgactttgcgttaaataatggatgaaagatgtgttcgttaatgtgatatatggacctagttcaag

SEQ ID NO: 73193 - DNA, 400 bp, Triticum aestivum
  Clone ID: PAT_TA_73193
acactatacttgatttgctacttcttggctagcttctcctttggtgttttgtccatagggcatatggtgtgtggggatacaatagctaaggtggcccatgagagatcatggtgcaagtcatgagcctctctctctctctcatctcggcattttaaatcagtgtgtttaattggttactctctctctctctctctctaccatggatttgggaagaactctctagatgtacaagttaatactagtactttctacaccttttgcagctgaattagagaactgtttttgagttctcatgcattagagttgtcaagggttcatgcatcaagttttcttctttcttccttttttcctaaaaaaaaaaaaaaaaaaaaaaaaaaaaaaaaaaaaaaaaaaaaaaaaa

SEQ ID NO: 73194 - DNA, 679 bp, Triticum aestivum
  unsure (1)..(679): unsure at all n locations
  Clone ID: PAT_TA_73194
cggcacgaggagccgatcccgtgcgtgtgcgagtgtgagtgagatcgacaccactagctaggtcgagaccatggctacagcttacgctcccatggcgagccaggtgatgaagagcagcctgcagctgcactccaagccgaggggcttgtccggcgctgccctcaccaccaccaggcgtccccggttcaccgtcaaggccatccagcccgagaaggcgacgtaccaggtggtgcagccgatcaacggcgacccgttcatcggcagcctggagacgccggtgacctcgagcccgctggtggcgtggtacctctccaacctgccggcgtaccgcacggccgtgagcccgctgctgcgggcatcanggtggggctggcgcacggctacctcctcgtggggccgttcgcgctcacgggcccgctccgcaacacgcccgtgcacggacaggcgggcgcgcccngcgccgcggggctcgtcgccatcctcagcgtctgcctcaccatgtacggcgtcgcgtccttcaacgagggggaaccctccacggcgcccacgctcacgcttacggggaggaagaaggaggccgacaagctgcagaccgccgacggatggtctaagttcaccggagggttcttcttcggcggcatctccggcgtgctctgggcttacttcctcctctacgtgc

SEQ ID NO: 73195 - DNA, 633 bp, Triticum aestivum
  Clone ID: PAT_TA_73195
cggcacgaggtttgaagcactcgtaaagaagatgaatgcagaaggcgctgctttacagggatctggatgggtgtggttagctttggataaagaggcaaaaaagctttcagttgaaactacagctaatcagggtcctctggtgactaaagatgcaagcttggttccgctgttggggattgatgtctgggagcatgcatactacctgcagtacaagaatgttaggccggattacctgaacaacatctggaaggtgatgaactggaaatatgctggagaggtgtacgaaaatgttcttgcttgaattgtcttaatggacaatactcatctgtgctggttttcggctgtttgatcatgtgaaataaagatggacctgtcgagctgctggaccttgtgtacatttcgctgaggtagactaatgcacaatggcctgctgattttgctcgtcctgcttgcgtgctactctgttctctgctccagtgtctggcactaccctttcgagcaaggtgatggccaggagagctattctccattaataaagcctgctgagcgcccgatgtttgcttgaatttgttgccatgcgtttccagtttttcgcctttccacttggagcaaaatcttgcaaatcatgttcat

SEQ ID NO: 73196 - DNA, 624 bp, Triticum aestivum
  Clone ID: PAT_TA_73196
cggcacgagcaactactgatccactcttctgctggatatcttgatggctgccgacaaatttgaggttgtttcatgcatgaggtactgcagccagttgctcacaaacttgccgatgaccacagaatctgcacttctctacctagatcttccctgctcaatttcaatggcagctgcagttcaaccactgacagatgcagctaaggatttccttgctgtaaaatacaaggatttgactaagttccaagatgaagtgatgaacatccctcttgctggaattgaagccatcttgtcaagtaatgacctccaggtggcatctgaagataccatctacgacttcttgctcagatgggcccgtgcacaatacccgaaatcagaagagagacgtgagatccttagttctcggctgctccctcttgtgcgattcagtcacatgacatgtaggaagctgcggaaggtcctaacatgcacggatatagaccacgagcaagcaaccaagtgtgtcaccgaggctcttctgtacaaagctgatgcaccacaccggcaacgagctcttgcagcggacacagtaacctgtcggaaattcgctgagcgggcttacaagtacagaccactcaaagttgttga

SEQ ID NO: 73197 - DNA, 592 bp, Triticum aestivum
  Clone ID: PAT_TA_73197
tggtaggctagtgttgtcatacgctcacactctcgaccgaatgtgagaggaaaggaacgcccgcagagcccccgcggatccggatgcgacttgtggcaggcaggcaccggagcggagcttctggcggcgctgctccgggctgccgctgatcgcgcgcgggcatcaggcaggctactggaggccggatgaggcgcgggcgccccagttcgtcagaggcagggcgagcaaagaggggcggacgccaaagctgcgagaggcggcacccgactgatgaaacgggcgccgagcgaggcagcggccgcacagagagaaaaaaacgaagccggaagcccggaaccggaagttgcgagctgacactcgtccattggtgttcaaaactgaagatgccaccgtttcgtggttggatttttaccatttttaccacttgtttgctgtcttattttgtagcgcttcatgttgtgatgtgatccccggcccgaaagtacagtagcataacacattgcagagagcacgggagatctctccgctcttcagaacgcgttacgctgattttttgaaaaaaaaaaaaaaaaaaaaaaaaaaaaaaaaaaaa

SEQ ID NO: 73198 - DNA, 532 bp, Triticum aestivum
  Clone ID: PAT_TA_73198
ttatttctgctggcagcacgacggaatcactttcagtaaagcgtgcattttctagcaattctgcgctctgatgtggttgcccttgttatctaggcaatggcctgtgttaccgagcaagattataaaattgcacagaggattgacaaagaaggaaaagcttgtgtcattgttgtgaacaaatgggatactatccctaaccagaaccatgagagtacaacacattatgaacaagatgtaatagaaaagcttcccatacttgattgggcacctattgtctactgttctgcgactaatggcaccagtgtcaaaaagataatttctgctgctgctttggttgagaatgaaaggtctataagactcggcacctccattcttaatcaagttattagagaagctatagcattcaaaccaccaccaagaacaagaggtggcaaaagaggtcgtgtctattatacaacacaggctgccattggtccaccaacattcgttttatttgtaaatgatgcgaagctcttccctgatacataccgcc

SEQ ID NO: 73199 - DNA, 786 bp, Triticum aestivum
  Clone ID: PAT_TA_73199
tcggcacgaggctcttgttgggccagcaggagcgttaccttcccaacattcaaggcagtatgctataaatcttgctgagggtagcagcagcagtggacgtgatagtaatcgtaaatgggaaagtcagggccttgatcttaactcaggccctggaagtatagatttagaaggaaaggatgaacggatgcctttaccagtcagacaaaatttgatcccacccccacatggctttgcagaggatcaaggaagaatttaccaaatgccagttgtaggaacaaagagaaaggagcctgatggcagttgggactcagaaaggtctacatacaagcaattatcatggcaatgagggctctgaaggagatcattttgcaccgactggtctgcgatgagcataggtacctgcatgtagaacttgggcggtgtgttcttcagtcactggactatactcgggattcagccccgtgacgatgatgtgggattgaggaaacgaaaagttgctgtaattgttgtagatttttcttagctgttaggcttttggttctaatttactcaggagggtatggctgcggaggaggaatctttgtgatcctgagctctggggctactgtaattagaccgtccgctctgtttgttggtgataaactgttgagcacatgctgcagctttacataagaatttagatgtgaccttgttccttgttgggaaagcgttacgtcagctgaccatatacacactggtgcaacgaacagctcgagttgctacgccatgtatcttgggttgcagtgc

SEQ ID NO: 73200 - DNA, 559 bp, Triticum aestivum
  Clone ID: PAT_TA_73200
gcacgaggcttggtcttggtcgtcgtcttctctcgcctcagcctttgccgccggcagaggagcggcgcaggcacctgaccggccacagatccaccagccatgggcgacgcgcaggctcctggaggctacttcgtcggccgtccggccaactacgaggacaaacagcgagatgctgctgcggatgcacagaccaaagagagcgctcctgctgccggtagtgagaaccaagcgccggcgcctggtggccacaagaaaactggcttcctcggcaacctgttttcctgcttctccggcggccgagtggagagctagctgaccggcatggccggcagtgcacagcatttactctttcaaagattcgagtaccatttgtaatctgtatggactatggaggttggagggagacgaggcgatctgtacctcaagtgcatcctctgctatccggaaagctgctctgttctcctttcatacgataccacttgttcattatactaccgaatgtaactattcgttccacatatgtttcaaaataatttttttttcgatcagcattaaaaaa

SEQ ID NO: 73201 - DNA, 729 bp, Triticum aestivum
  Clone ID: PAT_TA_73201
tcggcacgagggcagaattagtttgggtagacagttgttttcgttcaattgcacgaatcgcagattgagttaatatcaatcttttgtggtatatataacacaatgatttataaataaagaaaatagatgtttgagagaaaaaaaaagaaaatagatcccagtaagagcatctccaagagtacccaaaacactctcctaatcctttactttttagcaaagattgaaaaaatacatctccaacaactcctaaatccaactcctaatttttggcaattggtaaaaaacatgtccgcgcgcgtaaagttacgcgcaagaagctcacgcgtaggctatcctcctctcgagtcttcttcggcctcgcgcgcatggtcactacaggtacatcggttgacatgcttggatcctgcggcgagccgccggcgatctactctgcctcctcgacatgcgcagccgcaccgttgatctccaacctggccatggcgagtcactcgacctgctgtcgccgctctgcctcagcttcgacgcgacgcgtccacggtggaaggcgcctggagatttgttagcgtcgagccgcacttctacgacggcctccgcgtcactgacgcgctcatcatggaggtcatcaagatggtgctcgccggaaggtcaacaagaacctcgtctcattaacattgcgggaggagctgccatcggcctttgcgtcaagcagacgtgcctcatcgatcctct

SEQ ID NO: 73202 - DNA, 623 bp, Triticum aestivum
  Clone ID: PAT_TA_73202
cggcacgagggccgcacggaataccatcatcaacgaagtgagcggcgtttttaaaccctacggcatcgatgttgacatgaggcacctgagcatgatcgcggacttcatgaccttggatggcggataccggcctatgaacaggatagggatcggccagttcagcacctcgccgtttggcaagatgacgttcgagacagcaaccaagttcattgtggaggcagcaacacatggggaggcagactttctggagtgcccttcagcgagtgtctgccttgggaagcccccgaaggttgggaccgggatctttgggctactgcagaatcttgaattggagcagcccatggaaacctaaatctgcatttggtgcacgtctttccaagctgccttctataggttcacaagttttggtcctattcctatctgcctttgcacggcagtgaaatgtgctttagtttgcttatatggtttggtacgctgctggaaaaactagcagaacatgtcaaataccagttagtgatctagattaatttacagcatgacagctagttgtacacatgctttagaatgctatattgttgagaacgaactggttcgtctttaaaaaaaaaaaaaaaaaaaaaaaa

SEQ ID NO: 73203 - DNA, 741 bp, Triticum aestivum
  Clone ID: PAT_TA_73203
acccgatgtggaatcagctgaccgtgcccgaagcatcgctctattcgtgggatccaaactccacctacatccatgagcctccatactttaaggacatgaccatgtccacctggcccccatggggtgaagaatgcctactgcttactgaactttggggacagcattacgacagaccatatttcaccagcaggtagcattcacaaagacagccctgctgccaagtacttgcttgagcgtggtgtggaccgtaaggacttcaattcatatggtagccgtcgtggtaatgatgaagtaatggcaagaggaacatttgcgaacatcaggattgtgaacaagtttttgaatggagaagttggacccaagaccgttcatgtccctacaggggagaagctctatgtatttgatgctgccttgaaatacaagtctgagggtcatgacactattgttcttgctggtgctgagtatggaagtggcagttctcgtgactgggctgccaagggaccgatgctcctgggtgttaaagctgtgatcgctaagagctttgagcgtatccaccgaagcaacctggtgggtatgggaatcattcctctctgcttcaaggctggtgaggatgccgactcacttggccttactggacatgagcggtacaccatcgacctcccgaccaacgtcagcgagatccgtcctgggcaggacattaccgtcacaaccgacaacgggaaatccttcacttgtactctt

SEQ ID NO: 73204 - DNA, 722 bp, Triticum aestivum
  Clone ID: PAT_TA_73204
cggcacgaggcttcgtcctcgctcacgcccgacttcgaggcgcccaccagcaagatgcgtgccgcgctgcccaaacaggtggccgtccaccagcacgtccgcaactccagccaagcggccgcgcttgtcgccgctgtgctgcaaggggacgccaccctcatcggctccgcaatgtcctccgacggcatcgtggagccaaccagggcgccgctgattcctggcatggctgcggtcaaggccgcggcgttggaagctggggcattgggctgcaccatcagtggagcagggccaactgctgtggctgtcattgacggggaggagaagggcgaggaggttggccggaggatggtggaggcattcgccaatgccggcaatctcaaagcaacagctactgttgctcagctcgatagagttggtgccagggttatctctacctccactttggagtaggaagatctgggaggactgctccggtaggtcaaatttggaatggctcacatggacactagtgggaggagaagaaggggggattggtgtgttttgtaattcctgggctgaccagaacgattgtcagtcagttgggttgtgaattgtgtgatgtagtagcaaactgattcgtgccggcaattgaattgcaataagctagtggttgcagcatcacctggcgaggcgtagctaggagatgcagaaacagcattttgacatgtgtgggtgttgacatg

SEQ ID NO: 73205 - DNA, 685 bp, Triticum aestivum
  Clone ID: PAT_TA_73205
cggcacgaggatgatgccatgccctcaggcgacaatccccagaatggcttcaactttgggaaccagccctctgttccatcaggtggattcaactttggctgaagatgcccatttggaatggcggctgtgccattatgccttggctagtgcttggggctagtcagaggtggggtagtcgcgtcgtccaagtcgtggttgggtcccattggtctggtctcagggagtcggtcaagtcagtcccagtcagcaacagggtcagtcctagggctgcatcaccagtggtgcagcttggtcagtggtcagtcttcaaggtcagcgggttggatcatttgggctctttgctcccaccaccacctaatggtgggaggcatggagtcgcaggtgttgtcgggagtttgggttttgcctcctcctatatagcatgaatggattatattgtttttacctgtttgatgaggtagaaagaaccttgaaagatagggaatgtgtcggtttttgtcaaagcggttcctgtgctgtataacatgttgcaatgagtattggcacaacttataagacataatgtcaaatgggtttttttggagtccccattctggtctctcgagtctaatttcattggtttattattgtgtattaattatacacaggttttgtggttggttggtcatgtcttgtctgttgtagt

SEQ ID NO: 73206 - DNA, 625 bp, Triticum aestivum
  Clone ID: PAT_TA_73206
tttttttttaactaaaaataatatatactttttgcagggaaaaaaacttcttaattcagttggcatatttccaaaaaccaagggatacaatctcctttttttaagcaataagggatacaatctcaatagaaacaaactctcacggtcgtgtagagatacaatttttcaaaatataaccaacctctcacgatcgtgtaaagagataaaatctgtctaaaaatagaacaaaactctcacgatcgaaacaatctctctttccgtcgtgcacatgtcaaataactcagccaacctaaaataccttccctttaaaaagcgtcaattattgattgtcctgtctgacttcagatcaccccgcatatccaacaagtggcactttgacattgtcttcctccagcggcaaccagccctccaatggcccattctcctgttgactcgcctcaactgcaatcggctcagttgagcgatcaaaccacctccagtaagtaccatcttcacagaattatagccttgctcaacagcaggtcgaagttctaacttcgaagaatgttgacgcagtggaggatgacgacgacttgccgagtagcatcgagcgagaatagccacgatgcgtctgcctcgcacttgg

SEQ ID NO: 73207 - DNA, 719 bp, Triticum aestivum
  Clone ID: PAT_TA_73207
attcggcacgagggcacaacatctgcagtttctagagccctctctgccactcgtgatctccaccagccacgatgcctgccctcgccaagcccgcctcccgccccgccaagaccgccgcggcgccgaagccgaagcccgccgccgccaagccgaaggcggccgccgccggtgcctcccacccgccctacttcgagatgatcaaggaggcgatctcggcgctgaaggagaggaccggctccagctcccacgccatcgccaagtacatggaggacaagcacggcgcgtcgctgccggccaacttcaagaagatgctctccatccagctccgcgggttcgccgccaagggcaagctcgtgaaggtcaaggcctcgtacaagctctctgacgccgccaagaaggccgcccccaagccgaaggccaagctcgccgccgccaagaccgctgcgcccaagccgaccaagaaggacgccgccaagcccaagaagactgccgcagcagccaagcccaagaaggccgccgcggggaccaagcgcaaggcgccagagaagaagaaggtcgtggccaagccgaagaagtcccccgctgccaaggccaaggccaagcccaagaccgtcaagtcccccgccgccaagaaggcccggaaggtcgccgcatgagatgggttgcttaggtcgtagtagctctgatcgtcgtgtggtgttggttaggagttgtacaaa

SEQ ID NO: 73208 - DNA, 730 bp, Triticum aestivum
  Clone ID: PAT_TA_73208
ccaaccgctccgcgtcgccgctccgcccgccagccgcgcgccccgccaaggaggtcataccgcagttttattttcaagatggacggccaccgccgtacgaggtgaagaagcaatgcatatcgacagttgatcagctcttcgccggccactcaaatggtcttcgggctccagaatttcggatggttaccagggaactctgcaaactaccgacattctttaccactgttatcttcgataagatagacaaggagagcacgggattcgtgacaagggatgccttcattgatttctgggtgaatagcaatttgatgagtatggatagtgcaacccaagtgttcacaattctgaagcaacagaaccgcaattacctcacaaaggaggattttaaaccgattctgaaagatcttttggacaaccatcctggtctggagttcttaaagagtacacctgaatttcaagaaagatatgctgagactgtcgtatatagaatattctattccttgaatcgaattgggagtggacatctgacactcagggagctgaagcgtggaaatctactcaatgcactcaggcatgctgatgatgaagaggatatcaataaagttttaaggtatttttcatatgagcatttctatgtgatatattgcaagttctgggagctggacacagaccacgacttctttattgacaaagaaaatcttattaagtatggaaatcatgcactgacata

SEQ ID NO: 73209 - DNA, 406 bp, Triticum aestivum
  Clone ID: PAT_TA_73209
gaaccaggggacgccgctcaagcccaacgtgcccgtcgacgtgtacgtgttcgcgctcttcaacgaggacatgaagccaggacccgcgtcggagaggaactacgggctgttctaccccaacggctcgccggtgtacgcgctcaactccgccggctccggcggcggttcgagtcccggcgggtcgctcaacccgtactacacgtccatgttctcctcctcgtccagatcggcggtgagcgcaacctttttgacagagagagtgatactattactgctgctgcaagcgattgtaatactgcgacaatcatattcattgtactgttagtcagtgataccttgtaatcttgtatacggaaatatgcaatttcaattcaaccatagggtaggcctagattcggcaatttgg

SEQ ID NO: 73210 - DNA, 400 bp, Triticum aestivum
  Clone ID: PAT_TA_73210
agagagattgatcttatgtgacactgttatttaattttgttggttatcatgagaatgattgcctgggactaaccgaacacctcttttactgcatcctttatgccttcatctctattttgtgcagactcaagtctggtgtttgtgacattggccctccctttctttaactgtgttctgcaatttccccactttggacttccatctggtgcatcttatctgttgtggatcaaaaccaagaaagtatgttgctctgtgttcctgccaaaagaaaatctgtctgaacaaacttgtttggctgaacgattgttgcctcctgattatgccagcctatgtgcccgtctcggtgatgcaatgcaagcttctttgtactttgggatggaaaaaaaaaaaaaaaaaaaaa

SEQ ID NO: 73211 - DNA, 680 bp, Triticum aestivum
  Clone ID: PAT_TA_73211
cggcacgagcacgctggagacgtgaaggggaggatcccctaactcccctgccaaccgtcacggcatgcgacctcctctcccttcgagcttgccggcccctcgtctcctacagccgtgcagtccggcgaccacagccgtgcagtccgcgcccgtggccgtgcagctcggacaagtgcgcaaacgcattgaagttccttgctcatgtgcgtgctgctcgatgaacacaactgcactgcagctcctggatggtggactgcggaaggtgcggggctcctccgacgtgcttcggtggccaagtccttccctctgtgttgctcgttgcctgattcccgacaccggcggggccaaaagaggaggagagggcggcaacctacctctacgtctatgccttagctcacgggtgtgcctcaagtttactgtaagctgttaatttctacgtgtgtgaccatctctccacatagcttcgtggagaatcaatggcgttatgcgcatgcagtaggatttttttaactcttgtttcttgaaatataagtaggctacttcaattttgctggatatagtcaccctgttggattcaatgaacccccacgttggagtagtttgctagcagtaaagttaaactgaggagtggaagcctagactttggaaagatcttctttggataggaccagttcccctgt

SEQ ID NO: 73212 - DNA, 417 bp, Triticum aestivum
  Clone ID: PAT_TA_73212
cggcacgagggtggtccccatcttcacggggagtgcggagcctgcgcgtactgcgagtcggacaagaccaacctgtgcgggacttaccgcgtcaacccattcaagagcaccatgtcctccgatggcggcacgaggttctccgtggtggaccgcaactctgggctgcggcagccggtgtaccacttcctcaacacctccaccttcgccgagtacaccgtgcttgacgcggcctgcgccgtcaagatcaaccccaaggccccgctccacaagatgtgcctcctcagctgcggcatctccacaggtacacgcgtatcggtgtatataccgccgttggttatcaaaattgaaggccttgtttacatacgcccaaaaacctaaaattttataagattttccgtcaaaaaaaaaaaaaaaaaa

SEQ ID NO: 73213 - DNA, 475 bp, Triticum aestivum
  Clone ID: PAT_TA_73213
ggtgggcgccgtcggctgacgacgccgcgttcatgtcgacgtcgtcgtcgatctcctcgtccgtagcgtcgacgcgcggcacggacaggtcgtcgtggggtgccggcagaagccggacggagagggccgcggtgaaggcgtcgttggtcgtgcaagagacggcggcgaagggtgcagtggagtcccctgtgtccgtgcaggacaggtggttcagcgagaggagctccccttcctccaacagcttgctgggcaataattgttccctgcactgaactgaaacatccgactgctcatcttctatgctccaagtttaagctagctagcttaggggcctctttggcttggggtgactaaactttagtcacttttagtccataaaatgtcaaaaggatgactaaaaggtaactaaactttagttcaggaaccaaacagggtatacatttaagaacgaaaaaaaaaaaaaaaaaaaaaaaaa

SEQ ID NO: 73214 - DNA, 552 bp, Triticum aestivum
  Clone ID: PAT_TA_73214
ccagttattatcaggttcatccctttgccatgtaatactgtggcgacattgtctgttatgtataattgtgcacacaggtttctgttggaacaatcactgaaaacgatgatagactttgtctcacatgtgtcgctcactgatgagaactagactgaagtgaattgtgctagagaaggagtggccgggaaagtacaccagtgatgccctacaaggcgagcagaagaaagctaaagagatgctccgtgtaatccctaagaagcagaaagggagcaaaagaacaggtccgcttcaagggtaaaatcctctgggtttttttttcgaaaaggaggttatcccctggcctctgcatcagaatgatgcatgcgcccatcttattaataagctgataaaatcatctgtaatccctaattgtgcttttgtgaaaatatgtggatcagtttgatgctggacacgattaatttactattgttggtacatgtagaagtaattctggattagccacattgtggtttcctactaggaactgaaattatgcccagttcattggcatgg

SEQ ID NO: 73215 - DNA, 707 bp, Triticum aestivum
  Clone ID: PAT_TA_73215
tcggcacgagggctaattactgagtttctacgaggaggcgatcttcatcaatatctgaaggaaaaaggtgcactcaacccacttactgctgttagttttgcgctggatattgcaagaggaatggcatatcttcacaatgagcctaatgttgtgattcaccgagatttaaaaccaagaaatattcttctagtgaattctgctgccaaccacttgaaggttggagatttcggccttagcaagatcatcagagcgcagcatgcgaatgatgtatacaagatgactggagagacaggaagctatcggtacatggcccctgaagtttttaagcaccggaaatatgacaagaaagttgatatcttctcttttgccatgattctatatgagatgatggaaggtgatccacccttctccagctacgaaccttatgaggctgctaagtacgtggcagatgggcatcgccccattttccgtaaaagtcataccaatgagttgaaggatttggttgagctatgttggtctggggatatcagtctgagaccatctttcttggagatcctcaagaggcttgagaagcttaaggagcattattcgcatgagaaccactggcatttgttccagtagcagtgcttatatataattatatattctttactacaactggtgtcttgaatggggttttctcgggagatctgacatcgatgaatgta

SEQ ID NO: 73216 - DNA, 774 bp, Triticum aestivum
  Clone ID: PAT_TA_73216
tcggcacgaggaagcatattcacattactcatgatatgttcataattttttaggaccctgcggaagctgacaaattaatgaaaatccagagggacttggatgaaacaaaaattatacttcataaaactattgagagtgtccttgccagaggagagagattggatagcttggttgagaaaagctctgatctaagtgctgcttcacaggtaatcctatctttacttcgccggataaattattttcttttagctgttaaagcgtaaaatgtgttaaagccctatttgctgctaattttcaccgtcataaacgaagtactgatcaacttcaggtactcttactaattcacaaaaaaaaaagatactcctgtacatagtggttcttcaggtgtacatactcttttagatgtatattactgacttctccaggtagtaatcatgatctatgggagttttagaagaaaattatcgacatgccatcttttatgtcagtctcagtattcagtagtactccctccgtccaagtttgatgaatttataaggcacaaaaaggttttcagaattgataagtgtgtaatgctcagcagctgtacccaggtgctagttttactcgggtcatcaatgaggcactattctcccaggcatctagcgtcctattgcatgcatacattaggagttaaaatcctatgtcttacacttggggagtagtccaatcccatgcgtgaaacaaacatttatgcttgtgtgagttaacgttaacgatgagaattttccttct

SEQ ID NO: 73217 - DNA, 564 bp, Triticum aestivum
  Clone ID: PAT_TA_73217
tcggcacgagggaaatgagctaccagaaagtccctcccgaggaaccctaccctcctccagggtatcctcggccaccaccaccagatgtgtaccctcctcccccttggggccatggacatccaccacctccgccaccgccgcaggggccttattaccccccacctcagcaccctccaccggggtaccagggctacttcaacgacccgccgccgcatggagagtatcagcagcagcaccaccacaaccatggaaaccagggtagctctagctcttctgggttcctcaaaggatgtttggccgctctctgctgctgctgcgtgctggaggaatgctgcggctgcttctgagatgctagatatccgctaattgggtcctacgctattgttgctagcgtttggagcatccgagtattaagatatagtaactgtgcttgtaaagaatctggagcagcagtgtgttcttgagcttccagtccagcattctattttcagacagatcacatataacttgtagtatgtgttatgccttattatccgaaaataaaggatgctattcatgggattg

SEQ ID NO: 73218 - DNA, 735 bp, Triticum aestivum
  unsure (1)..(735): unsure at all n locations
  Clone ID: PAT_TA_73218
cggcacgaggaaaagaatggttaaacacgtttctttcatcgttggatgtatcatcctatctcttagtgcaactttgatcgtcccaacgaacagcttgccaatcgaggagagtggacaaaaagaaactaatttttcgggatctcgctctaaacgtcaagtagctcaagcttcaagttctgcaaatagtgctgctaaagccacagcttctacgcaaacggtttcgaatccactattactttcagctttacttccattgcttactaaaggaagtcaaattcctcctccaatggccactggtggttctgctggtcctcccggtctcgccggtcttgccggtcttcccggccttcttttggggcttaacccagtgcttggaggtcttagtggtgttctcggaaatcttggtggcacagtgaataatctagttgacaaagtcgaaactgccgcaccagttgttagccctattactgaccttcttcaacaaattattgctgctctgttgggtggtggntggaggaatgggcatgccacccatgcctgctatgactaaaccaccgctgaatccacttgctttatttgcgctattatcgcagccacagcagataaaacaaacagtatcatcaacatcatcatcatcatcatcatcacaagcatcagcatcaacagcacctaaaggctaaactattttagtttatttacccaatcaggttgcctctgatgtattggaacaatgtc

SEQ ID NO: 73219 - DNA, 575 bp, Triticum aestivum
  Clone ID: PAT_TA_73219
tatggagctcagtgctcgcagttcgtgaaacgaagattgtgtgaaaacttgctccgggatagccggtttcgtactgatgctgttcaggctcttcattctgctttcttggcaacaaattctcagctccatgcggacagcttggatgattccatgagtggtactaccgcgatcactatactggtgaggggcaaaacattgtacattgcaaatacaggcgattcacgtgctcttattgctgagaaaagaggagagtatattattgctgttgacctgtccatagatcaaactccttaccggaccgatgaggtcgaaagggtcaaggagtgtggtgccagggttctgacattggatcaaatagaaggactaaagaatccagatgttcagtgttggggcaacgaggaaagtgacgatggcgatcctccaaggttgtgggtggaaaatggcatgtatccgggaactgcttttactcgtagtattggagattctgttgctgaatcaattggcgtcgttgcaaatcctgaaatttttatcctggagctcagtgccagccatccattcttcgttattgctagtga

SEQ ID NO: 73220 - DNA, 645 bp, Triticum aestivum
  Clone ID: PAT_TA_73220
tcggcacgaggatgaactgaggcagcagcagaggacggagccggcaagccatggctccctccgccgccgccgccgccgccgccaccgcctcgccgctgtcccgtctcctgctcagcctcccaaaccccagcgtgaaacctcccgtgtcttctccgagccggaacgccggcgccgccgtggccgccaagaacagcacccccgtcgtcgccctccgccggcgcgaggccgtggccgccgtgctgtccgcagccatcctctcccgcgtgctccccgcggcggcggaagcgtccggcggcgagtgcccgctcgaggtggcgcccaacggtctcgccttctgcgaccgcgtcgtcggcaccggcgccgccgccgagcaagggcagctcatcaaggcgcattacaccgggaggctggaggacggcacggtgttcgacagcagctacaagcgcgggaagccgctcaccttccgcgtcggcgtcggcgaggtgatcaaaggatgggaccagggcatagtgggcggcgaagggatcccgccgatgctcgccggtggaaagaggtcgctgaggctgccgccggagctggcctacggcgcgagaggagccgggtgcagaggctgggagcccacctcctgcgtcatcccgcccaact

SEQ ID NO: 73221 - DNA, 785 bp, Triticum aestivum
  Clone ID: PAT_TA_73221
gtcggcatcggcgacccctgccgaaaactccggcgtggccaaactggacttggaccgcgccggcacgggagactgcacggtggcgcggcgcgacttcgggcccagctgctttgcgggggagccgttcttcgtccccgacgacgtggaggggaacggcaacgaggacgacggctacttggtgtgctacgtccacaacgagcgcactggcgagaacctgttcgtggtgatggacgcgaggtcaccacagctggacatcgtcgctgaggtggagctgcccacccgtgtcccctacggcttccacggcatctttgtcacgaaggccgagctccaggcgcagcaacaatgatcaaagcaccaggcgttcgtcttgtgtttacctgctgtagtgctgaggatctgtagcacaggattccaagagaaacacacacaccgctggatactgaatagattgtagtaagaacaactctaggccacatagcattcactaatacgaattatgttgtatagcattcactaatacgaattatattgtattgcaaatgtagcagaacccataaaaagggttcatgagtagaattgatatgaaatttcaagattttactggaatagtacaatgttcatatcgatgggtccaccaccgactttgtggactgtgcacggtgcacggaaacagggcaaggggttgggacaagggcaactcaaccgacgaggccccgacaagccgacacacaaggcgtcagccaagagcagcacaatgacaattgctggaacgaagcgggagcaca

SEQ ID NO: 73222 - DNA, 649 bp, Triticum aestivum
  Clone ID: PAT_TA_73222
ctcgacctcctatttccttcccaatgccgggcactgcccgctctcctctctgatttccggcatggaaaaccctcttctccgactttcggcctctccccaacctctggccggtgctgcgggacatatacaacatctgccctccatgccattgcaacttccagcctcgacgtccatcgccttctctagatccagcggccatctgcacggctgcacgccaactgttcggtcaattgacccaacagacacgaggtatttttcttttttttgttcctttggtgttccatccagcactaatgtgaaggtcttggttcagatgctactcatgttctgtacattctaattgattatattagcctagagaatggagagaaagaggagaagttgtcttcagcaccatactgaactattgaagcaacaggaagatgagtgtatcatgcaagaggagatcctggccgccgtcctgtgcctcggcgaccagtatgaccatgtcctcgcgtgcctcctgctggttgatccggtgccagcaactgtcatcttcccaaaatttaactggacatttgaatgttcttaattttttttcttctgaaatgaacatagctgtgagttttttttatggtgaaatcaagttctgacggaatttacaatatac

SEQ ID NO: 73223 - DNA, 741 bp, Triticum aestivum
  unsure (1)..(741): unsure at all n locations
  Clone ID: PAT_TA_73223
cggcacgaggtctcactgaggcataaagtgagagaccgtgattggatcgatcaccggagcgacgatcaatggcgacgctcaccgtgcccgccgccgtgccgcccgtcgccgaggactgcgagcagctgcgcaaggcgttcaaagggtggggcacgaacgagaagctcatcatctccatcctcgcccaccgcgacgcggcgcagcgccgggcgatccgccgcgcctacgccgaggcgtacggcgaggagctgctccgcgccctcaacgacgagatccacggcaaattcgagagggcggtgatccagtggacgctggacccggcggagcgggacgcggtgctggcgaacgaggaggcgaggaagtggcacccggggggccgcgcgctcgtcgagatcgcgtgcacgcgcacgccatcgcagctcttcgctgcgaagcaggcgtaccacgagcgcttcaagaggtcgctcgnaggaggacgtcgcggcgcacatcaccggcgactaccgtaagcttttggtgccacttgtgactgtatatcgctatgatgggccagaggtgaacacatcgttggcacattctgaagccaaaatactccatgggaagatccacgacaaggcttacagtgacgatgaaatcatcaggattctcaccacaaggagcaaagcacagttactagcaacattcaatagttacaatgatcagttcggccatccaatcactaaggatcttaaagctgatcct

SEQ ID NO: 73224 - DNA, 746 bp, Triticum aestivum
  Clone ID: PAT_TA_73224
ttcggcacgagggtagcaagtcctagactccgtagcattgaggacttgaggtttaaattgccaactaaaatttaagtttaacccaatatatgctagaatccaaagttccgctgaaatatccaaatagaggaaaaccgcaacaatggcaacaacaaagcttttggtcctcagcaacttggggtaagctagagctgaaacccacaatatgaagcaccaagaaaaagaaagtgaaattgaaaaaaaaataatgcatctttgtttcaaaaaaaaaacacaatagaaacagaaagggaattaaccaaaaagaagagaactccaaaacatatttgcttccacttttgattctgcttgagatgttcatagacctctcagaccactgtgttttttcgtataaaatcaggctagtgtaggcttgaacattttgtttgcttaatgctttcaaatcctgatgatgctaaatgacttggcaggtctgcaatcttgcgtggtcaaagaatgtaaatgagcttgttagcacccatgggtactctcagaaccaaataattgtttggagatatccaacaatgtcgaagcttgccactttgacagggcatacatacagagtattatatttagctatttcccctgatggccagaccatagttactggtgctggtgatgaaacactccgtttttggaacgtgttcccttcaccaaagtcccagagttctgatagtttaagttgcatcgggggaacatcatttgtt

SEQ ID NO: 73225 - DNA, 737 bp, Triticum aestivum
  unsure (1)..(737): unsure at all n locations
  Clone ID: PAT_TA_73225
ttcggcacgagggtcgccacctgaagcttcctttaacacaaatatttatntctgctcaagataatggtcctgtcaggggtaaggatttgcttcaagatcccgaggacttggggctatttgcttcattgattggtgaacgtgaaaaacacaaagaatctgttgagtacaagcgggcagcagaggaggagtgggcatcgagacagcggcaattacaaatacaggctgaggaagcaaagaaattgcgaaagagaaagaaagctgaagctcaacgattgcttgacatggagaagagacaaaagcaaagactgcaagaagtccgtgaatcacagagaaagaatgaagaagctatacagcttaaggagcagtatcggggtgtagtcagaaaggaactggaagatttggaaaggagacattgggatatgacttcaatattgcatgcgctaggcatctctgttgaaggtggtgaggttaaagccttcaagcaagctcttctgaaattccatcccgacagggtatcaagaaatgatatttatcaacaagtaaaagcagaggagacatttaagttcatttcgcggctgaaggagaagctacctcggctatcctaatagccatccccaactcagtctctgtttttacacatgccttagtcgcatcctccttttaacctgtagggtcaaggtacagagttgagaggatgtttattggcgttcttagaagtaactagggcttagctcttt

SEQ ID NO: 73226 - DNA, 689 bp, Triticum aestivum
  Clone ID: PAT_TA_73226
cggcacgagggacgtgtggcagcttcaacaaagtgtggcccccagaacagctgatccccaaggtctttggtcaaagtgtaggacgaaccacgctttctgtaatagcaaccagcttcagtttttgcaagggtttaggaaccaaatgcttgatgccgtgaagggtttttctgcgtcaaggcgaaatggtttgttcatcaactcatgttttgctcattgccagagcgagagacaggatacttggtatgcgaacaactcgccacgtcttggtaacaagaaaatcgctgacgctgtcggtgattggttctttgagaggggagacgccaagtacacagactgcccatacccttgcgatggcacttgccatcatcttgtgttcaggggagaccattaagactattcttcaacacgaacaattcagaaatttcagatggtaaaaggaacaaaccccaatgggtacagaaacaaggtatagatacagagaaggtgcaagtggttggcttgcccatgtatgttcatcagtcgatcatatgattgataggacagggacctcgcctgcgaatgcgcggaggtctctgcattagcttcacatatcatcatgatatcgatttttttcattgggaaaatgtatgattacctaccagaacatttggaccctattgcctatctgtataacattataacgtacatta

SEQ ID NO: 73227 - DNA, 749 bp, Triticum aestivum
  Clone ID: PAT_TA_73227
cggcacgaggcgcaccccccgggggccgaacctccttgccgtgtgctgccatatcctcgctgcgagccctgtctcgcagagaaacctggacgccatacctcctagccgtcgccacgaacagctccatcggaaactccgcacccgccatatatgccttcgtcgctttgcctgcagggctccggtgcggagcgtagatcccaggggccaaagctgctgcgtgaggatagaggcagcctgcgatctaagtcactggtggaaaaggggagcaaaaggccgaatgttttctgctgttgttgctcctttcttgtttgcatctgattagatccatgagtaatacgctccttcgtatgcaccctcccctagcttaaaatacttcatgtaccttgccaataacaagactttgattttggttgcgttttattcaagcttctctggcctgatcttcctttttttttcatttcttgatgtcctggctgatgagacgataccaagagaaccatctgttgcttcatgcaactgatgaacatgacccaactgattttcctttttcatttttctcgctctaaggttgctgcagctatcctttttcatttttctcgctctaaggttgctgtagcaatgatgcatttggaggcagggtgactaatttcattttgcaaaactttcaatccataggtgaaactgacagacccaaggaagtactttgtgcagcacgctgcacgcctgccgtatactgctgcatggagctc

SEQ ID NO: 73228 - DNA, 332 bp, Triticum aestivum
  Clone ID: PAT_TA_73228
cggcacgaggcttcttcggctgcatctccggcgtgctctgggcttacttcctcctctacgtgctcgacctcccctactacttcaagtagaagttgattaataaagatccatatatatatatatatagctccgatgctgcgatgcatgcgatcctcctctctgcgtcggcggcatgcgtggttatgtaggtgatggggtccttgtttcacttcagcagtgatgagcaccgtgtataaatgtaattcctctgcacatggatggattgggatgtaacttgaaactgttaattttttttttacttggatgcaaaaaaaaaaaaaaaaaaaaaaaaa

SEQ ID NO: 73229 - DNA, 603 bp, Triticum aestivum
  Clone ID: PAT_TA_73229
gcacgagattccctgatcttatggcaggaaatcctcgagaagcgacgacgccgacccgatcctcccgagcttctgcctccggcgaccgcccgcgcctccggccaagagcttctccctccaccggcgatgtcatccctcccctcctgccaagatcctctgcccggtgatggcgacggcccagaggtcggtttctacttccggcaagatcgactacccctcgtggctcccatctcctcatacgaacaacaacgagctagcggtcaccttcctcgtccttcgagccagattagccctctcctcttccttgtccaccactaacatctcgttctctcctctatttgatgcctcggttagcactgatgaggttgctccagatccacggacgtgagcgtctgttcctccttttccagctaatcggaatcttggaactctcccagcattgtcaaattaactgtaaggatggggtccaatggtcgtacgttttgaaggtgcatgtggagtgagcaatgcagtagaagcacctgagtgtggctctttttagctacagtgatttcaactgtctttgcagtaaatgtgctaccttactgtggttgcatgggtggt

SEQ ID NO: 73230 - DNA, 736 bp, Triticum aestivum
  Clone ID: PAT_TA_73230
ttttttcttttttttttttttagatatgacaaagacatgagaaatggttgacctggcaatgttgttcagtgttcaaacaatcccaaaaatgatattgagaaatctatcctggcctagagacaggagcatagactaactttacagaattctaattcatgcactaaacttctccaagaaataatcatgtattgcaaattgagtaattagcggtgctgcgtcaagaactatagagagttcatgtttgcattagcacaaataataaaatcaaaaggcaggcacgactgtgttcacaagagagaaatgccaacttgttcttattcactaaattcttctgctggattattcctcttctttctcagatctgcacacatctcttcatgccacgccataagatgattactttcagccagattgatcccctgtttctatgaataaaacatattgcatgtgactggatcttattgttatagattagcaagcatctttagattctatcatcatatatatcttactcctaaagttacagggtaaccataatcatctacttgcaatttccaagacattctttataaatgttatactacatggcacatgtctatgtccaaaagggcaataatatgcaattcgacgatcatattcatatggtaccataactgcatcccacaaaaagaaacctataggcctaagaaacagagtaaatatcggtaatacatcattaccatgaaagaatttctct

SEQ ID NO: 73231 - DNA, 463 bp, Triticum aestivum
  Clone ID: PAT_TA_73231
cggcacgaggctgtagcaagcaaccttgttcctggtctcatgcgtaatctcatgtatgaaggggagaatgcattgctaaatgagaagctgttgcctctgatgaaatggttattctgccagccgaatcccatcgcactcaacactgctctggctcagcttggggtggcaaggcctgttttcagattgccgtatgttcctcttcttcttgagaagcggattgagtttgtccggattgttgaagctattggacggggaaactttgtgggacagaaagaagcacgtgttctcaacgatgatgattttgttttgatcagtaggtattagtaagcgagcttgttagtcctacgtattttgatgaataaaactaggagcatgttatgaggactttttcagacttttgtaaagaaataaaactactgtcatgttatgaaaaaaaaaaaaaaaaaaaaaaaaaaaaaaaaaa

SEQ ID NO: 73232 - DNA, 438 bp, Triticum aestivum
  Clone ID: PAT_TA_73232
atacacagttgaggaccttgagatatccgtgacggatttcttcgaggggtctccacctccaccgcataataggaggagatcccatggatgagagattgcttgaagcttgcagtagctgtatcacttggttgtgtgttgttgccgagcattctttaattcttcggtgaagccagtgcaggcagtcgggtatgtattttgtttcactctcctgagacttaagggtgtagttggtgatgatttcttctactagaggtaatctgaaacagaatcaggatcatattgacgctgtcaaaagtcttgggtgtttcttcctcagttggcgatcttgttcatttgtttaagtgttgttgtaattttgtgtagcagcatgttcatataggaatgttcttttagtaatgtcgcatagttgtaagttgtaaaaaaaaaaaaaaaaaaaaa

SEQ ID NO: 73233 - DNA, 311 bp, Triticum aestivum
  Clone ID: PAT_TA_73233
attcggcacgaggcttcaccgaagggtttggtcttactatttggcagccttcttcaccgaagggtttgggcgaagaagatatattccttgcagagcctaccgtatttgtctgacttgatctctttgtatctgacagtccgtacttggcgttttaactgcccagtggggtatatgtaggcggtagatagaccaatctgtatgtaaagctgtaatgaagttgtttcaatcttatttgaaacatcgtgtaactaaagttgtgtataataaagggaagccaaatgatttgactctataaaaaaaaaaaaaaaaaa

SEQ ID NO: 73234 - DNA, 617 bp, Triticum aestivum
  Clone ID: PAT_TA_73234
ttcggcacgaggcacacacaatcccctcttcttcttcttccacaaacactccacgccagccagaaatcccccaatccacacacgcaccgtcgtctccgtgaggtctgagcgaggtaggacgaatagctctgagcgagttcttccgtcttccaggtagaatcatccttgcagctctcactctcctcttcccgtcgctcgtctcttgttcatagttgttggattcctctttcttcttccttggatcctactagctattacaacagagctccagagccttttagtttctggtctctgattttctccttcttttttttttcttcttttttggtgggatagcgaagagaggttctttttccacatctctctgttcgttcagtgatcatcagtcgtagatctgtcctagcctgttctttgattttagctaagaactaggcgatttattctttcttttattggaaaaaaaatccccagaaaaaaaagttgttggtagtagtatattttcttgtacgatttgatggcggctgctataaatctcccggggcccagcgaagatctgatgcgagcgatggagtccttcatgcaagaagacgccgccccatcccctctgcccatgccgc

SEQ ID NO: 73235 - DNA, 717 bp, Triticum aestivum
  Clone ID: PAT_TA_73235
cgctctgctcgcattagcgagaaagttaaggctttcgatagcccagaaggggagaagatcccgaaacgttctaggaactcatctggcagaaagggcaagcaggagaaaaaggaggccaccgaaaatgaagaagcgaaagacgctgaagctgacaaggaggcccctagcgaagatgctccaaaggagactgatgtagagacaaagcctgctgaagaggcgaaggaggcccctagcgaagatgctccaaaagacaccgatgtggagatgaaaactgctgaagatgccagcaagaccgcagacgccgacactcctgctccagcaccagccggaaccgagaaggaagatgcaaaaccggctgaatctgaggctgctcctccagcaccatcggaaggaggagagaagaaagaggatgcaaagccagctgaacctgaagcagcagctgctccaccaagcaacccaactgagccttccgcacccaaagctgctgctgctgctccagtagagaactccgcggacaaaggccctcaccaggacagccagccgccttccgccgccgcccccgccaaggagtcatcccctgtcaacaacgggcagctgccggctggtgcctctgccgtgaagtgcacctgaagatgaagatgaaaccccccaacgaatcatcatcctcctccccttgtccgtgatgtacgccttttaggaatcattcgcatttgcatt

SEQ ID NO: 73236 - DNA, 744 bp, Triticum aestivum
  Clone ID: PAT_TA_73236
cggcacgaggcttaggtggatgaatgagttctcgcaataccacaacaaacttcttgtagatgaattggaaaacttgcgcaagcttcatcttgatgtgaccatcatctatgccgattactatggagctgccatggaagttttcctttcccctgaacgatttggtcagtgaagctatttcattactgtttgtaagctttatactattaattatagtttgtaggtaactacaagaaaaaaaaaactttctgttggcctcttaaatttgacttctatggcaatctcgaacaaatgaaatctttttgtaaatatgcttgtaccacaatcacaacatctaaattgggtttctctcactccatatatttaccaggttggctattttattttcatcatgttatggaatgcactcctgcactactttctatattgataaagaacaacttttcttgtcggtagcttgtttaacactacctaataaactgcggttcaggaattgaggatcctttggtcgcttgctgtggtggaagaggaccttatggtgtatctgcatctgtacgctgtggatatggcgaatacaaagtgtgtgatgacccagcaaaatatgcatcgtgggatggcttccatccatcagaagctgcatacaagggcattgcaattggcctgctacagggttcatacactcaacctccaattgttagcatcactaattcttgtccgcagataattggccttggttcctctgttgaa

SEQ ID NO: 73237 - DNA, 784 bp, Triticum aestivum
  Clone ID: PAT_TA_73237
cggcacgaggaggaagtggagactttacatccaaacatgaaattgcaaccgaaggtgaagaaagctaaggctgcatctgcatctaaagctgtgaagggtccgtgtattgatcagaatgcattacatttgatgaggggcatgacatccacacgaagaaaagatctaatggagtgcataaaacagcaaaatgcaaagcacgagtctcgcagatgccctgcaagtgaccctctggacaaaaagaaaagaaaggtggttcttcagtactagccagagttgacaatggcatagcagaaccgcgtcatggcgtttggacagaacagaaacctctgccgagaaaaagacgaagagggatccatcatttggctcctgaagaagagcttcagccaatcagcctctaccaagatcacttcctggtggcatttgccacgacgagggtcctggtgaggttgacgctctacggcaagtccatggtgctgctcagccgcgtggcgtgccgtgggctttagccagtgagccagaacacggcgaagcagggagttttaggtaggagtgccggagacaggaggatgcaacgcgtgctcactgctcagtcccctgacaacaagcgccaccacggggcgaggcgaagacctgaagagcaacacaggtgattaatggaaatcttaacaaagaagaccaagcggtgctgatatgctcggtgacatgaatagatgaaagcatagatatgtttcttttttatttgccagtcctgaggtattggacatctcctgcagtcctgttttgt

SEQ ID NO: 73238 - DNA, 480 bp, Triticum aestivum
  Clone ID: PAT_TA_73238
cacgagggtcatagaagatctgctccaggaggagatatacgatgagacagacgtacattgttgaagaacaatgacacatgccgcagtcacttcccattttgaaccagaaaatcggtgccatacctttcttttggctgaggggaagtgccgggtgcaaatatgtgtttatattagtacgtaatactgtacttcagcgtagatagaaacgggggttgaattggttcatttgaacagctggtacgaatgtctagtagtgcagtagtagagagggacgacgggttgtgtgattttgcttggtcctgggacagtaggattgcgtagttatgaaactgtactggttatcccgggattttgacgcggtaatagtgccgctctgagtcaatggtgctccttcggaaggcttcgctttcttgtgatgttggcctcactcgaagcgtctgcacagtaacaataaaaagcatgacagccttatatatttct

SEQ ID NO: 73239 - DNA, 728 bp, Triticum aestivum
  Clone ID: PAT_TA_73239
tcatctctcgtgtgacttcttataaatggaatctctggatggtcttgagatggaaaaagtctatttctgtcttcttttatcactgtgtttctgctttgaatttactgcaatattaaattagcaaaattcatttcccccctgttggactttctgttgaagtgttgctcactgtatattacattctgtttttctaaattcattttccacacacgtaactattaagaacaccaaaagcgggactaagtcagtgtaaaacctcctcttttggtctgtttattgtgctaagtcagtgttaattggtctgttcattttccacacatgtaactattaagaacaccaaaagcgggactaagtcagtgtaaaacctcccaaaaaacaggtatatggtctgtttggttctcttctcagtgttcctgcactgcacctggctcccgctgaccaggctacgggtgtgcaaccattgtttgtttggttcgcatgactacgccatcgccgcccgcgagccaggccatgagaaaacggattccaaatccgttttttgggagccaggctccagtgcctcggttgcatgcccagggccaggcccagcaatgagtgcagggaaccaaacactgtgaaactgcatcccaggagccaagcacgagtatatcagggcaaccaaacaggaaaaagacattatcccatggcggtagttgtatatgtgcaacaagcatgaagtattgtgtgac

SEQ ID NO: 73240 - DNA, 779 bp, Triticum aestivum
  Clone ID: PAT_TA_73240
gaggggcccgtactgcccctgcaagcgtggccagcgcgccaccgccatctccgctccgtccgctgcgcgttgtccccgccgccgccgtcgctcgacctcccgctcctcccgttccagcccgcggaggtgctgataccatctgaatccaagactctacacttgtatgaagcaagatatatagcattgctagaggaggccttgtacaagaggaaaaatacttttgttcactttgtgcttgatccagttgtagatagcactactaaagcttcatttgctgtaagatatggttgcttggtccacatagaaagtattcaaaagctggagattggagcactaatatcaattagaggagtgtgccgtgtaaacatttcaaatcttttggatatggagccctatttccgtggtacagtttctccaatgatggatgagccttatgaagctattgaattagggacaagaatttccaagctaaaagaatccatgtgcaatttacacagtctacaaatgaagttgaaggtacctgaggatgaaccactgcaaactaacatcagggcatcactattgtggtctgaaaaagaaatttttgaagagtataatgaatcttttatccctggacacccagaacgcctctcatttgctgcgtaccaaacagtttcaggcatgtcagatgaagaacttctcaccctgcaaaactacaagatacaagcgatggattcgatagacacccttgaaaggctaaacaatggtatcaagtttgtagaacataatattggaatgat

SEQ ID NO: 73241 - DNA, 618 bp, Triticum aestivum
  Clone ID: PAT_TA_73241
cggcacgagggaagcaagatagcaataagcaccgtatcagttgcactttcaattcgcgaccgacaaccgacgacgatgagctccacggcgacggcggcggattgcggcggcgccaagacgtcgtggccggaggtggtcgggaagagcgtggaggaagcaaagaaggtgatcctcaaggacaagcctgacgccgacatcgtcgtgctgcccgtcggcacgatcgtgaccgcagattttgtgcccaaccgcgtccggatcttcgtcgacaccgtcgcccagacaccccacatcggctgattaattaagaggctggctgatgcctagctagctttgattccttccttgctccagaactgaatattctattctgtaaaatgaataagtcggacatgttatatatgtattcatgtccgtacgtgtatctgacgaataatggatgtgtacctactataaacttatgcactaaataatggcatcgctgttgcataaataaatatgtatcaaagtgtgttgtccatcctagcacgaatgaatatgtgaaaggggatcagttgtttgttttcactttctatcattaaaaaaatagttgtccaacacaaaaaaaaaaaaaaaaaaaaa

SEQ ID NO: 73242 - DNA, 563 bp, Triticum aestivum
  Clone ID: PAT_TA_73242
cggcacgagcccagcccggcattctcgacgtgtatccttccgcaaaatggtggcttgacgccgccgacctactgcgcagctcccatctcgacttcacacgcgtattcttgggctggtactccgactactttgccatgccgcatgtcaagtccaacatgaaacctttcaactacgctttggacttcaagaataagaaggcggtgctgccaggtgatggcaattcggcggtctcgttcatccactcgacggatttggcgaagtatattgttgcgacgttggatgatgagaagaaatggccggagcttagtccttttgcttctgatgcgatgacgtggaagaaggctgttgagttggcggagaaggttacgggcacgaaatgggacatcacctacgataccatcgaaaagttggagaagggtcaagctacggtgctccagcagccagaaggctcatacgagtttcctccggaattcattcaaccattggtcgtcgagttcagcatgttggctgtacgtgtgaacatggatgtctcgaaggatggactgagaaaccatgagtttccc

SEQ ID NO: 73243 - DNA, 565 bp, Triticum aestivum
  Clone ID: PAT_TA_73243
tcggcacgaggggcacagctaccggcggcgcagccacacagcagcagcaggtgaggaggagaggagacccgccgccgccgccgccatgggtatctcgcgtgattccatgcacaagcgccgcgccacgggcggcaagcagaaggcatggcgcaaaaagcgaaagtatgagctcggaaggcagcctgccaacaccaagctgtcaagcaacaagacagtgaggagggtgcgtgtccgtggaggtaatgtgaaatggagggcactccgtttggatactggcaactactcatggggaagtgaggccgtgacccgcaagacccgtatccttgatgtggtctacaatgcatccaacaatgagcttgtcaggactcagacccttgtaaagagtgctattgtgcaagttgatgctgcccccttcaagcagtggtacctcactcactatggagtggatattggtagaaagaagaaggctcctgcagccaagaaggatgctgaggggcaggatgctgaagctaccacagaggaagcgaagaaaagcaaccatgttgtcaggaagcttgagaagcgc

SEQ ID NO: 73244 - DNA, 596 bp, Triticum aestivum
  Clone ID: PAT_TA_73244
cggcacgaggggttgtcggtgaatgtggtgacacagattatgaaggactacttggaggcgtgcacaaaactatcatactcaaaggctcgttcaatactgctccaaaccaagtccatgctaacagaagctattcattccaagatgttgtatcccttgagaaacaaggaattgcttcaattgagggatatggtccagacaatctaaaatcagctctaaggcaatttggtatatcgaaagactaaatctttgatcttgctggtcagcagaggaatcaaactaggatcgaggagagtggcaggacttcccctatgccgtcgtactgcacctcgccgaaaaatagtgggattgctatgcatggtccttattgtacactagaaaattggggacacaaacttgtgtcagattctccgttgcaaaattcagtgatggtgtttttgtaactatacaaaagttgtgccagtttctccgttgttgcaagactcagtgatggcgtttttgtaattacacatcccaataagactgatgactatgcaacctgagggaaaatgacaattttcctagatcaaatattttcaaaaaaaaaaaaaaaaaaaaaa

SEQ ID NO: 73245 - DNA, 626 bp, Triticum aestivum
  Clone ID: PAT_TA_73245
gcacgagcacatgaggaacagcgtctccttgatgttgttcaaagactgtctacgcaacatgcaaatcttcgatggaactctgagttttccaggagcagcagagtaagttctcgccttctccatacttgttctttcttggataaacatgcttgcaagggatgattctcttcaggttacagtacacttgaagaagcatctggcatctcactatctttgtttgtcatttgcaggagatgcacaattgcttaacagtagtggcatgccatcagtgttacgcactgttggcagaaactcaaatttgaagtttattgaaaagttaacaacccgattgtaacaacggccttaagaaaatatacttgcaaaggaacaacgggattataatgaggaaatgacttaattttatgcttgtttgagcactacaacaatgcacacctaccggttattattgtatagccacctcactgttctattactatgctatagtatatgcttagtgactaaagcttctcaggcgagttgtcttagctgtgttcttttatatcttgctactggtcagtattctgtatgtatcattgtaacctattacatatgattatcaagtacgaattattgagtcgctgcttctt

SEQ ID NO: 73246 - DNA, 664 bp, Triticum aestivum
  Clone ID: PAT_TA_73246
caaacatgcttaatcaagacgcactctcaggtggaatattgtcaaatgcatttcgtggtagtttgtatacgactatgcattatatggaatctgagggtatacttgttgctggtatgggaaatggttcaatcaggtttattgacatatctcggaatcagaaactacatttgtggaagagtgatacggctgaaatatctttctcatcacttgtgtcagctatttgctcgtgtggctcaaacaaaggaagtccaatggcttcatcctggatagcagcaggtttaagttctggatattgccgattgcttgataagcgtagtgggaacatcattgcagtttggcaagcacatgatggacacattacaaagctggcagcgccagatgatcacttaattgtatcaagttcccttgacaagactcttcgagtgtgggacctcagaaggaatctgggaacacagtcaaacattttcaaaagtcattcagacggcatttccaacttctctgtgtggggtcaggacgtggtatcaatttcaaggaacaaaattgcactaacttccctatcgagaccagcaagtgaaattggacatcagcagcttgcactccagaatttgtattcggctgatagaggggtgaaacacaaaaacctatctgtcctttccactattgc

SEQ ID NO: 73247 - DNA, 692 bp, Triticum aestivum
  Clone ID: PAT_TA_73247
atcggcacgaggctctctctctctctctctctctctctctctctctctctctccctctctctctctcctgtctcctcagtacaaccacggccacccccacccccacccccaccacagcagccacatccttctcagacacttcaacaacttggtgctatccaattaccacaccaagatcagcagctgccatatccccagagtgctatcttgccacaagttccattgcaatttcctaaccagctacccattcctcaactacaattgtatcatcaaagccagcaggaatctgggcaaacactgaggcaagttggcgaacaatcacagcttcagaaccagggtatgcaagctgatagtttctcacaacagcagcaagactcagggatcaacttaaatcagttcttttcatctccagaagccattcagagtctacttagtgatcgtgagaagctctgccaacttttagagcagaatccaaaactcatgcaaatgctccaggatcgcattgggcagttgtagccgccactggaggtgctattgtgagtgaaatctgatgctgggtctattgctaggttcctagagtctggtggagtttcgtttttggctatggatgtagctagatgaaatcaactgctggcttgctattgcagcaatagtattgctagtcgctgaaatgtattcctatgtacattatc

SEQ ID NO: 73248 - DNA, 714 bp, Triticum aestivum
  Clone ID: PAT_TA_73248
tcggcacgaggccgcaacgactacgcccaagggagagggctggaagaagctgcgccggaaaggcaggatggccaacggcggcgacgcccccggcacgccgaggagccccaccgtctacgactgggtggtgatcagttcgctggaccgctgaagcggccgggcccaaggccaacctgcccaagatgagaactccgacagccacaaggagaccatcaacagctagcgaactgcaacgaggatcagaacagagggacctcttttcagagcttctggtgacggttctgttatagtgtatacgttaattaacggtgtatatatgtcatcttcctgtaaatctccgtgtgagtgagctgctggcctgctgctgattttgtaagctaaagctactactactccgtactacgctcggcatcagctcgtgcatgtcaccgtactcgtgtacatgtcgtgaagggggaggcgggcaacacaacacaaggagcaacagtagtgttgaagagagtactgatactcctactccgtagtacttatgtggctatgtacactaatcctgttggctgttgctgtacgagtgactagacgcagcctcccctgcttcctagtagtctgtagcacagggtactcctccgtatggtttctgctgctgtgtataatgtaaaatgtataataatcctactacgcgcgcaacaataatgcgtggttttggcaaaaaaa

SEQ ID NO: 73249 - DNA, 374 bp, Triticum aestivum
  Clone ID: PAT_TA_73249
cggcacgagtttcaggccgcccagtggagggcttcctcgtgatctggaaaaacttgacacgtaatatgacctgttctacaaaagtttatcgatacattttttggtttctcagaggcactcagaagtattttacccacagttctgagttgttgctgatcatgacgagtgtgagtgatttgtagttgtagggaacagtagctaactgaaccatatgaaggatttgtatgttctagacgcatcttagacaaccataagtccatgaacttcagcacccctttggcacctatgttacagcctggtgtgttttcaggatgctttgtagtatctccatttaagtttgttatgtgagaaaaaaaaaaaaaaaaaaaaaaaaa

SEQ ID NO: 73250 - DNA, 623 bp, Triticum aestivum
  Clone ID: PAT_TA_73250
cggcacgaggcatccgccctcgattcctctcgccggtttgctctccattgccagctgccggtggccatggatgacggggacctcgatttctccaacccggacacattcctctgcccggccgtcggtggtgctgaccccgacggcagctgctccatggacagctatttcgacgacatcctcaaggatacggagcaccatgcatgcacccacacccacacctgcaacccgcctgtgcatgacctctcacacacccacacctgcgtccatgtccacaccaagatcgtctccgccccatccgacactccgtcggatgctgccgagaccgccgagtccccgacggagaacaatgcctccaagaagcggccgtcgggtaaccgtgccgctgtgaggaagtacagggagaagaagaaagctcacactgcctcgctggaggaggaggttgttcatttgagggctctaaaccagcagctcatgaagaagctccagaaccatgccacgctcgaggcagaggtatccaggctgcggtgcctgctcgttgatattagaggaaggattgaaggggagattggggcttttccttatcagaggccagtgaagaacatcgatttggtttctagtgttga

SEQ ID NO: 73251 - DNA, 744 bp, Triticum aestivum
  Clone ID: PAT_TA_73251
cggcacgcggtatgcactcatcgacatgggcaaacaaaattcttggaccttcgctggttgccctctataatccactccaaccagctttttctaccgtcctctctactatttttcttggtgccccagtttatgccggaaggtttgattctacacactgtccaaatgtccaataagtatgccaaatgtgatatttgaacattattactctctctgtcttaaaatataaggtattgaagtgttcaaaatatatcctaaattgtaaggtatatgtgtgaattaacttcctaataaaggaaccaatcacatgtgtatcagtcataattgtgtaccaccaggtttaaaaaaatagtaaacacatgatctccccatgtttaagagagggttaaatgcaccatttgctctgcaccataatctgtcctagaattcccgctcgttatatttggggacagagtgagtattagattattcgtcaaatcttggacctttttgaattagtagctcttgagtatttgttcttattacttgttgacttatactcttgcaagccaaaaaaaaaactacattgtggtactcgatcaaatatgaaactggtgaactttttacagatatatatagctattgatattcttcgattctctctttataaacttaacgaagttatgaaattcatcatagagaaaaacaacttatctttacaagtagtattgatcctaaccttttctgtacacttgtattcaactgctt

SEQ ID NO: 73252 - DNA, 747 bp, Triticum aestivum
  Clone ID: PAT_TA_73252
cggcacgaggcgttcccggctactcccgtgaccctgagaggagaggcgactaggcgaggccatggcctccggcaccggcaccggctcccgccagctgcaacccccagcagcggcggcagatgctgacccgggagccggcggcgacaagctcgtcttcgaggcgccgccgcagcccgtgagggacgactacgtcgagaacgccgtcaagttcctctcccacccaaaggtcaggggttcccccgtcgtctacaggcgatctttcctcgagaagaagggcctcaccaccgaggagatcgacgaggccttccgaagagtccctgatcctcaacccagcactacggctaccacttctccacagcagcaggtcaacagccaaaatcattccgctggcgtgcaaacttacactccagcgcaacctgtgcacccagcaactgctggccctgttgcccttcgaacacaacccaggttcagctggtaccaagcattcctcgctgcagggctcttgcttggttttggtgctagcgctgctgtctttatcaagaaactgttccttcctaggctcaagtcttggatacgcaatgtcgtagcggaaggtgatggcactgaaggcaaccaacttaaggccaggatagatgaggaaacagccgaggctgtaaaggcctctgcttcagctgtttctgctattgccaaaacaaaccaacatctgcttgcttcaaggatgaagaaaagaagatactagtgacgtta

SEQ ID NO: 73253 - DNA, 520 bp, Triticum aestivum
  Clone ID: PAT_TA_73253
gagggggtgttaattatccagtttttttttccttgttttttctctccttctccttctctgtgcatgcgcatgtgtcggcgtacttatatatgcaggtctgaggcgcaccggcaagagctgccgcctacggtgggtcaactacctccacccggggctccggcgcggccgcatcaccgccgacgaggagcgcctgatcctgcagctccacgagcagtggggcagccggtggtcgcgcatcgctaggagcctgcccgggcgcaccgacaacgagatcaagaacttctggaggacgcgcgccaggaagcagaaggcggcggcgcagcagcagcagggcagccggagcagcaagacggcgtcggcgttctcggggtcgtcgtcgtcgtcgtccgtgacagccaccacgtccaggtccagctgctctggctctccgagtccgagtccgagcagcggcggctgtggcggcacggccaccacgtcatcttctgccgtgaccgagtcagcgctgcggcaaagcagcggc

SEQ ID NO: 73254 - DNA, 692 bp, Triticum aestivum
  Clone ID: PAT_TA_73254
acgccgcgccgtacccggccccggcgtaccagcccaccgctgccgctgctccggcgccgcaggccgcgaagccgcggcagctggaccggcggtactcgcggattgccgacgactaccactcagtggaccaggttactgatgctctagctcaagcaggacttgaatcatcaaatcttattgtcggcattgatttcacaaagagcaatgaatggacaggcaaattctctttccatgggcgtagtctacatcacattagtaacacaccaaatccgtatgaacaagccatctcgattattgggcgaacactatcgaaatttgatgaagataatttgattccatgtttcggatttggagatgcatcaacacatgatcaagacgtcttctgtttctctcctgacgagagaccttgcaatggattcgaagaagctcttgatcgttatagggaacttgtaccacatttgcgcctagctggaccaacgtcctttgcaccaatcattgagatggctatgaccattgtggagcaaagtggcgggcaataccacgtcctattgataattgcagatgggcaggttacaaggagtgtagatactgcatctggacagctgagttcgcaagagcaaaagactgttgatgccattgtgaaggctagtgaactgcctttgtcaattgtgttagtaggagttggtgatggc

SEQ ID NO: 73255 - DNA, 579 bp, Triticum aestivum
  Clone ID: PAT_TA_73255
cggcacgaggcaatatcctgatggtcgaccttgctgttgatgccaagtgtgcacagaattggtatgcggccaagtagaccgtagtactttcctcccttccctgtccagtgttgactaccaaacacagcaaagcttgtggtcccagaagggcgtcaattcctttggcgaaatgaggtgcgttttgaactggtatctactgctagtagcctagtgagctcgtctccaggtggatgccatgcacggttattttgaaggtgggcagaggcaactggacagttaggggtcatcactaagcagtgaaagcattgtacactactccgtataggtcggatagcttgaccttacacactccctgttaggatctgtcgatttttcatgcctgatgtagttgttcttcctggatagtaatgaggactaatgtaattgatcgtgtggtgttagcatgccgtgttcataagatttgtttagcatgttgatgtgtagtgttagctgacctacactgccgtacgtaccgcaacaatgtaattgatcgtgagctttcttaatttctttctttctgctgctgaaaaaaaaaaaaaa

SEQ ID NO: 73256 - DNA, 569 bp, Triticum aestivum
  Clone ID: PAT_TA_73256
cggcacgaggcgacgagcagctgccgcgctaaagcttcgtccggggagcttcggagaagggccgggtaggtcaagatgcagatcttcgtgaagaccctgacggggaagaccatcaccctcgaggtcgagagcagcgacaccatcgacaatgtcaaggccaagatccaggacaaggaaggcatcccgccggaccagcagcgtctgatcttcgccgggaagcagctggaagacggccgcaccctggccgactacaacatccagaaggagtccaccctccacctcgtcctccgcctccgcggtggcatcattgaaccttctctccaggcgctcgcccgcaagtacaaccaggacaagatgatctgccgcaagtgctatgcgcgcctgcatcccagggctgttaactgccgcaagaagaagtgtggccacagcaaccagctgagggcaaagaagaagatcaagaactgaaacttggcaaatcggttccgtgtgcgacgtttgggtcaacaagatgtctagaagtttcaaagcttttgtcgctgcataatgctgctgcttcttttctaagtcag

SEQ ID NO: 73257 - DNA, 555 bp, Triticum aestivum
  Clone ID: PAT_TA_73257
cggcacgaggcatggatcttcttcaaggacattacatgacatctgttagtcgagacatggcagtcccaaccaaagcaggacttctggacagttatgcgtccttccgccttgcttttgcattggttatgggagctctaatgttcatgatgatgtcactaagacaagcccggaatgatgttcgccatttgttgctgtcacttctgtgggctggtctttgtattggcatcacacaatttgttaaagccaatggtcgcacgttcactaaccgacctaggtttcacaagtcacgccattgatggatgcaagctcgtcaggcgacctaggtttcacttgttgatacacattcgtttacatgaagtgttgcatttttttggcacggtacttgccctatgtaataagttttcttctattttgtaacaagtttttgtttccttctctcctacttttgattcatactgttctggccatcatggtcttttggtagaattcatttgtaaaaaccaagtgaacacgccttcagcacatatcagtgcattatgattttttttttcatat

SEQ ID NO: 73258 - DNA, 551 bp, Triticum aestivum
  Clone ID: PAT_TA_73258
cggcacgaggtgatttttcgctggacatctcagtctctggactcttgaggcgagccagtgcttaggcgcccagttctcctccccctgccccccaatcccctgcttccttctcctcaagcgcgcgcacagggagaggcgaagtagacgccatggcgatccagctacgttgtcttctctgcttcgcctgatttcgcgacgcttctcattttccctgtattgatctgcgaggcctgtgcccctccctcatcctccatccatctgtggttggttttgtaagtatgctttccccctgtgttcacccccctgctttttctgttcaatttttgctagatccggctcagtgttgcgttgttcccctgtgtagaggtggatcttagatgttttggatgttgcaggtgttgccggtgtatggttgatgtatatgtagtggtggatccctcctgtcctgttttttgtcgattttgcgcttctggatgccgctgtagttgtcattgtgacgagtagctcctagatgtgtacaatccctcatgtggatccctcctataattgtc

SEQ ID NO: 73259 - DNA, 512 bp, Triticum aestivum
  Clone ID: PAT_TA_73259
gagatcatctttctgcacttgaacttcacaaaaaacagtagcgatgtgtttgtgcattttgtgcccagtgtggaggaattctccgtcgacttgcaggttcagtgatgggcgggttcagcggatgggcaaattagaaacaaatcttccttgttgtctccacgggcgaccttccctggctcctctcttcgaccttccgccgagtctctcctgcagctgcgcatggcgctcggcggcttccctggcgcctgttcaaacagtctattttttgtggctctcccgatgtaaggctaatgcacccaacggctggctctgcttagtgagttttttctttgaatttgctgtcaatttgggcgtacagagaagaaagcaaaaggcagaagacgaagaagaaaaaggtcaaagggacaaggcctcgtggtgtggataagaagtgtgtggtgaacgagggtatgtacatatattactactcggtgaattaaagaacttgtggttcaaaaaaaaaaaaaaaaaaa

SEQ ID NO: 73260 - DNA, 583 bp, Triticum aestivum
  Clone ID: PAT_TA_73260
attcggcacgaggccttattccatccgtacggtttcaaaattgtaatttagagatttgacgttgggattaactaatattaaatgagttttctattcatttcttttttattatttcaatccttagctaagaaacttatgttttttggtgtttcattagttatagaaataatatagtatttctaatttaagtaaaaaaataattcataaggattacatacatattcgtaattaggtttcttatttttataaattaaaatttctatagaatagtaatttaaattcttagatgaaattaataattgtacttagcttagagcttttcatcaatatttttttttttattaattttaattttaatcattgtttatattgattaattttacattgtaagtggaattttcaacagtaaataatgtatatgttaaataactagtgtctaacatagattatattattctatacagttatataattgcatttaaggaactcatatcccaaaatttattactcgctgtaatattagtaaatcaatttttgttcatttatggtaaatatattttaataaaatatattttaattattt

SEQ ID NO: 73261 - DNA, 550 bp, Triticum aestivum
  unsure (1)..(550): unsure at all n locations
  Clone ID: PAT_TA_73261
cggcacgaggggtgaacactgtccccccaagaaccgacggcagcgaactgcgacaacaagggccagatccaacctggtgcctctgctatgaggtgcacataagggagcttgggacactgttgcattgtgtgtttaggacaataccctgcatttgctttgataattgtaatcgtggttaacctgacagtgctgcgtagcactaggctgcccagcacttagttacccttccgttttattatggcggcggtgtgcagcaggggcaatgggctggcctgtgccgcctcagccaactgcagccaccttaagctctgtactacccggtgtaagtgtaactcttagcgtggtctacattgatctcaggagaggactggaggacatagtactgtctccgactgttgtaacgtgactgttgtatgtgttgtagccttgtgttattgaacttattatgatccataaataaagccatataagcgtggcagggtcattccctgaccaccttcaggcnaaaaaaaaaaaaaaaaaaaaaaaaaaaaaaaaaaaaaaaaaaaaa

SEQ ID NO: 73262 - DNA, 763 bp, Triticum aestivum
  Clone ID: PAT_TA_73262
cggcacgagggctggtggagctgctggagaggatagagtccaagctgtgtgctctgagaagaatggatggttgatttgtggaatatatgatggatttaatggacgagatgcagctgactttttggcagtaactttatatgataatatagtatattacctatatttgttagagtgccggattaaacaagaaaatggtctatatggttcaccagagggctctcttaatggtgttaaaagtgagttaacactggccatgagatttgcagaaaatgaagatgtgaaattttctgaaacatttcgagctggtgtgcttaagtgcctcactactgctgttgagcaagctgaaaatgactttttatgcatggttgaacaagagatggacgatagaccagatttagtatcagttgggtcttgtgttctggttgtgcttctacatggaacagatttgtgcatcttaaatcttggggatagtagagctgtgcttgcttcagtgccgtcttcaggaatggataaattgaaggctgttcaattgactgagatccactcacttgaaaatccattggagtaccaaaaacttttagctgatcatcctaatgagccatcagttgtgatgggtaacaaaataaaggggaagctgaaggttactcgtgcttttggagttggctatctaaaacagaagaagttgaacgatgcactcatgggaattctccgagttcgtaatttgtgcagcccgccttatgtgtacacaaatcctcacacagtt

SEQ ID NO: 73263 - DNA, 757 bp, Triticum aestivum
  Clone ID: PAT_TA_73263
gagggtttcctagtgccggccggccggctagccaccatgctcgcgaaagcttctccacgtccgtgctccaccggcgccgttgcaggcggggtgccgagcggcggcgctggccttgcacgaggaggagcgaggtggccggcacgaccgagagccgccgccagcgtcaggctggtcgccgcgaggccggggaggaggaggaggacgagggtcgtggctgcggccgcaggcgagaggacagcgtctgggccggggccggagccgatgatggtagaggctgctaatggatcgtcgtcggccgtagcaggtatcagcaccctcttgacatcgactgtggggaaatcgacaaatatcctgtggcatgattgtcccattgggcagaacgagagacagaatttgctgaaccagaagggttgtgttgtgtggatcactggtctaagtggttcaggaaaaagcacgctcgcatgtgcgctgagccgtgagttgcacattagaggccatctgacatacgtcctcgacggcgataatctcaggcatgggttgaaccgggacctcagcttcaaagcagaagatcgtgctgaaaacatacgcagagtaggggaagtagcaaagctattcgcagatgctggcctgatctgcattgctagcttgatatcaccttacagaagtgatcgaagtgcatgtcgcagtttactaccaaagtcttcgtttatagaggtcttcctaaacgctccactggaagtatgcgaagcgagagatc

SEQ ID NO: 73264 - DNA, 605 bp, Triticum aestivum
  Clone ID: PAT_TA_73264
cggcacgagggtacgattgcataggtcacgattcagcactacaagcaggaatctgctaggctgaggcagcagatcactaacttgcagaactccaacagggccctgataggtgatatcacaaccatgagccccaaggacctcaaacacctggagactaggttagacaaagcacttggaaagattagagcaagaaagaacgaagtgctgtgttctgaactagagtacatgcagagaagggaaatggagttgcagaatgacaacttgtacttaaggagcagggttgatgagaatgaaagggcacaacagacagtgaacatgatgggggcgccatcgacaagtgattatcagcagcagggttttattccttatgacccaataaggagcttcctgcagttcaacatcatgcagcagcctcagttttactcccagcaggaggaccggaaagacttcaacctaggtggaagatagataatgaacctctggagcttcagttatccgatatgatgtgcctcaagtgagaaactggagctacattattagtgtgaaattatatgtaagattagtactactgcttcatgtgtgtgcgcacacgcctacatagtatg

SEQ ID NO: 73265 - DNA, 415 bp, Triticum aestivum
  Clone ID: PAT_TA_73265
gaggccttgtaggagtgaacactgcggaggcttcaagtatcagcattgttccgttccaactgataagaatacgccctttcaattttgctcttttgcaggtcaaacctcgacctgagctgtttctgtagtgtgctagcagttaacctattcgaaacatttattgacctgtgacgcccatttcatccatgttggggttacacggtgtaaaatgagaacacttgtggttccagattcattcctagtgccttgaaaaggagggctgattttgccctgaagtggcttgtttcacaataagagacaataatgaaacgtgtgttcattgtttattgacatggctaccaagacaatgctgaactttctgcatattttgtcacatgacttatctttgttgtaaaaaaaaaaaaaaaaaaaaaaa

SEQ ID NO: 73266 - DNA, 558 bp, Triticum aestivum
  Clone ID: PAT_TA_73266
cggcacgagggtaatcccatcgtcaagacctggatgctctccatctccaccgtttgcctcgtcctcaccggcgctgcctacactggcccatccatgaaccctgccaatgcgtttggctgggcatatgtgaacaatcgccacaacacatgggagcaattctacgtctactggatatgcccttttgttggcgctgttcttgctgcctgggtcttcagggccgtgttcccaccaccggcacctaaacctaaggccaagaaagcatgaggaaatcaagcacaaacttcaactcaggagttggtacagatgttgggtttgaagaacccaacattatttattagctagaatggtacaaggaataatcctttccaccatatttaattcaaagtaatttaggtaattagcttcggaacactgacaaacccaagagcatgcacattaatttgattggacgacctcaatgtaatttcaatcattcattggtcttgtttgctcttgaactggtggatggtatgaatggatattataaatttatcagtaattaaaaaaaaaaaaaaaaaa

SEQ ID NO: 73267 - DNA, 350 bp, Triticum aestivum
  Clone ID: PAT_TA_73267
tggcgcccaagaaggtcactccaagggtgacaggagcctttgggttcatcacctcgctcatctcctgctatcagcaacttccttcccgcgctcctttggccaaagtcaaagtttgagtagtgtcgccgacctagaatagtagaataaatgagacaacgctggaaattggtctctacttcaacaatggatcgtactacaattttatagcccttttttttaaaagaagaagacaaaatggaacaccagtgattatcagtgtatcttctctttttgcctagcaatggacatgtacgtacggaatgttcacatggttatgtctttataaaaaaaaaaaaaaaaaaaagaaaaaa

SEQ ID NO: 73268 - DNA, 542 bp, Triticum aestivum
  Clone ID: PAT_TA_73268
cgacccggcgctgttcctcaacctgccatgagccgcccgtgacaacgccaccatggttaactaatccaccatcacgacccacgagatgagatgaacagagcacgcagagcgcgcgtctggctcttgaagctaggtactggagtttcctgagcttactgtagcgatctctactcgtctagtctgtctgacagtcttttacactagtgttttgctggtttaaaatcgccccgctttgtactccgtccaatctagtaaaggctaacatgggatagccgggctctgcatgaatctgtgcttgtttcgatcgagctgatcatggtgctttttgaggccatgagaatcacaagaacagatgcaaggagaaggacggcgaacttcgaagtcgtgtcgttggctcgttgcaagtgttggaggcatatattctaaagccggccacgcatgtcacgccggttcttgcaaacgctaaactagtattatcgtttaaccaccaccatcgaaccacgatcacgttccagttcggtcgcaaaaaaaaaaaaaaaaaa

SEQ ID NO: 73269 - DNA, 553 bp, Triticum aestivum
  Clone ID: PAT_TA_73269
ttcggcacgagattgtgttgtcttcatacttcacgggttttgtgctagccgtgatatgtttttggccacatgccttattcaactaggtacatccgctgctccgagactacgagaagttccatgcctcggtgaggctggtacctattttttaggactaggtgtgctatgattctcacttcctactgatttgtccacttattctctgtcctactcctctcttttgatttaatcccctgaatctctaatctttatttgtgcagattctcttacctatgcctacaaggtgtttgatgaaaatccaagcaagctgcaaagaatattcatctatgtaatatctatgttccattatctctgcttaataactttttctgaaatttagttgcattcaatgattgcttcctctcatgccaatgcggcaatatctctcatctgaattctcatttatcttttccagttacatagtggcttatgtgctacctggatgttggagtagcagtatgtgcgaaaatgcttttcttttttagagcatttgtatgccacatctggtagcgtt

SEQ ID NO: 73270 - DNA, 366 bp, Triticum aestivum
  Clone ID: PAT_TA_73270
cggcacgagggaggagcttgaaaaggaacttgatcagagtacaacgtctgagaaaggagttgacacaaagaattgatcaacatcatgttaggggtactcctcattgtatatagcgtctgtactattgtttttcttctctcctctttggaaaaactgcttgtacatatgtatggtgttgtatgaactgcacttgcaagatgcaacccaccatgatcatagtaaggcatggagattgtgtgcttgggtgctcgtagatgaagaaccgaagactgtttgatgttgaaagaattatttgtactctatcaagtcattatgcataaataaatacatattggttcgcaaaaaaaaaaaaaaaaaaaaaaaaaa

SEQ ID NO: 73271 - DNA, 733 bp, Triticum aestivum
  Clone ID: PAT_TA_73271
tgggtgatgatggatgtgatggcgtctctctccctgggacggctaagcggccgccaaagctgcaagtaaccagaccatttgaacaaagcgtcagtagcacgacgaaaaggaatacgctgaatcacaagtttattcctaacagtccacagcatccaggcaaggaccccaatggtgagccacctaatgtggcgcagcgtgggtgggttcgcctggagttcggcaaagagagcggggaagttgttatggtcccagcttccacccacaatctcacggaaacaactccataggaactgcgcggacacgcaggtgaagaagatgtactttctcgcttaaactatcctgcaaaccagccaccaaatcaatttagtatggacacaaaaaattgccaaacaacacactaaccaagtgaaagcaatgatcacctcagattctgggacgggctcctccttctctttaggtgtcatattttgctgacatgctctaacacttactcgccttgcttggatttcttctggtgtacggctagcgtaccttattgcttcacattcacgctttcactctacaacatttacgcaagaaattaattaagtgggtaaatgaaattatataagcaaacacttccgccttatagatttaccttttgagctttctcctcgctccaagaactcgattgatgtgagcaccccactacaagtaggaaaaaccacaatcgctgattgctttatcacttcat

SEQ ID NO: 73272 - DNA, 776 bp, Triticum aestivum
  Clone ID: PAT_TA_73272
cggcacgagggaatcttcagttaggaagagcatgtcactggatgatttgcaggagaaggctgttttctctgcaattattgtagatccccagatgaaagacacaaaagaatcaccggagcaaagtggatcaaatagtacagtgcagaaaatgataagtgcctttcaaagcagctctccacaggatctgacgcggatcaaatcagaaagctcactaaaagggctgtctgcttcttcagagaatttcacccagtcttcttcagacaagtcatctagttcactagcaacccaggatgtttcaggccacacagaggcaggtcttgtggctgggacatcaggcaaaatgcagcttcctcctggtgacaaaagcttcagtaacaaaagatcaaatgcaaccgagcaacaggccgttctgtcaaccacatctgaaggcagaatccgtaggctattcagagagaagaaggacctcgataattcagagatggtgatcacagtccaaaaccggagcaagaagcggtcgatgccgaagcgtcgtcgcgctgccattggcccttactctcttgaacacatgcatccccatgtctgcatcaccactgcaagcaggcagctgagagagcttgttgagcttgagccacccttggattcgtttgtgtttgtaggacaagttgatatcaagagaccaaatgtgaggggaggagctagcatgcaagatcagggcacaagcgacagtaaaacgaaaaatgagatggtttctgctcgaggtgatgatcatggttttc

SEQ ID NO: 73273 - DNA, 305 bp, Triticum aestivum
  Clone ID: PAT_TA_73273
acaccttggacctcaagaccggtgacgccaccgtcgagtacaacgtattcatcaggctctagtctccgatcggggtcagattctacgaggactttcgtatactcatgctacaagaataaatgtacttatatgcgttacttacggaaaacttttctcgtgattcgtgtggtgtcccggacttaataaatctgggccctaaacgtcggccgattttgtccggtccggacgtgtctatttaaagcccttatttgttggtcgatgcaattatactcctcatttactcttttaaaaaaaaaaaaaaaaaa

SEQ ID NO: 73274 - DNA, 667 bp, Triticum aestivum
  unsure (1)..(667): unsure at all n locations
  Clone ID: PAT_TA_73274
ggaagaggccctccaccaggtaccggtcgttgtttcaactgtggaattgatggtcactgggcaagagactgtaaggcnntggtgactggaaaaacaaatgctaccgttgtggagaaagagggcatatagaaagaaattgccagaacagtcctaggagtgtcaggcgtgaaagaagttactcacggtccccatctccacgtcgtggaaggggtcgcagtccaagctatagtagaagcaggagcaggagccggagtcggagctatagccgatcgagatccctatctggatctcctaggggaggtcgccgtgaccgtgacgataggagatcaaggagtcttagctacagcaggagccccatgcgatctgcctcgccacctccaaaggaaaaggagcgcagccccacacctgatggaagcaggagcccaaggagtcgcagcccccaggatcaggtgatgagcccaccaccaaaggataacggcgaaggcaatggttcagaccgtggcgagagccccagaggaagggaaactagcaggagcaggagccgcagcaggagcccatccggtgataaccgcagccctgcagctaatgggcggagcccgagtcctagaggtgaccgtagcccaagccccagggctgaccgtagcccaagccccaaggctgaccgtag

SEQ ID NO: 73275 - DNA, 641 bp, Triticum aestivum
  Clone ID: PAT_TA_73275
cggcacgagggtcgactatcattacaaggaaatttaagcgaccacgaagagtatgacgctggtgaagattggtccgtggggcggaaatggagggtcagctcaggacatcagtgtgccacccaagaagctgttaggcgtgacaatctacagctcagatgcaatcagatccattgccttcaactacatcggtgtggatggacaggaatatgccattggtccatggggtgggggcgaaggcacctctacagagattaaactgggctcctctgagcagatcaaggagatttctggaacccatggcccagtctatgatctggctgacattgtcacctatcttaagattgtgacaagtgctaataatacatacgaggctggagtcccaaatggaaaggacttcagcattccactgcaagactctggccatgtcgttggattctttggaaggtctggaacgcttatcgacgcaattggcatctacgtccacccttgattcccagtggtcaaagaattactacctactaccatatctacgaaataatgttccatggtgttgttgtacttcatgcaatccccccattgtctgtgtacgtgttgcaccgatccgtagtacaataaagttggcgatatatatgttgtcccaa

SEQ ID NO: 73276 - DNA, 697 bp, Triticum aestivum
  Clone ID: PAT_TA_73276
tcggcacgagggacccctgttcctggcgcacgaaactcacccattgatgtggaggccatcgacgatgaagttcaggcagtatcgccctcacgagtgcccccgccaaggaggaacaggaggaccaggagggaacctataacagtggttgacttggaggttgaatctagcagggaagggaacaaacgccagagggttgtaccagtaggacatcacctctcttcagattcgggagcagggtccagcttgcagtcaaatgccgtacaaaccggcaaagagcctgccaaggaggtccccaaggaaacatttttcacctgcccaatatgttggaataagatggaggagccttccacaacgacttgtggccatgtcttctgcgacacatgcatcaagcaggccatcaagattcagaagaaatgccctacttgcaggaaggggctgaaaatgaatagtgctcatcgcatttaccttccgaaagcttctagttaaggttgattggccttatcaaagaaacttctggtaacataaggctgtgcaatatacagttaggatcagaagttcttagggtgaacagtggatagatgtttcatcctagtctgtatcatttaactgcatcaccaggagctcatcatgaaaacttcccgactagggaagtggatatcagcctcagttttactcccctcttagtgcatccatggtt

SEQ ID NO: 73277 - DNA, 747 bp, Triticum aestivum
  Clone ID: PAT_TA_73277
cggcacgagcctcatccccactggagaaaagagaccacggtcgccgccgactcagaccgcgcgcccgtcccccgtcgtccccggcactggcgatcgagccacggaggtggcgcagcggcaatgtcaggcgagcaccaagtgtacctcctatcacccgtccccggcaactcagcgcgcgcgcccgtcgtccccaccactggcgatcgagcatcaagcagcacggcgaggcaggatgcagttccgacagctgaagatcacaaaaggcccaagcgcaaacgaagctcagatagaaaaccatggatccgttgtctgccagatgacctggtcgagaagatgctagttcatcacacgatgcagactgacttgaataacgtcatggcatcatctttcttctttttgagagtggcactcttgccctgtccctgccataatcttggacgacaacctcgacttgtcgctgctttggtgcagacaaagagaggtttgcttaaagtcgcagctcgagacgggccacgcttaagatggctggagcccgcggccaacatgctgaacaagttccttcatctcgtgtaccactcacgtggatgggtaagacccgtcgactgtcgagaagggacagttgcagttatcagggacagacaaggaagggttgttgagctcctgagacccttccagggtcagaagattactacactacctgaggctccttgccacaatgcggatgaactgctcactggtgggctggtt

SEQ ID NO: 73278 - DNA, 568 bp, Triticum aestivum
  unsure (1)..(568): unsure at all n locations
  Clone ID: PAT_TA_73278
cggcacgagggtgtgctgggcgagggtgggtttggctcggtcttcaagggctggatcgatgagaagacgcttgccccgactagaccgggcacggggatggtcattgccgtcaagaagctcaaccaggaaggctaccagggtcacaaggaatggctgactgaagtgaattaccttggaacgctttcgcacccctatcttgtaaagctcgttggctactgccttgaagacgaacagcgcctccttgtctatgagttcatgccgcgcgggagtttggagaaccatttgtttaggaggagctcctatttccagccactgtcctggaacctacgaatgaaaattgcccttggagcagctaaaggtcttgcatatctccatagcgatgaggccaaagtcatctaccgtgatttcaagacctctaatgtccttctagatgcgaacttcaatgcaaagctctctgattttgggcttgcaaaggatggtccaactggtgacaagagccatgtctccaccnaggtgatggggactcatgggtatgcagctccagaataccttgcaacaggtcatctga

SEQ ID NO: 73279 - DNA, 571 bp, Triticum aestivum
  Clone ID: PAT_TA_73279
gaggggctgccacacacggacaggaagccgacggcgatggaggcgagcgaatcggggttcgtagtcaccggtgctgaacgcggaagcggcgtctgcgggcggcaggtccgcgccggtggaggagggctcaagctcgatgccggtcgtcctcgagccgcgtacgccagcacccgcacgccacgccacccccccgccgccgatgcagccgcagctggccaagaagagccgtcgcggccgccccggcccgcgctcccgcagctcgcagtactgtgccggccactggaagtctcacatctgaaactaaggctcgagtagagagacgcggctgctgtccaggaggtgacatttccacctcgtccaagagctttccaggagcacggatgccgtctaggaggtgactagctgccgcacagctactgtccaggagcatggctagctgcagcaattttatacaaatttcagagatgcaatgctctagagtctgtatgcagagaatgcctgtaaagtgcagtttgtgcaatagcttgcaaactatgtaaattgtggttgtatccaaagcattgaataaatt

SEQ ID NO: 73280 - DNA, 400 bp, Triticum aestivum
  Clone ID: PAT_TA_73280
cggcacgaggcgggcatggtgaagcacaggatgacgaggccgctccgtctgaggcatctgcctctgctcctcctccttcctagttgcaacttgcaacagctgagtgtccggtgagctaagggggtatcggaaatcaactcggcagtgattgatgaaccggcaaataaagagaaatacttgcgaatctaaacatcatgtgaaacatgtcccatacctgctgattgctgactgtgtgtactagtttcccatccaactttctgaattgtgtggcaggtttttatggtacacctgactgataccatccgaggaaacagaattgcttaataaaactagtacagatattctgattggttggttaaaaaaaaaaaaaaaaaaaaaaaaaaaaaaaaaaaaaaaaaaa

SEQ ID NO: 73281 - DNA, 734 bp, Triticum aestivum
  Clone ID: PAT_TA_73281
ttcggcacgaggcccaatctcagcggcgccgatgcccatcttcgtcgtcggcatgtgcttgccatagttccctgtcggcctcccatcttcgctggcgccgcctccattgggagccacgcgtggaggccatgaacgtggcgccggcgacataatcaggccgcgggggcgtggtgttcccgttgtgacctgagcttctcccagtagcagagccactcctcggtgtcaggtctcccaccttggcctcctccaccagcatcaccacaggcggcggcaacgtcgctgagacgataaatattggtggtaataggcttcgttggcgatgcgcataccacggccaagcctagccgggcctgcagcgagagtacccgtgtggccgtcatcgtcaccgaggcttccgagtcggcgacgaggcatgcacggcgccaaatgccgagttgttcttcttgtcaggagacgtcgatgcggtggccttgctaatctgagcctggaccgcgagcaaccgtacggttgtgctcgatgcggcgctggacgtatcaagggacgacgatagcacgcgcattgcagtgcagccgctgaccgccaaggacctccgcggggtcggtcggcgatgtcgccgcagttgacgtcggaccccatggacatgagcggccaaaatactgcacgcacggagctgcagcagttggcgttgtggcggcaccggcaccagttgttcatcatcctaccgaatgtgcggc

SEQ ID NO: 73282 - DNA, 366 bp, Triticum aestivum
  Clone ID: PAT_TA_73282
gtagcgtaaatacagagacaaaaaaaaggaataggttcgttcgtcagtttctagttaattttcgtgcaagcttgtactgctgcaagcctgacattggtcgatggtagaagttaaagtagttgcattggattgatctcttcagtaagtcagttgggtatggtcgtctgccctgtccatggtgcatgacacatttggagttgagatgcgtcaattttgctggctccatagggcatatagagttatagaatatatccggtcactcttgtatgcctcgctgcaacacatattaagtgtgaccaattttttcaggcaaatatatattggtgatatatttatttaaaaaaaaaaaaaaaaaaaaaaaaaaaa

SEQ ID NO: 73283 - DNA, 560 bp, Triticum aestivum
  Clone ID: PAT_TA_73283
cggcacgagctgccttcctatctacacactgtctttgagaaccactccagtatgcatagaggacggggcgtcgacccgttggctggcagctgaggttgctgtcagcccacccgatttcaagtctcggcttggacgcgtggtgctcgcggagtttctcctataaaaaaaagccaacgaggtttagcccttgggttggtctcattttttttcactatgcatagcaatacagatcatgcataggtccttttgcgtactactactctatgtgcccggatcatgcatcgtatcaagtggagcttttggatactggatgtactggtagctcgggatatctacaagcgatttggatggcgatccggtaatagactagatgtttagtcatctagttctgttttagcctgttgtggcaaatcttatcttattttaattttgagcttctagcatatttgtatttcatcggagatctttttggacctttcgtttaatagtatggttgcatgcatcgttctgatgcagaggccggggataatcctccttttccaaaaaaaaaaaaaaaaaaa

SEQ ID NO: 73284 - DNA, 723 bp, Triticum aestivum
  Clone ID: PAT_TA_73284
attcggcacgaggctgcaccgtccggggagtcactcagacaggtacagtttcggatgatggaattcctcaaccggacagtcctaagactaccagaaaaggtggcaatgggggacacactgtcacaacaaaatgagttgaaggggttctctcggcagagctccagtaattctgtccaagatggtcctccttgggatttgctttacaggctcaaccggcacagcctccaacgaaagaaatctgggaaaagccgactccagtttgtcacttcaggggacaatgaagctgaagatgatttctcccctaaagaagtaaaccagaggcatctccttcatgaaggaagtcttgggggctcagcggcctccattgctattttcagccacgtgacccctattcggtgcctcattgcaggcctgctagactgcaatcctataatgtccaagagaatatgtatagacgattcttctgttactgttcttgagcattcgctgaaaacaggatggcaaataaaaaggctgaatgatactgcacatctcaggcttctctagctgatcagtgtatcatgcattgtaaagaaattatctgataccattctccaaatcagatgctgaagccactagctgcatacgtgtactatgcggccatcagaagtgtggtctcatcactgtatttcattgtatctatcgaatgtctctaagccaggtaaaaaaaaaaaaaaaaaaaaa

SEQ ID NO: 73285 - DNA, 571 bp, Triticum aestivum
  Clone ID: PAT_TA_73285
cggcacgaggctccttttaacagtttaacaacagaaaatctacagttcttgtcatcaaagcaggctttatttgatcttgccgttttccgccaatattatcaggaaaccttaaatgctaagtataatcgctctggggcagacagttcttggtttgtttttggaggatcatatgctggagcactcagtgcttggttcaggttgaagtttcctcacttgacatgtggaagcctagcaagttcaggagttgttcttgctgtatacaactttactgattttgacaaacagattgggatctctgctggtcctgagtgcaaggcagcacttcaagaaataacaggacttgttgatggacagcttcagtctggccgtaattcagttaaggagctgtttggagcaccaaagttagaaaatgatggtgacttcctctacttactggcggatgctgctgctattgcgttccaatatggtaatcctgatgtcttatgctccccactagctgaagcaaagaagaatgggacagacttggtggaaacatttgctagttacgtcaaagattattacattggaaaat

SEQ ID NO: 73286 - DNA, 413 bp, Triticum aestivum
  Clone ID: PAT_TA_73286
gttgaatgtgtgattcagctagcttatagaacagcaagaagggataactggattgatgtcgaggtgaaggtagacaacataaggtgtgatgtggactctttggtctctgagaccctcatggcagaacgaggatatggctctgaagagaagcacttcccatcccgtgtcatgctgcaaatcacacctatgcaacaatctgatgtgctgtctgtttctgtcggcaagtccaacgacaaccccacacatgaatttggcattgagaagggctttgagggttcctttgaccccccaaactcatttggtctgaaggcatcagtcactgaaagccttactctggccatgaagccctggaaatttgagcagtctgtgcatggcaacactgcaaccttgaactggtttcttcatgatggtat

SEQ ID NO: 73287 - DNA, 573 bp, Triticum aestivum
  Clone ID: PAT_TA_73287
cggcacgaggtcgaggtgttctaggtggagtccggcgagtcggagctcgagtccgaggatgaggccaagcccttcgccgcccccaggaccaggagcgcgctccccagagatggattaaacactagtgcagttgttgttgatggccctgctgcaaattcagttaaaaggaagaggaagaaccagtttaggggtatccgccggcgcccatggggtaaatgggctgctgagatcagagatcctcgcaaaggtgttcgtgtttggcttggtactttcaactctcccgaagaagctgccagggcttatgatgctgaggcacgcaggatccgtggcaagaaggctaaagtcaacttcccagatgaggtttcgacgattcctcagaagcaccgtgctggtcctacccctctgaaagtgcctgagatggactttgaagagaagccgattatcaagccggcagtcaacaacatgaccaactcaaatgcatatcactaccctgttgtcgaccacaacatacccgagccatttatgcatactcaaaacatgtcatttgctccttttgtgaattctgctgctcca

SEQ ID NO: 73288 - DNA, 559 bp, Triticum aestivum
  Clone ID: PAT_TA_73288
cggcacgaggaggacttcccggcgcccgttcaggatccacatccttcccgagcgagttcttggttgacctcttcctcttcgaccacctcctaggctcttggtgtagcttgccactctcaccaatcaagttttcatgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggtcattcaactccagggtgatcagaggaagaacgtctctaatttccttgtccaggccggcattgtgaagaaggaacacatcaagattcatggtttctgagcgaccgccgggtccatagcaagccctgcatgcaaagcagctatatatctgaggtggagcatatctatctggctgtgt

SEQ ID NO: 73289 - DNA, 685 bp, Triticum aestivum
  Clone ID: PAT_TA_73289
attcggcacgaggggatgctcctagcgttgatgtcaagaagaatgtgattgtggccattacctctgataagggactctgtggtggtattaattcaacatcggtgaaagttagcagggcccttcacaagttgacatctggtccagaaaaagaaagcaagtttgttatattaggagaaaagggaaaagttcagctggttcgtgactcaaggaacagcattgaaatgactgtaactgaactacagaagaatcctatcaactatacacaggtgctcacgtaaaagagctgtgaattgagttaaaaattaatcatccactttgtaaaacaattgctgtgctggccgatgacatattgaaaaatgtggaatatgatgctctgagggttattttcaacaagttccattctgttatatcatttaagcccacaatggtaacaatactgtcccctgaggttgcagaaaaagaatcagaagctggtgggaagatgggtgacctagattcttatgagattgaaggcggcgagacaaaatcagagatattgcagaatctagctgagttccagttttcttgtgttctgtacaatggtgccctagagaatgcatgcagtgagcttggagcccgtatgtctgccatggacagctccagcagaaatgctggcgatatgcttgatcgtctaactctcacttac

SEQ ID NO: 73290 - DNA, 572 bp, Triticum aestivum
  Clone ID: PAT_TA_73290
cggcacgagcgacgatcatggcctcttcgccatcgacgttctcgatccttcctgggtgagtgagcttatggttgctagttcagtgaatggagttcaatggtagatcttttcttccgttcgttcgatgaactgtacactggcgatatattttttttttttgcccctttctgtgagcatggccggtgggagttttttgggggcgattcttgtgacacttggtgtctgttaattggggcaaatgggaagggagaagaggaagtggacatatagagatagagggatcagtgatggatatccgtttcgtactgtcgtatggagagctttcttgtccttttatcttactagtgctcttggagaatagataacaggatagggacaggcatttggtacatatggactgcacattgcatttagattgtggaccgactaggatgaaaaaaatggatttatgtggaccatggttgcttaccacaggaaaaaaaatactgagccggagctattatagtccatcaaatttgtatttatattctcttaacttcaaggaatgaagtcatgctttcgctcaaaaaaaa

SEQ ID NO: 73291 - DNA, 478 bp, Triticum aestivum
  Clone ID: PAT_TA_73291
cggcacgaggttgtgaagggcttcatggataaagcaaagccagtcgcctcaatttgccatggccaacagattttatctgctgctggagtccttcagggaaggaaatgcacggcgtatcctgcggtgaagctgaacgtggtgcttggcggggcgacatggctggagcccaatcccattgaccgctgcttcaccgacggcaaccttgtgaccggcgcggcatggcctggccacccggagttcatctcccagctcatggcattgctaggcatcaaggtctccttctgaagcaacgagaggtcaggtcccagcgtttttgcacgcgatatagcaagacacagctttgggctttcgtctaagatatatacagtcttaccgatactgtaccagactgtactatgcacacctgatagactgtcgtctgctgtcgttttttgtgcttgaaataataagataattactaaaaaaaaaaaaaaaaaaa

SEQ ID NO: 73292 - DNA, 561 bp, Triticum aestivum
  Clone ID: PAT_TA_73292
ggctggttccgcatgttctccgtggcggcttacaagccctacttcgacgttgacacttccgacgttgtcgagaggatctgggagtccgtcttccccttccgcggcacatttaccgagaagacctccgagaaccctgatctgtatgggccattttggacatgcaccaccctgatttttgttgctgcatctattgctacttttgtcacctacctatcccacaaatggcacaagaaggaatggaactatgatatcaacttggttacctggtctgctggcttattctatggctacgtgacgtttgttcctcttcttttatatgttattctcaaatacttctcagcacctgctggtcttgtgcaattgtggtgcctatatggatactccctgttcatcttcattccagcatcgcttctgtctattgtgccaatagaaatattcagatgggtgattgctggcgttgctggtttcatgtctgctaccttcgttgctgtaaatctccgtgcgcacattgtaaattctggcgagcgatggttcctgatcgttgcagggatattcttgttg

SEQ ID NO: 73293 - DNA, 530 bp, Triticum aestivum
  Clone ID: PAT_TA_73293
cggcacgagcaactgctcacaaaagtaaaggctaaaaaagcacgacgactcactcggtcaaagttgagtgtttcttatatagcctaatatttgatatgaatgccatgcgttagtagcaaagaacttccaaaaaataagcccaggcattttcacccaacatgcagctactatgatggtgctgaaagataaagaagattagcccatctgaagatcttgttaggataaagcatggttttacgatgattctattattattgtagcaataaccaaatctcccaaaaggtagctactccaacactcgtccccaagcactcaccaaaatatgtgaagtggtccatattttccctctaacaagtgacaaagcatatacagaacaatgataggactaagtatattggaagtagtatgtatacgatccccaaacaaagtttgtcatatggtagtcaactaagatgcgttgaaaggtttcatctttaccacacaagatttgatttcctactcattccatctaatccatctgaagatcttct

SEQ ID NO: 73294 - DNA, 686 bp, Triticum aestivum
  Clone ID: PAT_TA_73294
attcggcacgaggcgacggtccgccctcttccccatcccacccgcgacggccgacggcctcccgactccttccgccgtccgcccgtcccgcgccgcctaggcgttgtcccgccacttgaaggaggtcgtctcctccgactcagggcttccctctccatccgagcttggatcgctgcttcttttcctggtctggtcattcgtgagttcatactccagttatctgcatcacaagggaaatggcaagcaaagcaggtggtgatggcaaagaagccataaatgagcaagtaattgccaacacttatgccaacatgcgtaccgaaatgaaccagctctacaccaagatcacagagctggagatggaggtcagtgagcactcccttgtgatcggtgcgatcgaaccgctggacccctcgagacgctgctacaggatgatcggcggcgtcctggtcgagaggaccatcagggaggtcctgcctgcagtgaagcgcaacaaggagggacttgaagaggtgattgctcgcatgcacgaggcgctggagaggaagaagaaggagatcaccgagttcgagctcaagtacaagatcaggatccggaaggctgacaatgacgccgaggacgaaagcggcaagaaggaaggcactgctcagggagtccttgttggtcctgcctgacagtaaaacttgatt

SEQ ID NO: 73295 - DNA, 545 bp, Triticum aestivum
  Clone ID: PAT_TA_73295
attcggcacgaggactactatgaggacctcactccgaaacgtgttgttgagattgttgagatgctgagaagaggcgaaacaccccctcgaggcacacaacacccagagcggaaaaactgtggccctgctggggggaacaccaccttgctcggagagccgaaacctcctccatgcagggatctggatgcctgctaggtttgcttcggagcattacgagcacacaaataagttggctcgcactgtaaggtgtgcaaactgcaaacagcagaagggatgtattatttgcattctgaagctttcttgtgtttcacagtgaaagcttttctaacttttatatcctgcaccatcagagaaacagtaaattgatagacaataagatgttttttgatctgatgttcagtggcaaacgctttgtattttgcaaccggtgaaggagctgaacctgtggcaactggaagaatcgaccaccgtgcaatgctgttcattttgttttattattaagtcttgttgttagtcattgaatgatgagatcatatacttgatat

SEQ ID NO: 73296 - DNA, 664 bp, Triticum aestivum
  Clone ID: PAT_TA_73296
tcggcacgaggcgtaaagccatctactagtaccaagtagaggaaatagctcaaggctttggaacgcaagaacatcaccatgaagagcagcactctcttggtgatcctggctgtccaggccgctcttatcatgggaatctttgctgctgttgcaaaagaaaatgccgtgggtgagagcaaggcgatcgacatcaacccggggcagctcaagtgctgcagcaactgcaacttctccttctcggggctctacacctgcgacgacatcgtcaagaaatgcgaccctgtctgcaagaaatgcgccgtcgtcaagacctaccctgtgaagatgttcaagtgcaccgacaccttcctcggcatgtgcggccctccctgcaagcactgatcgatcgatcgatcgatgatgacctgaataatgcatgaacgcgagccattgctgtcatatatctgtgatctgtgtgatatacagtgtgcattatatatcatatctcgatgctagtatactgtatactcgaacaataagccgttgtctgagtgaaggaccaaataaaaataatgaagctagaaggtgtttgcatgttacttgggagacttgtgtttcccctggacttgagagggacatgagaacaatgttaatattatcttgtgataatagatatatattgtct

SEQ ID NO: 73297 - DNA, 538 bp, Triticum aestivum
  Clone ID: PAT_TA_73297
cggcacgaggccgcgggcgagtgggctagggcggctgctggagcgagggagggaggaggcggcggcgcagctgcgcaggctcaggtgcctcgtggccgcggtggccgacgcgctcgccaagctcaggacgctgacctcttgccctgtttgcagcaatgaaatgtaccgcactcatatttttttgacttccaccgaagaaatgttgcaagaatcctaaattgatcagaagattcagaactatcccgacttcgcaaaattcgtcgacggaatggtaaacaagggacagatttttgttatagatgattctggacaagatggtgtcatggatcagcatctttaagcaggaggggcagctgacttcagacatcgtagaattcagttctgctttggtagctgttcacgttttatgttatgactacaccatgattgtaacactagcgttcccagcttcgtttcatttttctttttcatttgaacctgtatacagattgacattctgttgtaaattttcttgggattgaataaaaagtaatgctga

SEQ ID NO: 73298 - DNA, 400 bp, Triticum aestivum
  Clone ID: PAT_TA_73298
gtgctgcgtcgccgtcaagaagctcttcggcagcgacccggagtgcatctgcaacggaatcgctgaggctcagaaggtcgcaaagcagtctgggctcaactacaccgtcgacggccaggagatgttccgccggtgcgagatgcctctcaccagctgcgaccccgccggcaaaccaggatcacaaagcattggaaatggagcccctactacgaggtcctttggtgtcttccagatcctacttgtcttcccattattcttcatgatgtaaactttgcttattttttggacttcgtttccctcattattttaaatatttgtaatctcatttattttatatgtttgactcatggtgcaatcaataaaaatcggcgagtgtttttctctttaaaaaaaaaaaaaa

SEQ ID NO: 73299 - DNA, 585 bp, Triticum aestivum
  Clone ID: PAT_TA_73299
cggcacgaggccccagcaagcaagcaagagcgcgtcagaaaccaccaaggagccggtcagttctgttcccaagaagcaaaaggacctccacaaccccgactgctgctgctgtcgtccgtgaccatggacaagatcctggccttctccatcctgagctcatcgccggcggacatctccgcggccgggttcttctccacgcggctatcgtggcggacctccgccgccgggaagcctcagacgcctcaggtggacccggcaccgcaaaatcagaaggccgccgagcagcagcggggctcgccgcgggtcccggcggcggagcgcgagcgagaggcgcggccgcggttcgcgccggagttcgacgggctcaactgcttcgagtccatcgtctccttctgaattccggggggctccgcgtgacatggttcccctccccgcttgaattcgttcgttcctctcttctaattaattttgggatgtttgctgactaaagcgacgagtaatctgtacagagctgctgtataccgcgtcctattgaatggatcatcatacgttcgtttgaaaaaaaaaaaaaaaaaaaaaaaaaaa

SEQ ID NO: 73300 - DNA, 400 bp, Triticum aestivum
  Clone ID: PAT_TA_73300
tgcatcgaggtctttgggcgattcctcccgaacatggcaatggagcgccgccgtcgttgcctctccatcgcgggaccatccagtcattgttggtcactgacaagaagttctcaaggccacgattcagtcggaccagcgccctggagaagaaatagttgaactcgttgtttccaaaagacacacatataacatatccatggtctcaaccttaaaaaatgatgggcatatctgacgaacgttcgccacaagacatgacatttgtgaacgtcatcagacggtttacatagcatttcgagaaccggtggcctttttgtaaaacggccatggcctttgtttaattttaagtgtatacaagtcatccaaactgcaccgtaaaaaaaaaaaaaaaaaaaaaaaaaaa

SEQ ID NO: 73301 - DNA, 540 bp, Triticum aestivum
  Clone ID: PAT_TA_73301
ttcggcacgaggattcgagcgctacatgcacgtagaccctatggtgctacggtgcttaattatcagaagctttctctggagtgcacgtttgtgtgtgttgctgtgccttacttcatgctgcttgattggtctgtgtggtggtgtgaaatctgcatctgcattgccatggtgtggtggtgcgtcttccatttcagtttgatttgatttggtttggtttgtttagtttgctcacctttgctcgatgaaagccatataaacgtcaaagtaagtatgcatcatcgagttggatagatgatgcatgcatggtacaagctttgaccagaaataaataagagagggcattcatcctgagctgcatgaacgacctgcctgctcatgctgttgctatgctgctgctctccatttgtttgttgtggtgtgtgatttgatcatctacagactgattattgtaatgctataagcaattcctccgacttgtataccaatggtgattcgagtgtgtcatcgcaccaataacaaatatcctttctttgaagatat

SEQ ID NO: 73302 - DNA, 286 bp, Triticum aestivum
  Clone ID: PAT_TA_73302
attcggcacgaggcttgttgctgctacttaagcagttaaagcattaattattttgttatgtttttgctggccttgcacaaggctagctaattaaggtttattagtactactagcttaagcagttaagcagtaagtaattagtagtggtagtattagcttgcttctttaactagctagaaggagttaagctaggtagtagatgtgaaatgaaaacaagggacgatgatgtaaatatttttttttgggataaaaaacgatgcagaagtttaaaaaaaaaaaaaaaaaa

SEQ ID NO: 73303 - DNA, 573 bp, Triticum aestivum
  Clone ID: PAT_TA_73303
cggcacgaggtcgatatcgccttgcacgccacacacagcctccgactccaacgccctccggattgcaagtcgctaccgcccaccgcctctactcgtgtctgctgcacgtcattggtcgagtttgaaagggcaagaacccctcgacagcagctctacatcacaacaaccgatcgaccccccacctacatcgatcccgccgccccgcaaccatggataccaatatggaggacgtcaagatgccagagcctatgcagctgtcgtctgcccccacgactgagccgaccacaatccccacgctggacggctggattgagagtctgatgagctgcaagcagctggccgagagcgacgtgcagagactatgcgacaaggcccgcgaggtacttcaggacgagtccaatgtacagccagtgaaatgccccgtcactgtctgcggtgatatacacggccagtttcacgacttgatggagttgttcaagatcggtggccccaacccggacaccaactacctcttcatgggcgactatgtcgacagaggctacttctccgttgagaccgtcaccctcttagtcg

SEQ ID NO: 73304 - DNA, 594 bp, Triticum aestivum
  Clone ID: PAT_TA_73304
tttttttttttttttttcacagaacaaaccatactgcaaaaataagcaagatcaccccaaggattcaacatacaaattgcaagaatcagtaagatcaagcagctaactacgacaacagccatcattcgcaccatgggcatttaattactgaaataatgctagatttttaactgcagttcagcctaccaacgagtgcaacacaaaatctaaaataatccacaacacaacataacatgtttacaactaacaaaaaacagtccgtcgggcctagcactacactccagcatcccacatttgctaacctcatctccattgccttagtgcaggtgtttctcctatggccctcaaccccacaattcttacacctcgcagacttccgaggttgctccctggacatcacccatgtccaaacatgttgttcttttatgcaattcatcgtccgattcttgtcaatgagtattgtcttcggcgccacgcctctcatcatctgtagaaaatctgaaaagacacactcaaaactttcctcagtctcgtcgcataccagtacaccagccagtataatactctgaaaattgttgttaaccccaacaaaaa

SEQ ID NO: 73305 - DNA, 626 bp, Triticum aestivum
  Clone ID: PAT_TA_73305
cggcacgagggcgcacgtcaccggcgacttccgcaagctgttggtgcctcttgtaagtgcataccgctatgatggcccagaggtgaacacgtctttgtcccattctgaagccaaaattcttcatgagaagatccataaaaaggcttacagtgacgaggagatcatcaggattctcaccacacggagcaaagctcagctacttgcaacattcaataactacaaggatcagttcggtcatgcaatcaacaaggatctgaaagctgaccccaaggatgagttcctttcaacactgcgagcgatcatccggtgcttcacctgccctgacagatacttcgagaaagtcattcgactggctcttggaggcgtgggcacagatgaggatgctctcaccagggtcataactactcgcgccgaggtcgacctgaagctaataggggaagcttaccagaagaggaacagtgtgccgctggaccgtgctgttgctaaagatacaactagagattatgaggatattctccttgccctcctaggggcggagtgaggaggcgtgcctcaactccatcccatctgctcctccttgtttgatgggaacaaaaaactgcatcgatgtggtatacacgtggttg

SEQ ID NO: 73306 - DNA, 547 bp, Triticum aestivum
  unsure (1)..(547): unsure at all n locations
  Clone ID: PAT_TA_73306
gaacgatatttgtcaaatacaaacgaaagtgctacagtgtttattttgcaaaatttttntggaactaaacaaggcctagctgccatgcaccttattttttggttggtgcacctgggttatacacttatactgtactctaccactaacttgaggctgtaagctatctatagagagaattagctttaggtatactgctacttgtactgttgctgtatatgctggattcagatgctgtgcttgatacgttcgagtaacaaagtgaaggtctcccatgttatcattcaccagacctaccgactcagatatttgtacctgtacggttgttgctgctgagagaatatgaacttgatcaagatcaatgctacaacagaagcagcaccttgagcagacatgccttaggttttggccctaccctggccttatcagagaatgctttgcgaaaactttttgagctacagtagcactttcatttgtatatgacaattattgtttaattatgattcgtctcgtaaattataagtaaattatgtaattatttttttaatct

SEQ ID NO: 73307 - DNA, 362 bp, Triticum aestivum
  Clone ID: PAT_TA_73307
gaggcttgtccttagggcatttgttgttgctatatcaaaaatctgggcaaaatgaacaatgcagaaaggcttccttacatggaactgaagattgggtgaatccttcctactggaaaatgagaaaccggtccatgaagttccatttctcccatgcgaatatagatatgctactttcgtgctgcagtttaggttattttttggagacatagcgctgctatagttttgtagtcacttcccactgtaggtgtaatgtttagttatctttgtctggtgtgaactatctgctacaatggatgtcatgtgtctttttggtaaaaaaggagcaggatctctttttatcttcaaaaaaaaaaaaaaaaaaa

SEQ ID NO: 73308 - DNA, 705 bp, Triticum aestivum
  unsure (1)..(705): unsure at all n locations
  Clone ID: PAT_TA_73308
gaggtggaaacaggacatgcccacagactcagcaagtcctnctctaatacaattctcatcccaaatcaccttgttagaagcatgattgcacagtggtgtacagagaatggaattgctctttcgccacttgagaatcaagaggaagatttagttaccaacaatgagcggaagtcattcagtgaattatttgacaggatctcatcctcgtcaaacatatctgagaagaggcaagctattaaagatcttcgactgctaactaagcgcaatagctcattccgagcagtcattggagagaatccagattccatctcacaaatgatttctgctgtctccaatccagaactggaaagcaattctgaagttctagaggacacagtgacaacaattctaaatctttcaattcatgagagcaacaagaaaatcattggagatgacacaaaggcaatcacattcctcataagtgccttacagtcaggaaccatggaggcccgcagcaatgctgcagctgccatcttcagtttgtctgcccttgatagcaataaggcgaagattggtgagtcaggtgcaatgaggcctctggttgatcttcttgaacacgggagcatgacagcgaagaaagatgcagcatcagctatttttagtctttgcaagttgcatgagaataaatcaagagccacaaaaagcggagttattgacgtggtgctg

SEQ ID NO: 73309 - DNA, 434 bp, Triticum aestivum
  Clone ID: PAT_TA_73309
caggaaagagaatcggtgtgcttccgatccaatatatgctctgaacagtgaaacatgggcaccatattcagatcaggaaagaggaagaaatcagtgtggtcttgctgatctctccaggtcggcaagagccaactgtcatttttgcaccatgagaacctgacaaccggtacctgttgtgcatattgtccattaccttgttgtgaccgtgcttgtcttgggaacttgagctgcctgctcgcacactgaaaaggctttagacactagatccagaaatatcccatttttcctggtgcgtgccgaacctggtgcatgcttttgcgatgttgagtgtataattgaggggactgctgttgctgttgtacaaaatttgtatttctgttgcaataataaggcctttctacatgcacctaaaaaaaaaaaaaaaaaaaaaaaaa

SEQ ID NO: 73310 - DNA, 479 bp, Triticum aestivum
  Clone ID: PAT_TA_73310
gaggctcgccctcctcctctgcctcctcgcctgcggcgcagcaggcgccgccgccaccgcgcgcccgtgcgcgtcgccttattccggcagcagcgcctacccgttctgcgacgcgtcgctctccatcccggcccgcgcgcgcgcgctcgtctcgctgctcaccctggacgagaagatcgcgcagctgtccaacacggcgggcggggtcccgcgcctgggcatcccgccctaccagtggtggtccgagtcgctccacggcctcgccgacaacgggcccggggtcaacttctcctcgggccccgtccgcgccgccaccacgttcccgcaggtcatcctgtccaccgccgccttcaaccgctcgctgtggcgcgccgtcgccgaggccgttgcgacggaggcgctcggcatgcacaacgccggccaggccggcctcacgtactgggcgcccaacatcaacatcttccgtgacccgaggtggg

SEQ ID NO: 73311 - DNA, 532 bp, Triticum aestivum
  Clone ID: PAT_TA_73311
tgaagaatcagtattataactttagctaggttaaatgatagtggtgatcgggacttgacttctagatgctggattagttccaacaattaagtgcaactgcaagagggtatcatgttggcagtctgacatggtaagttttgtgtagtgtctcaggaagtaactagctgtttggtgtctttggtctgtgtcatatttttgggtcattataatccaggtggtcttactggctatcagggtttggctacaaaaaatgagcataaactgcatgaaatggttagtaaatctggtcaaggtggctaaaatctggtagcgcaaactttggttctcaaggtttgaagccaaacagccacagtaaccgcaaacagttgaaagtgtctttcattttgttttatcttaactttggctctcaaggtttggaaccaaacagccacagtaaccacaaacagttgaaagtccctttcattttgttttgttttttaaaagaatgtaaacccgcagataatgagaaaaatctgctagaattactctgggt

SEQ ID NO: 73312 - DNA, 606 bp, Triticum aestivum
  Clone ID: PAT_TA_73312
ctgttcaagacaacagcatatactggaccaatcaatttcactaatggtggtgatatagctgtctcttccgttgttcaagttgtcggtcttgtcctttgtttgcatgcagctgctaaaatttctcacagagctcaaaacattgcttcactggctagtcgatggcatgccttagtaacatgctctagtgattctacttatgtaagcacaccaaacagttctgggaaccttgtgccttttccagcacatatgttcttgagagacttttcagaaagtgatttggaatctctggagagtggctcagtacaaggcaattctcatggcacagctcaattggcttcatacatgtcttcataccacaagagggaatcacttgtgctgtatcttctgggcaacccaggtggcatcacgatatttggctggatcgttgatcggacattcctaaatacaattctgatgctcgaattaacacttgtgctcttcgtgcttagcaagaccgttgtggttccggccaaaacattagttcttgattacatcaggtttccatgatgggggctatcacatctcaaacatctgaatttggtccggatcgctagatatggtgaattg

SEQ ID NO: 73313 - DNA, 716 bp, Triticum aestivum
  unsure (1)..(716): unsure at all n locations
  Clone ID: PAT_TA_73313
tcggcacgaggcgcagacctgtctccgcaccactcagccagcacacagctagctgtcctttttctgttcatttttcacaaagtacttttacgacctttttcaccacgatggctgaaaccaaagcgccgaaagacccgtacggtttcttgaaggatttcatggccggtggtatctccgctgccgtgtcgaagaccgccgttgctccgattgagcgcgtcaagcttatcctgcaagtgcaggccgcttccacgcagatcgccgctgacaaacaatacaaaggaatcgtggattgtttagtgagaatcccaaaagaacaaggctttgccagtttctggagaggtaatttcgccaatgtcatcagatacttcccaacacaagcattaaactttgctttcaaggatgtctacaaacaattgtttatggacggtgtggacaaaaagactcagttctggcgatactttgctggtaacttggcatccggtggtgctgctggagcaacatctttgtgctttgtatacccactcgattatgctcgtacaagattangagctgatgtcggtaaaggaccagctgaaaggcaatttaaaggtcttggtgattgtatagctaaaactgtcaaatctgatggccctattggtttgtaccgtggtttcattgtgtctgtccaaagtatcatcatctaccgtgctgcatactttggattcttcgacactgct

SEQ ID NO: 73314 - DNA, 470 bp, Triticum aestivum
  Clone ID: PAT_TA_73314
gactgccgcggctcggccgctgaggaccccataaggagagtcatgttcttggctccctggggtcacacataaaacacaaaccgagatctgggtttgcaacagcatggccgcttgagtggccgtgtcttggtcagatctgcaaggaactgaaccataaaagaaccggagcttgtcttgtaaattaacatgaacatgaactaggtacatatggatatatgggtatgatgatgtgaaaaaacaaggtacgtagtccatgtctgatgttggagaggttgagtccttgggaagttcatgcatggcatgggtcatgggtgtgggttcaagagggaggagatctcaaacttttgtagccatgaacttgttttccagaaatcttgtcataaggggaacctgtgaatagctataagaaaataaaaatcttcctgctttgcgtgtccacttttgcttcttccaaaaaaaaaaaaaaaaaa

SEQ ID NO: 73315 - DNA, 242 bp, Triticum aestivum
  Clone ID: PAT_TA_73315
gttaacttgccggacctctctagatccatcctgatcctggtggctttgtgggtgaagaaagaaagaagatgctggacaagctgtgggacgacgtggtggcggggcctcacccggagacgggcctcgagaagctccgcaaggccgccactgcccgccccatcctcatcgacaaagacgcggatgccggagccgcggggagctacaagcggacgcagtcgatgccgtcgaccccgacgacgccg

SEQ ID NO: 73316 - DNA, 615 bp, Triticum aestivum
  Clone ID: PAT_TA_73316
ttcggcacgagggcagcgtcctcgcatatggctgttctcagcgatccggtggtcggggcggccccgcgccatgatctccagtgcccccacggaggcatagcttcccgcgcccctgtgcgtccccggctgccgagacaacgagccagcggccacggtggtgctctgctcggccgcgtaggggcaggtccatccgtgcagtgtcgaccttatccttggtccttcgcccttcctactcaacaacaagatccggcgaagtggagccttgcttcttactcagatccggcgaagtggagcactgtcgcccacgtccgactaaggcgctctgctccgccagcgcccatccactggcgagctcaatctagaatttgtattgattttgtttcaaaatagttgatttgaagagtcatggtcttatggagctagcaatgaatttattaatttgatttgaggaggaaaggtagtctgatttagattcctattttgtctgggattcgatacgtgagcgagttgaagtggcggacagaacaaagcggatagaaaaattggcagactgaaattttcacaatttattattaggtatagatatagatatagatatagatatagatatagata

SEQ ID NO: 73317 - DNA, 374 bp, Triticum aestivum
  Clone ID: PAT_TA_73317
ttcggcacgaggcaccacgcttgcgcaccaccacgggcacgcacgcgtccacgggctcggtggcggcggcggcggcggcggcgcgccggtggacatcgtagagacccccggcgagtacacgttcgtgctcgacgtgcctggcctctccaagtccgacatccaggtgacgctggaggaggaccgtgtgctggtgatgaagggcggcagcgggaagcggaagcgcgaggaggaggaggaaggggagggggaagggtgccggtacatccggctggagcgcggcgcgacgccgcggtcgttcgtgcgcaagttccggctgcctgaggacgcggacacgggctgcgtcgcggcgcgctgcgagaacggcgtgctcaccg

SEQ ID NO: 73318 - DNA, 213 bp, Triticum aestivum
  Clone ID: PAT_TA_73318
gagggggacaagcatgccctaagcccctctattttgcagttcatatgatataagcctgagtttttgctttaacgactgttgtctccgatttgttacttgccaccaaaataaaacagtagaatgttattgggttgtggtcccctggcatgtaaactttgattcagcttgactacaaagctttctgacagcaaaaaaaaaaaaaaaaaaaaaaaa

SEQ ID NO: 73319 - DNA, 690 bp, Triticum aestivum
  Clone ID: PAT_TA_73319
attcggcacgaggaacttatttcccagtgcatttgctctttctggcaatcgtgacaccagctaacctatcatgtggtgttcttgtcgctagtttattgtagggtaaaattgttaatttataagcttatgctacttttgatttgatttagcgtaggggaatcttctgattttggggagtataaaccaaaaaaagttcattgtttgatgattttcattatatgacacaaaaatatatttcctttgataaaagatctaggggagctctattttttttttacatcagatagaatagctatttttcttttccactttttttctgtttcagaccatgttgttctagttactaacttactattgctataatcctttttttccttgctgattagctgaatgcattagcgtcactatccatttgaataataggatactaataatgcagggctcaaaagttatggctaatctacttttcttttgttttgggtgaccgaaacaaagtttggtgaacacttcacatggcatgtgagccagattaggtcttagcatgcttgggcagcactagaagcaccttcagccttgtttttttttttttaaaatcttgattgatctagttgtttggtggctacagccagacaatttggcaatatgtatgtccctatggtagtggactagtggtggtgctgtggtgggctg

SEQ ID NO: 73320 - DNA, 700 bp, Triticum aestivum
  Clone ID: PAT_TA_73320
cggcacgagcctttgaaatgcaggtccaggggctcctgcagttttcaactgtgtaagtttatctttcgaatagtttagctttaaatatagtcgatgttctgattacattgattaatatcagatttgagttttaccttcatgcttgcatttattttcaaattttgccatagggactgaaattaacctacctggttctgaagtcttgaaatcttccttttgaaacttccagacttgtattgattccataataaatagggccaggtttattgaaactttttgggccattctagagtttgcagttcctgctaccagtttggctttcacgtgatatatactagctcaggcatgtctcaagttatcatactaagccatagttgtatgcatcaatcttactcaaagattgtgtagaccagctaagacaagatgttctattctggatttccattttattttcctgtctttatctgctgtgttattaagttctgtgcagttacacagacttgttttttcttttctttcatttccaggtggttgagattcctagaggcagcaaggttaagtatgagttggacaaagcaactggtcttatcaaggttgatcgtgttctttactcctcagttgtgtacccacacaactatggcttcattccgcgcacgctctgtgaggataatgacccaatggacgtccttgtcctgatgca

SEQ ID NO: 73321 - DNA, 388 bp, Triticum aestivum
  Clone ID: PAT_TA_73321
agctctggtgtggctgtggagctgtttgacacggtggatgcctctgtatcagacagctccacagatacagctctggtgtggctggcggccataacgagtgtgatggtgctggtgtcatccaacctcggtggctcaggttatttcaatccgtgaccgtgagtgaaggcagaggtagcatttgcatttgcattggggcgcagaggaagctacctggcctggctgctgtgactgaagctggtttgcttgcttggttgtaaagggtgacaacaagagagtttttgttcctgttcttgtttctttttggaaaggcaagagagtacttgattcgtttttgttgtcaccttcttccagcaagtgaggagagccaattgtatatgtatattcattc

SEQ ID NO: 73322 - DNA, 376 bp, Triticum aestivum
  Clone ID: PAT_TA_73322
gttattaatgatgatggacattttcatggagaattagctagtgctggacaaaatggttgtcgttgattttacagcaacttggtgtggtccatgtcaacgtatagctccagtatttgaacaattatcaacaaaatatcctaatgctatttttttgaaagttgatgttgacaaatgtggtgatacagcagctggacaaaatgtcagttcaatgccaacatttatattttatcgtaatcgtacgaaacttggtctttgtcaaggagcaaatccacaaaatcttgaagctaaaataattgaatattatggaggtggtgaatgtgatgatagcaccgagggaccagttgctggacatatggatttaacgacatttatcatg

SEQ ID NO: 73323 - DNA, 338 bp, Triticum aestivum
  Clone ID: PAT_TA_73323
ctgaaattcctaatggatgtcgtgctgctgattcatcaaagtgtgttgtactagatattgaggggacaaccactccaatatcattcgtgactgatgttatgttcccttatgcccgtgataatgtacgagaacatctgacttctacgtttgattctgaggaaactaaagacgacatcaaactattgcgcatccaaattgaagatgatttacgaaatgggatttctggggctgttccagttccacccgatgaggctggcaaagaagaggttatcaattcattggttgccaatgttgaatcgatgattaaagcagaccggaagatcacaccattgaaacaa

SEQ ID NO: 73324 - DNA, 328 bp, Triticum aestivum
  Clone ID: PAT_TA_73324
tccctggccgccaaaagacatccgcagcaggaagtggggttttaccaagttcacccgtgctgagtatctgaagtacaagagcgagggtaggattgcacctgatggtgtcaatgctaagctgctcggtgttcatggtcccctctctaagcgtgccccggggaaggcattccttgcagagaacattcaagcgtctgcgtagacttatccttctgccaattggaactccagatattcaggatattctgcttagtctaattttctatgctagaactttgttaatggctattgcttgcagcatgatctacttgtgtagcccagtttcatatgg

SEQ ID NO: 73325 - DNA, 347 bp, Triticum aestivum
  Clone ID: PAT_TA_73325
gcttccgggtcgccgcgctgcgggggttccgccgagtcttcgcccacgctgcccccatcttcttcgagcgcggcatcgccatcgaggccaccaaggaattctcaagcttgagtgtggagccatgcgatggtgaactgataatagtcacggtattcgaaatcaaggaggaagaggtgccagcatttattgagagggaacatgagtttaggtttcttgcggttgtccctgaaggtttggatggggtaccttttacaaatcgagcagttgtctgcgcgcgctacagcgatgaagaatatttccaagggagatgccaaggaagcaaggaaatattttatcagcgctatgga

SEQ ID NO: 73326 - DNA, 320 bp, Triticum aestivum
  Clone ID: PAT_TA_73326
tggttgctttgcgtgctgccctagttggtggggtagcagcatttgcgaagattggtgcggcgatgaaagctgcaggaggtgcgaaggttggtgcagcggctgcagcaatgacagctgcagcaacagctgctgtatctagcaaagacacaaacaaagataatccgaagactgaaacaaaatgatatgtgccttacttagtggagaaaccctgtatggaaatgcctctccagagcttaatatttttttttcctgaattgcacttccaccatcgctgaagagttgtataagctaattgcgacatctgaaatgatgtcataata

SEQ ID NO: 73327 - DNA, 357 bp, Triticum aestivum
  Clone ID: PAT_TA_73327
tttttttttttttttttttcatctgacatgttaatgcttggagtgcaggtccttctttaaatccattgacatctgggccatatggcctcatatttgcgtcttacataccattcttctttgacattccaatcacaacaaagtttcgcatatttgggttgcgcttaagtgacaagtcattcatatatttgtcaggactccagctacttttctcatctggatggcgttcaattatacctggactttctggtatactggctgggcttttgtatcgtctgaatatatttggcatccgcaggttgaagctcccagattcgatgacatcactgctctcgcggttttcatgccccttcttgaaca

SEQ ID NO: 73328 - DNA, 344 bp, Triticum aestivum
  Clone ID: PAT_TA_73328
gcgcctgtacatactcagatgccagcagataggcggggggttgtgtatgtgttaatttttgttgagcgtcaaaggggatagcagcgtccattgtactaggtattcatttgctgtagattttttgtttgtctctcatgttgcaatgtatggagtgggaaaatgggtttacttatgtcgggtcttgtataatagtgttgtcgcctgtttatgttagcagtgagttagctgtcagcacaccttacacctccctcctgttgtaattctcgtcactagtgctgagaatgtgtacaatatattgttgtctgttgtccaaagttttgggttatggacgggtttggtgattt

SEQ ID NO: 73329 - DNA, 301 bp, Triticum aestivum
  Clone ID: PAT_TA_73329
tgaggagaagcgcagctggatctgagtgggactacaacctttggggatacctctgttgacggtgatgactcttatccaatttggctctagctggccctagcatctctcctcttgggcagcggctcctaggaggcaccataagtgggggaatcgaaaaggtagtaaaaagctggatggcatatatctctgttgatggctaacaatgaaccagcacctactactagctactctcaggtcatcacttcatgttttcattgccactacattgtatattatgtttgagttgaaggctataattttc

SEQ ID NO: 73330 - DNA, 380 bp, Triticum aestivum
  Clone ID: PAT_TA_73330
cgattgttcgcccgccagctgtctatgcaaatgcaactacaaatggtgacagttttcctttcgtcactgatgctgctggaactggatatcctgaaaggtaccaggaggatgctggcgttggtacaagtggccttggtttattgaacaacaatactggtgattttgaaataaataactggcaaatgcattcttatccacaaccggagcaagggttccagttttttgggactgatactgatgttggcaatccttttgttggtccacataattccttcaatattgcaccagaagactactcgcttgactgtaatgttggcatagaggatccctctgcagctcacgatgtttcaatttgccgaaacagtaatgatgtgcatgga

SEQ ID NO: 73331 - DNA, 408 bp, Triticum aestivum
  Clone ID: PAT_TA_73331
caaacatgcgagaataataatctgacactttagattgtgaaattcatgctcctctttatggcatttttcatttctccatgaggaaagcatgttgaaagcatacactcttgagatgttgaacacgtattcaacgctcttccctgcctgaattagtgaattcgtgtgcagatccgttccaacccgtacatgtacaaaggaaacctcgcactgcaaacaggccgcgaactcctctccgtcggcctagacaccgagaagaacctgcacgaggtctcgttgccgttcttggtcctgcacggcactgacgacgtcgtcgctgatccttgtgggagcaagctgctgcacgagagggcgtcgagcagggacaagacactgaagctgtatcccgggatgtggcacgtgctcatgggc

SEQ ID NO: 73332 - DNA, 371 bp, Triticum aestivum
  Clone ID: PAT_TA_73332
cttgccgccgcggtccaggcaccaggaggccaactacagctctggtatctggaatgtggccgtgctctgcgcctccgccgccgttgacgacgcctgtgatcacctcgattgccacagcggacccttcctggttgtctttctggctaggggcaggtctgggatgtgtacccaagtctactcatccgaggctgctgcgtggagccatcggatctatgctcctcgcctctcagagcatatacaatgggtgccaagcgcgcttgcagggaattcgatgtacttcttgtgtagcaaaagtgttctcaagtttgatctgaccacacgagaaatgtctctgattgacctgccacaagaaacctttagtagcgctatgc

SEQ ID NO: 73333 - DNA, 260 bp, Triticum aestivum
  Clone ID: PAT_TA_73333
cattgttagctgctggaaaccaccttgtgtagatctggttctttgtgaatgtattagctttgttttagttgacataatatagtcaaattgctctctacggagagctgaaattatgtaaatcatcatcgtataactcatagatgaaatgcatccctttttatccatcttccttttttgtccagggttggtgcaagttgtactatgatcaactatattgtatatatcattgtttcaagctgcgcaaaaaaaaaaaaaaaaaa

SEQ ID NO: 73334 - DNA, 214 bp, Triticum aestivum
  Clone ID: PAT_TA_73334
cttcccagcattgataacttcattcttgaaggcattccatgtaatggatagggatctcaaattacataagaatattgactgctttttcagtgggactacatcggtggcagcgatcaagcaggggcgcaatcttataattggcaatttgggggattcaagggctgtcttaggcaccagagatgaaaataacgagcttgttgcagttcaattgaca

SEQ ID NO: 73335 - DNA, 347 bp, Triticum aestivum
  Clone ID: PAT_TA_73335
tcttcatgacccattatgtattgctcctttgttcgttcaaggaacaactacagcaacatgtgcgtgttcatgcaatggaagcagtaatggcttgctgggaacttgaacaaactttacagagccttacaggggcatctcctggtgaaggttctggagcaactatgtctgatgacgaagacaatcaggttgatagtgagagcaacatgtttgatggaaatgatggatcagatggtatgggctttggccccttaatgctgacggagggcgagagatcattagttgagcgcgtacggcaagagctgaaacatgagcttaaacaggggtacagagaaaagcttgtggacatt

SEQ ID NO: 73336 - DNA, 366 bp, Triticum aestivum
  unsure (1)..(366): unsure at all n locations
  Clone ID: PAT_TA_73336
gttttaggagacctccgccgcccctccggcctcgcgagctcgccgaaatggtcgcccacaggttccatcagtaccaggtggtgggtcgcgcgctgccgaccccgaccgatgagcaccccaagatctaccggatgaagctctgggccaccaacgaggttcgcgccaagtcaaagttctggtacttccttangaagctcaagaaggtgaagaagagcaatggccagatgctcgctatcaacgagatctttgagcgcaacccaaccactatcaagaactatggcatctggctgcgttaccagagcaggaccggttaccacaacatgtacaaggagtaccgtgacaccaccctgaacggtgccgtggagc

SEQ ID NO: 73337 - DNA, 348 bp, Triticum aestivum
  Clone ID: PAT_TA_73337
tttttttttttttttttgcaggtgaagcaaagcaaagccaaatggttcattcattcggtaggagaaaggagatgagatctcatctcatacagagttcattcagagtacagacataagacatgcagcagcttatggcccggcccttctcctgactctgtcactccccttgctcgaaaacgggctgacaaatgttggaacactagccatacagatacagtgactgacagtctgacgaaaacaccactccactcggaagtccgcgatgcatcgctatcgcacccggtctcttttatttggggatcgccgcagccagcagaattattattaggtaggagtagcagctagtag

SEQ ID NO: 73338 - DNA, 283 bp, Triticum aestivum
  Clone ID: PAT_TA_73338
caatccagcaggcggaggaggcaccgccggtcagaaagcagtgggtccgatgaggatgagctacatgaccatcggggagcaaagcgatctgggcagaagaacagggaccgcaagaggagctaaagaggagcattgaattggtaatcctattcgatgatgttattgagttcctctatttatcagctggtcggttgccttgtaagtttgaaatatttgaagcatgatgcttaatgtttgtaacaatgtaacatgttggtgtatattctgtatgtctgtctgaaaa

SEQ ID NO: 73339 - DNA, 359 bp, Triticum aestivum
  Clone ID: PAT_TA_73339
aactgaaggacaaagcattaaagcgagcagggctgactgaagaaaatttgcaagagcagattgagcagagaaatgtcgcaaggaagaataagcagtttgaggtatctgatggaatcaggaaaaaccttgctaccaagggcatcgccctaatggacgaaccttctggtacagtgtggagaccatgcgaaccagagcggtctgaataatcatgattatatgctcattaactcaacgagtgatggtgtaaaatgagatttttgcctcagggcagctatcacattttgaggactaacaaaaatcgccatctctggatgtggtattctgcagtgtagggggtccaggttgactcaccagttgaa

SEQ ID NO: 73340 - DNA, 339 bp, Triticum aestivum
  Clone ID: PAT_TA_73340
accctcctacctccaccgccgccgacgccgccgcctcacgtgacgcaaagcttcgcaccaaacagcagctacccgccgccgcctccttcgtcgcagtacatcgccggctacccgccggcaccaccgagcaacttctacccgccaccgccggcaggctacccggcgcccagtttcccctctccgacgagcacctacccgccaccgccggcgccggagtcagcctcatcgcagtatccaccaccactgccaagatcggcgccatgctgcgatcgctcggtggaccgtgcgctgccgtcgtacatgtcgacgcgtccgccgccgtccggcgcgccgtgctac

SEQ ID NO: 73341 - DNA, 351 bp, Triticum aestivum
  Clone ID: PAT_TA_73341
gaactgaaatgttggcctgcagatgggctcttgccacttgccagcactttattgcggcaagcagcaatcaccaatcaatcaaaaggcagctaagtaaattaaagacactaataatttggtcgtattcccatagtctaatattggtaatattgcctctccctatatttgcattgtacatgattgagcaagcatatcagaattcaagaatagcaccacttaacggaatcaaagaaatcaaaaatccaaattcatatgtatatacatattccatattcacctccaaagattggtcatattgtttctctcataaaagaaaatcaacccaaaagcgctagaccacgtttggatgct

SEQ ID NO: 73342 - DNA, 331 bp, Triticum aestivum
  Clone ID: PAT_TA_73342
catccatccccgatgcctgcgcctccttcctgctcggatccagcgaattccgagccaagccgccgctcttcttctagcggaccttcgccggagtcgcgccatgttcccctacgtcaagcctcgaccttgagctcttccccaacgccgttcctggcctccacctctcgtcgccgccgaggacgtgcgcagccgcctccttcaattcgtcgcgccgccacctagttcgccggatccgctgcctgtcggccccttctccgcctggagcttcgtctcctgcacccgcgcccatatccggtcatccccgccgccaaactccgcgtccctgcagtcc

SEQ ID NO: 73343 - DNA, 373 bp, Triticum aestivum
  Clone ID: PAT_TA_73343
tgctgccgtccccctcccgctgcgtgcgagaggcgcgccaccacaacggcgcctgagttcgcctttcccgtccgcggcacctccgctcctcccacggtttctggaggacaattctttgttgtttagcgttcctcaaaagtaaaaagggtaaatgggatcagaaggaccttcagttgtcactgtccatgttactggatttaagaagttccatggggttgctgagaacccaactgagaaaattgtgaccaatcttaattctttcttggaaaagcgagggttgccaaaaaatcttgtccttggaagctgtacagttctcgaaacagcaggacagggggcacttcccacattatataaggttttagagtctgctatt

SEQ ID NO: 73344 - DNA, 224 bp, Triticum aestivum
  Clone ID: PAT_TA_73344
tttttttttttttttttttttttttttttttttagctaagcccttttttttcactctttactggaaatagtatacctctagtccaaagaatcacatgttggtacatcggaagcagcatccgttttccatcattggaaagaactacatttaccctcccatacatgataatttttatgccaccttacattcttgattgaattgacggggaccaagtcacaccaatc

SEQ ID NO: 73345 - DNA, 236 bp, Triticum aestivum
  Clone ID: PAT_TA_73345
agaacccggacgcggaagaatgatcaagcgacatgtctggggcaactacagctacactcaaattgcttctgggatcgacatctctccctgccattcttgcagctttgcactgaatgagagaggcaattaataaagatgtgcatacattttggcacaaatttcagaaagagaaccattgcaaaccatgtaaaaaatttccacatatgtgaattcattcaagtacagatcacggtcgc

SEQ ID NO: 73346 - DNA, 364 bp, Triticum aestivum
  Clone ID: PAT_TA_73346
gattcggacgagggcacctcgccgttgcgccgctcccgatctccggctcccagtcctcgctgctgctgctcccgcgccgcgcgtcgcacgcccccgtctctctctccctccccctccggtcccgcctcatcgcggccgtcgcgaccaaggaggaacccgagctcggcggcggcggatcaggaggcgacgacggtgcgggagggagcggcggcggcggcggaagcgacccgaaggaaggagggcaggaaggggaaggggaggaagagaagatggagcagggcctgtccttgtcgcagaaactcactctcgcctacgccgcgctcgtcggagccggtggtgtaatgggatatatgaagagtggaag

SEQ ID NO: 73347 - DNA, 673 bp, Triticum aestivum
  Clone ID: PAT_TA_73347
attcggacgaggcggaaatcctctgcatggaccaaacaaaaggtattcagcatttgttgaggtaatatccagttttattttacttagatgttatttagtcccttaaataattttttgtgatgcttctctaaaatattttaggtcagcgagaatatatgctttatttgtatttatttcattcatacccatatttccattcggactctatgaagggaccaatcctgaggcttacgtagaggccttgagcttgaatttccttgatgaacctgacaagatcatatcttccctcgaagttgtactggtgaaatgataccatttacacatcttagtacttggcgtctcactcacaggatatttttcaggtgctttgacaggtgttcatatgaaaatgagaagagcatctacctggccctgcacaggctcatgaacattccagaatacataggcaacggcgtgcctgacctcaggggtgcttctggtgtagtgcatctcccggcgaacagcagcctcctggtgccatcgactaccaaggccctagcatccagcgacacctgtcttggcgccccatcttcctcctccacccaccggatcgctgccaccaccgtggccggtggcatgcacaacaaggctgccaacacagcgagcaacgctgtggcggcaatgtttattggca

SEQ ID NO: 73348 - DNA, 445 bp, Triticum aestivum
  Clone ID: PAT_TA_73348
gactggacccagttttactgaagctgctatgggacgcctagcacaaggaactaaagttttagcagaaggaggctatgaaaaaatatttaagcagacctttgaagttcttccagatgagcagctgaaaatatgctatgcgtgttatctctcaacatcggcaggtcctgtcatgggagtcttgtatatttctaccgcgaaaattgctttctgcagtgataatcctctgtcatacaaagctggaaataaaactgaatggagctactacaaggtggtcattcctcttcaccagctaagagcagctaatccttcagtaagcaaagtaaattctgctgagaagtacattcaggtcgtttctgttgaaggccatgagttctggttcatgggttttctaatgtacgacaaggctgcagccagtcttcaagaagccttggctactgctcgtgag

SEQ ID NO: 73349 - DNA, 365 bp, Triticum aestivum
  Clone ID: PAT_TA_73349
cgaggccgcaacgacttccgcttccgcttccttggataaccacaccacctgccccgaccgccctcagccatggagaaggcgatcgatcggcagcgggtcctcctggcgcacctcctcccctccgcctccgcctccgcctcctccgcgcagcctcagcttgcggcgtcggcgtgcgcggccggggacagcgccgcctaccagaggacctcctccttcggggacgatgtcgtcgtcgtcgctgcgtaccggacgcccatatgcaaggccaagcgaggaggcttccaggacacctacccagaggacctcctcactgttgttctcaaggctgttctggacaacactagaatcaatccacctgacattgg

SEQ ID NO: 73350 - DNA, 598 bp, Triticum aestivum
  Clone ID: PAT_TA_73350
aaaaaccagcaatcaagacggtcttggaggcttaccttccccagattgtgctcattgtgtttctggctttgctacctactcttcttatgtttctctcaaaacaagaggggatcccttcgcagagccatgcagtcagggcagcatcaggaaaatatttctatttcattgttttcaatgtcttccttggttatacactcggaagcacattgttcaagtctttgacaaccattatcgatcaccctgctgggattgtgactatgcttgccaatagcctgcctggaagtgcaacgttcttcctcacatttgttgcgctgaaattctttgttggctatgggcttgagctctctcgcttggttcccctcatcattttccatctgaaaaggaagtacctatgcaagacggaggaggatgtgaaagcagcatgggctccaggagatctgggatataacaccagggtcccaaatgacatgctcattgcaacagttgttctgtgctactcagtcattgcacctttgattataccattcggtgttgcatactttgcccttgggtggcttatagcaaaaaatcagattctgagagtttatgttccgagcta

SEQ ID NO: 73351 - DNA, 271 bp, Triticum aestivum
  Clone ID: PAT_TA_73351
taactgatgtagagctactgcggaagtacactctcttgcattctcttccattggacaagagcctgaagattgttagggactttctcatttctgctactgcaaaggactgtagcctgatgatcagctttcggccaagagagaatggaagtacagattctgagtatgattcagtgtttcttgaatcagtgaagcgaacctatgagtacaaggcatatttcgctgatctggatgcgaaacctctggttaagatggaacattattttaaactgga

SEQ ID NO: 73352 - DNA, 420 bp, Triticum aestivum
  Clone ID: PAT_TA_73352
ttcggcacgaggctacaacgacatgtcactcaaggacatggacaagaaaggcgttacatttgcttgtatgaacagcattggggagtcaccgagcagccttgccacatttgctctgaagttcaaggacacagccaccagggaggaattcaaggatgccgtggagtttcacaagacaagcaaggcaccggatgtgctgctgaagacgcccgagaactctccaaatgcagcagaagtctgaagctgcactcgggtcacgcttactcgtcctttgtacgtgtcgaggaaggagctgagaaatactttctgttctgttattgcggaattcttaaagaatgtggtgtcatgacaggatgtcctgagttgtgtttgcatacggttccttggtgctgttttttggaacagtgggtagcgtgtccaact

SEQ ID NO: 73353 - DNA, 294 bp, Triticum aestivum
  Clone ID: PAT_TA_73353
attcggacgaggcggatacggaggctggctgctctaccggtggccgcggccggggacgcggggttcgtgcgggagctcctcgggaggcagcccctgctggtgttcggcgagggtgagtacggcgtgaccgacgtcctctacgccgccgccaggagcaggcgcccgtcaggtgttccggatgttgctcaacgcggtgctgtctccggcccgagaagacggagctggtgatttgggaggtgctccttctggtgccactcgtgggggatacatgttcaggcgcgagatgatgaaccg

SEQ ID NO: 73354 - DNA, 391 bp, Triticum aestivum
  Clone ID: PAT_TA_73354
gcgtccccgaggccctgatacaggagatgttccggcacaacccagaggtgtccagggagggcctcggcctgtacatatgccagaagctggtgaaaacgatgagtggcacggtacagtacctacgagaagccgatacctcatcgttcatcatcctgatagagttcccagtcgcccagctcagcagcaagcggtccaagccttcgacgagtaaattctgacactcatgctcctggaactgcagtgagagttcggccgtgtcaaattctcgggtgtagttggtcaactgactgtgcagtctgaaacatcggttggtcagttctggtatcttagcacgtctgtgtaacgcgggtagatttggttgtttgtatttggagagatataaagctagctg

SEQ ID NO: 73355 - DNA, 502 bp, Triticum aestivum
  Clone ID: PAT_TA_73355
gattcggacgagggtggacaggtaccctcccaaggcgtacgtctgatgggccacgtcacgtggctgcatgacacaacaattgtatgatccgattcgagtttcctcacgacgaaggagcaacaagggcgtgtgagggagaaaattatacttgtatgttttattttccacttttcttttctttctttctttctttcttttgtttcgttttcccagtaagtataggttggcgtgagtagacagcgctggcttttggaattcattcagagatatctgtggtgtaaaatgaattccaaaagctagcagagtgccattctttctcctctatttgttgtctagccccttggtcttctttggcgttctctagacgcccgggaagttggaagggacacagacgaacaccagtgtgcagttcacatgactagagagtcatcgaccaagtgtgaattactgattcaagtatagtacatatactctgtcctcggtcaaaaaaaaaaaaaaaaaa

SEQ ID NO: 73356 - DNA, 375 bp, Triticum aestivum
  Clone ID: PAT_TA_73356
tcggacgaggctggagaggatatggcagtggaagttctcgggattgggctgccaagggaccaatgttactgggggtcaaagcagtgatcgccaagagtttcgagaggatccaccgcagcaacctcgtgggaatgggagtgttaccgctgtgcttcaagcctggtgaggatgctgattctctggggctcaccggtcatgagcgctacacgataaggctccctaccaatgtgagtgagatacaaccgggccaagatgtccaagcggtcactgacactgggaagtcatttacctgcaagctccggattgataccctggtggagctggcttactttgatcatggcgggatccttcactacgttctgaggaacctggtga

SEQ ID NO: 73357 - DNA, 599 bp, Triticum aestivum
  Clone ID: PAT_TA_73357
gttttctggaaataaaggcaaagtggttcccattctttgttgatgtttctcattatcatggccttcattgtgcctgattccattaacttcttgccgactttggtgtcctttatgtatgttagctggctttacctaagatacttccaaaggaacccactgactggacttaagggtgatcccagtgatgacttctccttccccagtttattcccagctgccatgagaccagttacagaccctgtggccaacctgtttgataggatgttgtgtgcaaggtctaggccttcggaagtagctctcccaatttcagatcctgccaaggcttcaagaagaagggagcgcggcgagagggttcttgaggaaaggttggcagctgacaatgctggtgacacagaagccacgcctcatggccacggcacagccgaagactgagaactctctcacgaccatcagcgccttttataggagtcatgcctgtcgcccatggctttgctctccagcatcgtagctcaccagatttgtcttgtggagatggagagtcattgagtttacagcgaaccaataatatgttcttaatttctccttgttttcatttatct

SEQ ID NO: 73358 - DNA, 424 bp, Triticum aestivum
  Clone ID: PAT_TA_73358
atgttgatgaaaatttagaaatttcgctcgataatgatttgaatattgaaaaaacagagaaaccggcctcgagtttaactgcaacagaaatggactccagtgtccatgttgtaccctctaccgatgaggtagatgaggccatacaacctcctgacgatgacatgggcatctcatcagctgcttgggtagaagtagagcatcaagaactagaagtcactgattcgggtgaaaatgtagtcgctgaggatgtaacttccccaggaattgcaccattgccatcatcaagcccaagagtgcgtcattcgttgtcacaaatgctgcaagcagatagcaatgaaccagaaattattgagtggggaaatgctgaaaacccacccccgcaatagtttttcataaggattcctccaaaaggattcaagaggct

SEQ ID NO: 73359 - DNA, 244 bp, Triticum aestivum
  Clone ID: PAT_TA_73359
gtggcatcagcggcctcaacgccggcaacgccgccagcatcccctccaagtgcggcgtcagcgtcccctacaccatcagcacctccaccgactgctccagggtgaactaaacctaaacgatgatcgatcgatcgatgatccattccgccgccgccgccgtcgtcgtcgatcggcgccggagcatcgaccatggatgagtatctatctacgcctgatatgatgagatgatgagttgtctactact

SEQ ID NO: 73360 - DNA, 571 bp, Triticum aestivum
  Clone ID: PAT_TA_73360
attcggacgaggaaaatctctcagccttatcctttgaccctctcaacttcagcctctcaaattccccatctgaagtcccaactcccatccaggcaaccagcgacacccaccagatcgatctgccgttttcggcgctctccagtgcttccgaccaccactgaccttcccacacaaccttagtctctcctctttaccagatcgagccgcgtcatggtcaggggcagccggatctggccacccccatcctcgggtggttcgagatggtgtcggcggctcggaataggtcgagcatcaacggctgccaagaacgaccgccagcggcgacggctgcatcgaccggcttgagcaagccgggacttcgaacggcgacagcagcaccaagcgctttgagctgtgacctcagctggttggatctgacaggcccaatgaaatgtcattatatcatgccatttaatgggtgggtcatggaagttatcctatctggcaggttcgactaaagtgtaattcaactgcaacttctcatacaagttttctgctcctggatgaatggaacaataaatcctggcagatg

SEQ ID NO: 73361 - DNA, 287 bp, Triticum aestivum
  Clone ID: PAT_TA_73361
ctgagaaggtcaattacagtctctagttgactgggaaatcccagaagatagttggaagatgtaagctgcatggtcataaaaaatccaagattcatggaacgctccacatcccatgtcaacatacacagaagagaccaaggctatcagatttatcaaaaggtgttccatgaccgcaccattttggcattgtcaatgtacattgtacagagaggtgatgcgggatgagtcgagctggagccttttgtgtccgctgccgagagccccacacagacatgttgctttgagct

SEQ ID NO: 73362 - DNA, 407 bp, Triticum aestivum
  Clone ID: PAT_TA_73362
gattcggacgagggaaactagagctgctgtaagtttgcatctccataagacacaacatagcacggggaagtcttattttggaatgtctcaattggtcttagagatgtgatggtttgcaagatgatttatagctcgagcaggtgtccacttgatctagctcaagaaacaaaggaagtattggtttgttcagaacttgccttgcaaaatgtgtgcacaagaaaatagattcccttgccacggttcttttccagttgcatccaatccaattaatatcatagttactgtagtttgagatttcagagtgggaagaaggggcagatccctttcagagtagtttcagttttcatatatataatctaaatagaaatttgtatggtttgtttagatttaatgggaatatgtttttg

SEQ ID NO: 73363 - DNA, 402 bp, Triticum aestivum
  Clone ID: PAT_TA_73363
gagggtcggcagaaaggcagataaggcctccctcgaaacccatgccatcacgacaaataccttccaacggaatgcgtgatgcccatgcaaagaaaaagcaaccgatgaaacgaagatttaatgatcttagcgaagatgaggaagatccgttggcaatgatcaggagcatgtttaggtatgatcctagtaaatatgcaggcagagatgatgatgatagcgacatggaagcagattttgctactatagaaatggaagagcaaagaagcgcgagaattgcaaaggaggaggatgacgagcaacttcgcctgattgaggagggagaaagacgtgagcaggagaggaagaggcgaaagatggcgcgtggccgatagtagcagctaagttgtaccaatgcttgagtta

SEQ ID NO: 73364 - DNA, 464 bp, Triticum aestivum
  Clone ID: PAT_TA_73364
atcttctggaatgctatatgatggaagctcaggtgacaatgctccatttgatattaatgacttccctcagttaactggacggcctaattcggctggaggtggtcaaggacaatatggatcactgagaaagcatggagtaagtgtcaatgccattgtgcaacaaaatcaggaattcagcattcagaatgaagattttccagctttaccaggaaataaaggtagttcctcagattatcctatggatatccatcacaaggaccaccttcatgagaatgtaaatattatgcaagcacaacattatcctatggctcgaccatctggctttaacttgggaagcagctatccaccccgtcaacatcagcagagtgctaattcagttcaaaatgctgggctggaaactattggactaagaccatcaaattctccaagtccatcgactaatgcgggggtttatgagcaattca

SEQ ID NO: 73365 - DNA, 517 bp, Triticum aestivum
  Clone ID: PAT_TA_73365
ttcggcacgaggccagaattccggggtccgctgtccaagaccaaatccaaatcccaattcccaccaatccccagcggagattttgaaagcaggctcatctcgttccttgcagcaatgattctggtggcggtagtggcggagctgctggaggagtacacggcgctggtggcccgggtgctggagcagctgctcaccgacgcgccgttcccgcgccgcatgcgcttcctctcgctgcggagcctccccttcgtgccgccgcctctgcccccgccgccgccgccgcacgccctccacgtcaccacccggggctgatcgatcgatcgatcggcttcatttcagggcggctttcagctggcccgccatggccacccactaggtagcctgtgcttgaggcagctgatgaacacagattaggttgttgatcaatgatccacggtgtgtttcgttcgtttctcgctttccttttatcagctcttggctacacggatttaatactgtctctgtctctttgaagact

SEQ ID NO: 73366 - DNA, 374 bp, Triticum aestivum
  Clone ID: PAT_TA_73366
ccggcagcggcagcaaccgggagccagagccagaccagcaccccagcaccctccccagtgcgttctggcgctgccggcctctcggcaacaccgcggacgttcctagctgccgcgactctgttcgtgtgccgactcttgtgagctgggctcacgtcacctgtcatgttccaagttcaagcgctccaccttaccttaccttaccccagtctgaccacagataaaaggagcatgtaacaaccctgtaccgagatgtatcttgtgagcatttcagtgtcgttttgcactgcttttgaaccagcatgtactgttcatgaatttcattgcttcgcacaagaaatcaataatgctacaagtcaaaaaaaaaaaaaaaaaaa

SEQ ID NO: 73367 - DNA, 471 bp, Triticum aestivum
  Clone ID: PAT_TA_73367
ttcggcacgaggcgcagatgatcaaggaggcgatcgcggcgctcaaggacaggacggggtcgagctcggtcgccatcgccaagtacatcgaggagaagcacggcaaggccctcccggccaacttcaagaagatgctctccgtccagctccgcgcctccgctgccaagggcaagctcgtcaaggtcaaggcctcctacaagctctccgacgccgccaagaaggacgcgcccaaggccaaggccacggccaagcccgccaaggacgccgccaaggccaagaagacggtggccgcgaagcccaagaagaccgccgccgctggcaccaagcgcaaggcacccgagcagaagaagctggtcgccaaggccaagaagtcgcctgcggccaaggccaaggcgaagccgaagaccgtccgctccccggccgtcaagaaggcccgcaaggtcgccgcggcttgatctgatctgatctgat

SEQ ID NO: 73368 - DNA, 246 bp, Triticum aestivum
  Clone ID: PAT_TA_73368
ccctgccgtggtggggttgtatttctcatccgattggctgacttagttgagtgatcgcttggctgatggtggagttcatatgagattttgtaccgtgtaatggaaaccatggaaggcctgacagcagcataggggcatgctttgatcgcagctgcgttcttgttttgcagacgagctcagcagtgtgtgtgtgcttttataccacctgagtttttattcattgcttccatgattgatatatgaact

SEQ ID NO: 73369 - DNA, 614 bp, Triticum aestivum
  Clone ID: PAT_TA_73369
ttcggcacgaggccatactcatccaattgaaaggatattacgatcgaggctctttcactcatcaggacctgattttcctgtaaccgtgactagctagtcttgtgctcgtgcagctgggacacatcacacacgtacagagacacaggagatggggtctctcatggctggctgggactcgccggttcttgccgacgacgacaagaaagttaacgcgcgccggaaccggtcgctgaccaaggaggaagtggaggcgttctggaagcagcgtcggagtcggaggtcgtcggaggaaggcggcggcgagctcgcctcgcctctttcctcgccgccggccaccgccacgtggcaggagagcccgttcgggagctcggagaagccggcggcggcggcggtccgtgtggacggcttcctcccgggcggcggatccggagacgacgacgacgcggcagctgacagccccagcaggagccgcgactggtggacgcggagcagctgggcgttcctcaacgagccgccgcaggaggagccctccgccagggcgcagcagcgctacacgccgcagttccacgtcgcacgcatcgccaccggcaacgcctgatgactgatcgatgaaa

SEQ ID NO: 73370 - DNA, 526 bp, Triticum aestivum
  Clone ID: PAT_TA_73370
aattcggcacgagggctaaagcaaaacttctactctatgagcaaaaatctattgaatcgatccagattttgagaagcagagatgtgctcagctagaagtactagaagcaaagaagaaaggggacaaaaccgaagagtgatttccatgcaactggagacattgctgtcccatgaatcaaggctggcacaggaaaacttaacatatgccagtgaaaaccggttcctacgtgagacagtacatttttatcaattcaccacccaggacaatgccttattggatgatgagggcacagatgttggaatttgatctgaattctaacgtaagtcttgttggaacgcttggtgggcccacatgatacgtgctgtgtttagtggaatcatttccctattggactatagtccatccgtcctatatatacatcttataagccgctcgggaagagtatacgactcattgtattccctgcattttgttaaaactcttgtcgtgtagccaagatcgccattggtgcccgtggtttttttct

SEQ ID NO: 73371 - DNA, 500 bp, Triticum aestivum
  Clone ID: PAT_TA_73371
gattcggacgaggaccgggtccaccctggtggtcagctggactcatcgcacatggagcacgctaagtcaggccccagcagttggccggaactggccgatgtggtgccggtgccgcaggacgacgggcctagccccgtggtgcccatcgcctaccgagatgacttccgtgaggtcatggattacttccgtgccctttacttcaccggtgagcgaagcccccgtgctcttcgcctcaccgccgaggccatcgagctcaaccctggcaactacaccgtttggcatttccggcgccttattctggaggcactagattttgatttactggaggagatgaaatttgtcggaaaaattgctgaatgtaatccaaaaaattaccaaatctggcatcataagaggtggcttgctgagaaattgggacctgatattgcaaacaaagagcatgaattcacaaagaagatacttgctattgatgcaaaaaattaccatgcttggtctcatag

SEQ ID NO: 73372 - DNA, 343 bp, Triticum aestivum
  Clone ID: PAT_TA_73372
gattcggacgagggctgtgagctaggaagaaatgctagctgattgattgctcgaaactgcaactggagcaagcattgtttgcttgatagaatttttaactcattcgacacatggctcccacttgtcagaggggtagaggggtgtctctgggttcccacacaatttgtagaaacccagatgctcccctaatgccatgctattttgttggcattagtgttaggtacatagctgagcgtaggcttactactatccccttgatccatagcttaaataaactggaactactgacgactccggtgtcctgaaagctgaatcaattgtagagtgataagaggaaattccc

SEQ ID NO: 73373 - DNA, 466 bp, Triticum aestivum
  Clone ID: PAT_TA_73373
gattcggacgaggtggaggaggcgctggagcagctggacaacgtgggccacaacttctactgcttcagggacgaggcaacgggccaggtcaacatcctctaccgcaggaaggaaggcggctacggcctcatcatccccaaggaggacggcaacttcgacaacaaggacaccgtcggcgttgcgcaaccaccaccacccgccgctccggagccgtccttggccgtgcacaccgccgccgacaacaactgatgatccttttctttttttttttgcttgcttgcttgctgctactgtaaaacaaactccacctagaactcgtcgacatctcatctccatcagttgcatgcattggcacattgctgtgtctgtgtctgtgtctgtgtcactctgtcacacacattactcacatagtattgctcaagtttaactctccttcatttcgtaccataaaaaaaaaaaaaaaaaa

SEQ ID NO: 73374 - DNA, 578 bp, Triticum aestivum
  Clone ID: PAT_TA_73374
gattcggacgaggaacccccttctccaggaggcagtcggaacggaaattctttgtagcctcggctagctcacggaatgtgaatgcttttgcggttttggaaacagaacaacttcctttaggaggttcagtgcttgttggtgtttcagatgatggcttgtgctttgaagtgactggtgatggcctgacggaccctgcaaagggaaacagatagtgcataatataattgctacacggattcggttcagagaggaatatatatacataacccagagggaagacagtggcacaggggtgtcattcgtccttaaaacaaagatacactgaatggtcggtatttggaggtctaatcacatctgcaggaaaccactgagcctgtggcaggagcatcttgtgattcttaccagattccctgggaggcgcttcattctggcttggggccttcttcacaaccgtgacctccctggcttccagcctccggggaggcatcttcttctcaggcttgaaacacccaaagcagctcatcatctcccaactgtatgtatcaatcctggatccctattcctctccgctcttgcag

SEQ ID NO: 73375 - DNA, 501 bp, Triticum aestivum
  Clone ID: PAT_TA_73375
tcggcacgaggccccgctgcaacccggcacctggaagccacccgcagttcacgcttggctgacggccgacccgaccctcaatcgtcgtagccctccctccggctccgatccattactcgccatggacgcggcgggcggcgagcagctgagcctggccgcggtgcgcgatgcgctggtccggctggaggactccgtggtgttcgcgctcatcgagcgcgcccggcatccgcggaacgcgccggcctacgcgcccgccgccggcggcggcggaggatattcgctcgtggagttcttcgtccgggaagcagaggccctcaacgcgaaggctggacattatcaaaagccagaagatgttccattcttccctcaagatcttccctcgcctctctttcctaccaagccttccccaaaggctttgcacccttttgctttgttggtcactgtgaatgatgcaatatggaaaatgtattttgatgaattgctcccattattcactgttga

SEQ ID NO: 73376 - DNA, 109 bp, Triticum aestivum
  Clone ID: PAT_TA_73376
ctctgggaccctttgagggcttccccttcggctccggcgggagcaacagtctcttcccgtcgttcccgcgcaccagctcggagaccgcggccttcgctggcgcgcggat

SEQ ID NO: 73377 - DNA, 431 bp, Triticum aestivum
  Clone ID: PAT_TA_73377
ttcctcaatctcatctcggctcctgaagggattcagtgtatttgcaagcgatttccttcactgaagattgtaacgtctgaaatcgattatggtctgaacgaggaattcagggtgataccaggactgggagaatatggtgaccgctacttcggcacagacaattgatgactcataccactctgggtgtatgaaatctcagttgactcctggatagggatgatatcttggaagtaacattcactatggaggccgtacttgtgtttaatagtttgtacaacctttgacataaaagcttgaccaagggcagagggggatgccatagaaggatctgcgtgaactcggaggacgtgtgtatgattttagctttgtacgggtgcagaaacattgttgatcacctgatgttttcaaataagcgtctttgattcaaaaaa

SEQ ID NO: 73378 - DNA, 176 bp, Triticum aestivum
  Clone ID: PAT_TA_73378
gtacctatcgatttcgccaccgccgagcacaagagccccgaacacctcgcccgcaacccgttcggtcaagttccagctttccaagatggcgatctccacctatgggaatcgcgtgcgatttgcaagtacgttgcccgcaagaacaatgcagcagagctgctgagggaaggcaacct

SEQ ID NO: 73379 - DNA, 459 bp, Triticum aestivum
  Clone ID: PAT_TA_73379
tcggcacgaggcaagacagcgagtgggagcgcaccttcgcctccgaccccgtcaaccccgccggctccatgctcgaccccgtcgtcggtggccacgccggcgacccgctgctgcaggacatcctcatgtactggggcaagccgttctagacgaagacgacgacgcgatcgaaggtcatcaatcaaaggggggaatttatttaaaaaaaaaagaaggcgctgcggttggttggttgatctgtcttgggcagcgcaatgcaatgcgacgcaaccgctcggtgtgggcttgactcaggcgagccgccattgttgacctcgttgaggaggagataggttatgaaactatagctggattggataaggcggcaatgagaccgtgtggccccgccggaagggagggagacggacggatggcacagtgcattgggtggtcgatcgtgcgcggcatgtgtgtgtgtgt

SEQ ID NO: 73380 - DNA, 632 bp, Triticum aestivum
  Clone ID: PAT_TA_73380
cacgaagtcaacgttcgttgttttccgttttccttaaccctcagacgcggcaaccccgtttcgtttcgcaccgttccatcttcgccgccgtctcaaagcaatggcgcccaagaagtacaacagcaggtcaaacagcagctattccgctcccaccgccccgttgcccgaaaggggaccagttgaagctttggtatattggagagatcctgtatcatcgggcattgtttttggtgctacgctagtcgtattgctgtcgttcgcatatatgtcactgattagcgtagttgcttatctggctatgttcatacaatctggatgcattcttttacgtctgtataaaactgctctacagacagtaaataaaactaatgaaagtcacccattccaagaatatcttgacttggacatcaggctaccacaggaaaaagctgaagaactgtgcaaattagctgttgtgcacatcaatgccgtattggttgaacttcgtcgcttgttacttgctgaagacttggtcgattctgccaaattctttggtattctctgggtgttgacatatgttggcgctttgttcaacggccttacactcataattattggatttattgccctgttcacactacccaaagtttatg

SEQ ID NO: 73381 - DNA, 474 bp, Triticum aestivum
  Clone ID: PAT_TA_73381
tcggcacgaggaaccaatctaaaatcgccgctacacacagagtctgcctgtgttgccttgcctcctctcctccctgccggctgcagctagctcgatcggccgcgcgcggcatgtcgaccaccaccaccaacgccgtgtcccagcagaaggacgctgcggataagaagccggcgcaggagacggtgacgaagacggtgcagacggtggaggtgcggtcgtcggcggggcagcccgacgaggaaggcgtgctcaagcccgtcaaggtggtgcacgagatccctgcgaaggaggccaaggacaactccggcgtcaagcaggactaacggaggagtagctagctcgctactctagatcacgcttcgtgattgatgctcctcctgctgctaagctgcggatgttgctgcggtagctatgtgcaaagatctttccacttccacccgtactagatcctatagtaattaattgctggagagt

SEQ ID NO: 73382 - DNA, 433 bp, Triticum aestivum
  Clone ID: PAT_TA_73382
tcggcacgaggtgtgatttgagtctcctctcgctcgcgtcgtgctacgtgctacgtttttcttcttcttcttcgtcgggtttacgatggctccccgcgtggcggtgctgctgatggccgtggcctcatcgctcctcgtgatggcgtcggcgcaggaattcaacgcgccggcctcctcgccggcgccgtcgccgatggccggggcggcgcccgggagcgcgtccccgctcgccgtcgcgtcctccgcgctcgtcaccctgctcgcggcggcgctcatgcagtagacgacgacgcgacgactccggcttctcccgcgcgcgtggctccggatttggttgcgtcgatcgagctgcgatcaaatcatgcatagttggtttctttcttctttattataattccttcttctttgggggagagagagagagagattattg

SEQ ID NO: 73383 - DNA, 524 bp, Triticum aestivum
  Clone ID: PAT_TA_73383
gattcggacgagggagctgcagaagaagctggacgagatggcaaaggggtggcctcagaagctgaagcatgagctgcatgacgagcatgaactcgtcctgctgcgccgtggtacgtacggctgcgacgggtgtgaagagatgggcagcacatggtcctacaggtgcgatgagtgtgactttgatctgcaccccaagtgcgcgttggcggaggaaaagaagggtgaagaggaggaaggcaagtccactgaggaagcccctgctgggtatgtgtgcgaggaaggcgtgtgcaggaaggtctagatttgttctactgagttgcctttgcgtttccggtgctatctgaatggtgtgagggatgacaataatcgtgagatggttgtgcttggagccgaggtttttgagctgctgatgtttgtgtgttaataaatagtagttgtaccctgaactcttaagagcgtatgtgtatgcagaactatgtgagtattagatcaaagtaatggttttgctacatggtatttctgct

SEQ ID NO: 73384 - DNA, 158 bp, Triticum aestivum
  Clone ID: PAT_TA_73384
gattcggacgagggtttattagttcgccattgattcatgatgtggataacagaaggaaggagagggctagatgcaattttggctgtaaagaaaaacgttcgctgtacattctcatgcaaacaagaacctgtagattttccaaaaaaaaaaaaaaaaaa

SEQ ID NO: 73385 - DNA, 625 bp, Triticum aestivum
  Clone ID: PAT_TA_73385
gattcggacgaggctggcttaggcagcgcatatgctaatggcatgctgtatgtggtcttgtacgagggggatcagatagctgtgatggacgtggaaggcaacacaaggaagatcatccctgtgccctttcaggagggcggtgagttccagccatgttcgttggccagtcccaactcccaagggcatttgcatttgatttaccatgctgacctgggtcatggtgaaatcctcccagaacagcagagtaatgaattgttcatatgggttcttgaggactatgatatactgatatagaagaatgggtcctgaaggacactgtaagctttttgaagttggttggaaagatgactggccaaacgatcaatggcttcaaagtggttgcaattcatccagatcacagtttggtatttcttattcagcactttaaccgggatctgatatcatataacatggacaagaagtgtctcgtctctgcactggctatcagtccatcactccatatgttccacttcaaaagagttgtcaacatttgaaaataaggactgaaatttttgcttgtgggctacttactgggacattccagccgaaatcagagtttccaggtatgtctttttaatgttgctgg

SEQ ID NO: 73386 - DNA, 445 bp, Triticum aestivum
  Clone ID: PAT_TA_73386
tcggacgagggtcctgcttctgatttgctttgcctcccagatcttgcagactagctggggggcagcccagccgagccgagctgatctcccaccccgcaacaccccggccgtcggcggatcgttcgttctgcgtctactacttgatctttgaacaagctaaagacgccgaagcgtcgccaccagcaagggcggcttgatcgtattcaagatggggaaggacaaagaagctaccaagcttaaggaggaggagaaacacaagaagagagaaaacaaagataaagataagaaggataaaaaggacaaagaaaaggatggatctgaaccaaagggttcaagtgatgaaaaacaagagaaaggtaaagataagaaaaagaaagacaagaagagcgaagagatggaacagaaggaggaccatctagagaataagaatgataaggccgcacag

SEQ ID NO: 73387 - DNA, 570 bp, Triticum aestivum
  Clone ID: PAT_TA_73387
gattcggacgagggtgacgtcgagcagcagccttgagcctgacaggttaagcgtcgtcgtcaagagagcaggaagatggacggagaagctgtacgagacgatctcgtccctgccgccgtcgcagcccgggcacctcgacgtctcggtcgaggggccttacagccaggccacaccagcaagcttccttcagtacgactcgttggtgatgatcagtggtggcggcggcatcacgccgttcatctccgtcatacgcgagctcgttcaccggagcggcacggcggcagaagccgcgacgccgagccttctcctcatcgccgtgttcaagacgtcggctgacctggccatgctggacctcatcgtccctgcctccggtgggttctccgacatctcccgcctcgaactgcgcatcgaggccttcgtgacgcgagaaagcgtgccctccgcgggcgatgtcgtcgcaatcgcgcacaaggtgcccgcagaggaggtcttgttcaagccgtcgccgtcgcacgcgcccatcgccccggtgctcggccacaacggctggctctggctcgccgccgtcgt

SEQ ID NO: 73388 - DNA, 437 bp, Triticum aestivum
  Clone ID: PAT_TA_73388
gattcggacgagggcccttggagtggatcgaaaatcacagtgcctgcaaaattcatactcagcaagaacgacgttggtctgcagtcctttggaactgaggagtacgtcaagagtggcggtttaaaggagaatgttccagatcttgaggtttcaatcattgagggacaccatttcgtccagcaagaagaggccgagagtgtgaattcggaaatactgtccttccttaacaagtttgccaccgagggaggatcagcatgatgtaattgtttccagtcagtcctgagatagtgagaggaagatggcctcagatctgagtgtgactgaaagcttttccaaactgaaaatgcaaggtcaagctgatatcttgatgtaaaacagtttgtgattgaataaagtgagagctgagtggaagccatatgttggcttgcatttaggga

SEQ ID NO: 73389 - DNA, 228 bp, Triticum aestivum
  Clone ID: PAT_TA_73389
gaggggaaacaagcggccgaaagctgagtgaccacgtcgccgccgcgtgagagctaattcaagattttttttggtctgactttggagggatacgatacaccatacagaatcaaggcctaaggggccattcgttgttttgttcagttgttggtagaggatacagtggggaagaaagtgcaaaggaggcacgagattgttacattactatactatattgcttttctatag

SEQ ID NO: 73390 - DNA, 556 bp, Triticum aestivum
  Clone ID: PAT_TA_73390
gattcggacgagggggagaacatcggtatcggttccccgtgaccccatctcttcctttcccgtctcctctccacataacgcggccagcaatgcaactgctggtaaggaacccggccagcagtggcggctgcgcgtttctgccggctgctgctgctacactgcggccaccgtcgtcggccacgctctcatggaggaggccgggctgcagttggaggagcaagcggtgcctcagtctccccccgcgcgcaaacaccgacggttcagggtctggtgctgctgcggctgaggcgtctaccgtgggagacaccttggaacgggaggagggcggcggcgtagatgcaggtgcttcggctgagtcatcatccaaccggaagcagccgcgccctgtcgatcccaagatcgagaaggagctcaagaaggcagttcagaagactgcagcaacctttgcaccgagggcgtccacgaaaacaaagaaccctgctgtccctggaactgccctgtacagtatctttgaagtccagggatatgtctccatgctgttgggtggagctctttc

SEQ ID NO: 73391 - DNA, 472 bp, Triticum aestivum
  Clone ID: PAT_TA_73391
tcggcacgaggcagcaatggtcggcgcagacatagacccgcagaaactgctgcagttcttttcaaagtatggtgagattgaggagggtcctcttgggctcgataaggttaccgggaagccgaagggctttgctctatttgtctacaagaccctcgatagtgctaagaaagcgcttcaggagccacacaagcaattcgagggggttgtgctgcactgccagaaggcaattgatggaccaaagcccaacaaaggtggaggacttgggggtttgtatggtgctggcacttcaggcgggaggaaaggcgctggtggttatggagctcatagtcattctttgcctggtgctgctgttgggggccatgtgatgccatctccagtatccagtttgacttcattgccaggtgtagctggtggcccaggggtgaatcctgctctggggcaggccttgacagctatccttgcctcccagggt

SEQ ID NO: 73392 - DNA, 262 bp, Triticum aestivum
  Clone ID: PAT_TA_73392
tcccctctcatccgctcgcggacacagaatctctcctctccctctcggcgcccaggttctcgccgccgcccgccccttccttctcttctcctcctacgtacgtaaataatccacctacgatagatacgaccaaccccattatgagctctctatgcccctttgccaaactcgcctccgctggcgccacatgccccgtaaaatcatcatcagacaacaaaaccaccatcaatcacgccgacgacgacgacgacgacaatgaaaa

SEQ ID NO: 73393 - DNA, 605 bp, Triticum aestivum
  Clone ID: PAT_TA_73393
attcggacgaggaattaattaaattcacacgcatacttttaacccgcctataagtataggcagatcttatatttacttacttcctagggaagtatttagtcgtcccaatatttgatgaagtcactcgatcgggtccatctttgaacaccactggacctcaattaagaagactggaagagagcttattacttactatccagggaaaaggaaatgtatttatttctaacatccatttattaatttggtgcatcgatcgatctctatctcgttgcgcttgcgtgcatggcgatggcgggcagttatacgcagctatcatggcttcagcgacggggtcagcgggtggtgtagcgtggatcgggcttaagggcaacacacacaccaactggaccaagatctgcaacatctacggcaacttctgccgtcacatcggcagctccgtcttcctgggcctcgtcgcctccgtcatcctcgtcctgctcaccatcctcaacgcctactgcttgtaccgccgcagtcgctagatagctaagctactacacctgattatacatatatacatcgaagaatgtagctagagcgtgtgatctgtattctgtactgcacta

SEQ ID NO: 73394 - DNA, 631 bp, Triticum aestivum
  unsure (1)..(631): unsure at all n locations
  Clone ID: PAT_TA_73394
attcggacgaggcagagaagcttctttgacagcctagtcaagtatataacaagtggtccagttctcgctatggttctggaaaggcctgatgccattgcgcaatggagagctttgattggaccaactgatgcaagaaaggccaaaacctctcacccaaacagcattagagcaatgtgtgggctggactcagagaaaaattgtgtgcatggttcagattcaccggaatctgcagccagagagatctcatttttctttggagaagaagctgattctgtaactgtggaacatgatgagctttagacgctacactggtatgagtcaagtcagcaaactgaattttggtttgtctttaaactcttaagagtcttggttgatgaatactttaggttcatcagttgagggcttgacaccacatgatgactagctagtgtggcttcatacacagagttctcagagactgatctggagattgtgattgctaagactaggatggctgangcctagccgcctagtggtctaccgttcttaagcttctactacttaagcgttattctcgaagtattctgtgtagggaacttatatttgattgcactggaactgcacacaaatagatctttgcattgatgctgga

SEQ ID NO: 73395 - DNA, 383 bp, Triticum aestivum
  Clone ID: PAT_TA_73395
attcggacgaggaactgcaggcgtctacttggctggtggtgcttgttggatctgcaatacccttatgatgatattaagttatgttgtgacatttaggttcaatacaaggtacacttaggatagaagcatttgctcaatacaagatacacttaggatagaagcatttgctcctcttagtctctctctctttttttaacgtaatggcaggagctctgctcctcttagtctcagccatgcgcagaattcaatttgtatactcattgatctccccacctgtatagcacatatttgatctgtttaatcgttgcttgttatagttatagctgatgtagaacaacattaacagccaacagtagcacgaagttaataaaatctaaccccct

SEQ ID NO: 73396 - DNA, 594 bp, Triticum aestivum
  Clone ID: PAT_TA_73396
attgtctttgaacgtggagatttggtttttgttttcaattttcatcccaagaaaacttatgacggttacaaagttggatgtgatttgcctgggaaatacagagtagcactggactctgatgctttcgtctttggtggacatggaagagttggccacgacgtggatcacttcacgtcgcctgaagggataccaggggtgcctgaaacaaacttcaacaaccggccaaactcattcaaagtcctttccccaccccgcacttgtgtggcttattatcgtgtagatgaagaggctgaacgtcttcaagcgaaagcagagacaactggttctagaaagacttctccagacatcatcgatgttgatgctacccccgtcaaaacttctacagctactaaagaagacaaggaggcaacatctggtggcaaggaggatgcaagcaagaagggatggaagtttgcacgccagtcatccaataaaaacaccaaatgaagccagaagtccttgatcaggactggactggctgccagcgccctcttaatagtcctgctctactggactagccgctggtgcccttgtaacggtcctttcctgtagctc

SEQ ID NO: 73397 - DNA, 431 bp, Triticum aestivum
  Clone ID: PAT_TA_73397
attcggcacgaggggatgaccttatctctctggaggaaatatgtcagtactccggaggcttggctggagcagcagccatgtatccatgtccagtacttgcgtggcagttgggttcgtggctaggctgtatgcgtgtgaggcttcggactctgctatatgtgtctctgggtctctcctggcagtggcggagggaagggggggctgagggaggcctggcaccccccaaccttcccataactcccttaatacacctcatagattagatgtttaattatctaactcccttaatacacctcatagattagatgtttaattatctaattagctagttaatgatattatctgtactaagatttttattcttatttcatattaatctctaatagtttcttataaaaatagaaacagatctttctaatatttttttcata

SEQ ID NO: 73398 - DNA, 489 bp, Triticum aestivum
  Clone ID: PAT_TA_73398
gattcggacgagggtcgctcgctctcctgcctgatccggatccggcaggccggactgcgtaggtgtgccgcggcgagacgtgcgcgcggcggcgccgatcgacgacccgatcgatggacttcacctcgtcctacttccacgccttcggcaaccccgacttcgccgcggtcttctccggcggcggcagcgcgcaggccatccggccgggcaccaccaccagcagcagcggcggcgcgaaggcggtgaacgttggcaggggcggcgcggcgaggcagggcgccccgtccgtgttctgcgtccaggacgcggaggtggaggaggcgcaccacttcctcgacgagtgcaccctgtgtcgcaagggcctcgccggcgacatcttcatgtacagaggggacacgccgttctgcagcgaggagtgcaggagggagcagatcgagatggacaggaacaggcaccgcaggaagaagcagcagtactctcccacggcgc

SEQ ID NO: 73399 - DNA, 217 bp, Triticum aestivum
  Clone ID: PAT_TA_73399
gattcggacgagggcagcttccctctctctcttctcgtccgccgctgctcgagatccgcggccagcccatctcctgccggtgaccggcggctctcctttctcccgggttgcaagcggcggatgagcactctggtgcaggccaggttcgcccctctccctacggagcgaattggatcccaaacagatgctggggctggtgggtaccagttccggctgg

SEQ ID NO: 73400 - DNA, 635 bp, Triticum aestivum
  Clone ID: PAT_TA_73400
attcggacgaggatacattgactctgtgctcaatcaggacagagctcacccagataaatacattgactctgtgctcaatagggctactcatcaggacagttatttggcacttaacaggaaatatgatcttatgtttactgacattgatgatatctcaaggatgaagggttccagcatcgaagaagtgaccaagccgtatactactgctccaaccagtgatccgtacagcttgcgatctagagatggcagcttctacaggcatccgagctcagaggatttaaacatcaatactgatgtgcctatgcaaggatacagtgcaagatatggacaaattggtggtgacagttacccacaagctcgtatggtcccattagcaacagattcagaaacacatcaaagaatgcatggtggaacaagtgctgatgattacccgtcgacaagatactcccttggatcttcaggtgctcgctttagccaaccagctacaactgttccctcttttgggctcccaggtgtgagttcacaacgaggctcaggctcagtaatggacaagtattcttatgggctcttgggtccgactgtaccacagagctccgttattgacagatatactgcatccctcgatggaacgagct

SEQ ID NO: 73401 - DNA, 491 bp, Triticum aestivum
  Clone ID: PAT_TA_73401
gagggaggaggtggtgcagagggagaagaaggagaaggcggtcgcgtcgctgctgatgaggagccagaagtacgccatgctaaagcagcagctcgccgtggccgcccaatttgaggattacaaggaagcagcgaggctgagggactcgctgaggtcgttcgaggaggaggagcccgtgctgcgccctccgcaggttgatgaagaaggccattgacgaggagaggtttgaggatgctgctaaatacagagatgaattaatgattttggctccacactccctcctcaaatgttccagcgatgcaactactttgggcataagagttcaagtcaggagcgtctatattgaaagccggagccagccattgaaaggccaattcttttttgcttatagaattagaatcacaaataattctcagcgccctgttcagcttctcagaagacactggattgttacagatggaaatggaaggacggaaaatatttggggagtt

SEQ ID NO: 73402 - DNA, 513 bp, Triticum aestivum
  Clone ID: PAT_TA_73402
tccaacaatggcttggaggtttgggctgggccactcagcaacaacaggaaggccgtggtgctctggaaccggcagggctaccaggcaaccatcaccgcacaatggtcgagcatcgggcttgcttcatccactgctgtcactgctcgtgatctatgggcgcactcatcattctcggctcagggccaattatcagcttcagtggcacctcatgactgcaagatgtatgtcctgacaccaaattaacttatagaagacatgagcggagtccatagtgtgggatgcaaccattcgatcaagattcaggaaaatgagtatgcaggcaaggattctaagataaggaaacgagatatcattgttatggtggggggaataatttataatctgtaagtgtatctaaggagccgtcaaatgtcggtgcctgtattctgagtgtttgcaacaaaagttgcagcaataaaattggcttgcccaccactctctttacgagcatgttaacggatttcagagagcggg

SEQ ID NO: 73403 - DNA, 468 bp, Triticum aestivum
  Clone ID: PAT_TA_73403
gattcggcacgaggatacaacttaacgtacagcaagaagctgatggcatgatacggcgttctgaagctggttacatggaaacatcaatcccatcaacatgcacagtaactattcgtgctcatgatggtgggtgtggatctttgatgtttgagcataactcagacaagctaattagtgggggccaggatcaaactcttaagatatggagtgcatctactggtgccttgacctccaccctacatggttgcttggggtctgttaatgatcttgccgtgaccaatgataacaagtttgtggtcgctgcctgtagctccaataagctgtttgtgtgggaagttaatgggggacgtcctcgtcacactctgactggtcacacaaaaaatgtttcatctgttgatgcaagctgggtgaagagctttgttgttgctagttcatccaatgatcgtactatcaagacttgggatctac

SEQ ID NO: 73404 - DNA, 440 bp, Triticum aestivum
  Clone ID: PAT_TA_73404
gattcggacgagtgccgttccgccctcctggtgtgccgcctgctccgttccctggtgcaccacaacagtttatgaggggtccgccgccgatggggccgccacaggtgaggcccgggatgccggggccaccacctcctggaatgaggcctgggatggctccgccaccctttggacagccgaggccagggatgcagcccccgccacctggtccacagcagcctggacagaacccgccgcagtagcttcttacccgagaaggcacagggtagcagcagggtagtggttgcatgcactccaagcctccagcatttcctgggataagcttctttcagatacacttatggaagatttttgtatcgcgagaaaggatcaatcgcacctctggaaggcttgtgaattgcaccaatgcttcaccattctgtcttatatatcagggtact

SEQ ID NO: 73405 - DNA, 620 bp, Triticum aestivum
  Clone ID: PAT_TA_73405
gattcggacgaggcagcattgtcgtccagtgcgtcattcagctcgccaaactgtatggtcttcacaccatcaacatcataagggacaggcctggttcacaagaggccaaggacaaacttaaacagcttggagcagatcatgtgtttacggaaagccagctagacatcaagaatatcaaaagcttattgggtgctttgccagaacctgcattagggttgaattgtgttggaggaaatgctgcttctgtcatactgaaatttttaaggcaaggtggcacaatggtgacatatggtggaatgtccaagaaacctgttactgtttctacttcatctttcatttttaaggatctttccctaagaggattctggctacagaagtggatgagttcagataaggcagaggaatctagaacaatgatagactacctgttggacctggtgcacgaaggcaaacttaaatacgagatggagttgacgcccttcagtgacttccatttggctcttgataaggcactcggcaaacatggaagccaaccaaagcaggttctcaagttctaagataatgcaaagacaacggatgagagagagcttgtatttacaaaacaggagtagaaaaaggat

SEQ ID NO: 73406 - DNA, 425 bp, Triticum aestivum
  Clone ID: PAT_TA_73406
attcggccgagggagagagagagtgcgagagagagagagagagagagagagagagagagagagagagagagagagagagagagagagagagagagagagagagagagagagagagagagagagagagagagagagaggcccgcccgagaggctactcgaatcccccccaaaattccgcggtgagagccactgatccatcgcaaaacccatcaaatttcgcaattcaaatcacccaaccccacctcccgccaccaattccgaggagatctcagtcaaccgaagggtcaagtctcgcgaagctttgagttggaaatatggggaaaccgctgatctacgagattctggagaagccggcgagcagcagcgtcatcggcatctgctccctgatctggtggctcatccagaagcggggtatcgggtacgcg

SEQ ID NO: 73407 - DNA, 624 bp, Triticum aestivum
  Clone ID: PAT_TA_73407
attcggacgaggcgcgagtccacgtatggccgccaacttctggacgtcgtcgcactgcaagcagctactggaccccgaggatgtggacctggtgccggcggcggaccgggagcggggcatcacgccagaggagttccgcctcatcaagatccatatgtcgttccatatctggaggctggcacaacaggttaaagttaggcaaagagttatagctacagcagtcacttacttcaggcgtgtgtatacaaggaagagcatgtcagactatgatcctcgtttggttgcacctacttgtttgtatttggcatctaaggtggaggagagcacagtgcaagctcggcttcttgtcttttacataaaaaagatgtgtggttccgatgacaagtatcggtttgaaattaaggatattcttgaaatggaaatgaagctcctcgaagctcttgactattatttggttgttttccatccataccgtcctctcttacagttattgcaagatgctggcataacagatctgacacaatttgcctggggccttgttaacgatacatacaagatggaccttatcctcatataccctccctacatgattgcactggcctgcatatacatagcaagtgttct

SEQ ID NO: 73408 - DNA, 471 bp, Triticum aestivum
  Clone ID: PAT_TA_73408
gattcggacgaggcctcgccgacttcgaccgcgtcatggcgatcaacgcgcggggcgtggtggccggggtcaagcacgccgccagagtcatggcgcctcgacgccgcggcagcatcatctgcaccgctagcatcgccggcgtgctcgggtccatcacgccccacccttacagcgtctccaaggccgccgtggtggggctcgtgcgcgccgtcgcgggggagctcgcgcgctccggcgtgcgcgtcaacgccgtctcgccgaactacatcgctacgccgctcgtcatgcggattctacaggagtggtacccggagaggaccgccgacgagcacaggctcatcgtggagaagagcatcaacgagatggaaggcgtcgtgctccagccggaggacgtggccagggcggcgctgtatctggcgtccgacgagtccaagtacgtcaacggacacaacctcgtcgtcgacggcgggt

SEQ ID NO: 73409 - DNA, 423 bp, Triticum aestivum
  Clone ID: PAT_TA_73409
gttcggccacggtcacggccacggccacggccacgggcaccgcgaccacagccaccgccatgccgaggacgccgagaagcaggcagatggagaagaggagagtggtgtgctggcttggatcaaggccctcatgaatcggttctagagctgtacgtctcgatcgttcgagcgatccgatccgtagtccactcacggtcatatggctgctgctcgcttctgattaccatcccgcatcttgctgtgtgttatagtgtgtttcttctatccacggtgtggtcgatcgtcttacgcatgcacttgtacgacagtacgtagtacatgattgtgtgctcgacatggtacggtgtgtttcatgtgattctatgcacgcatatacctttctgttttttttttttcggagatcgtgatattcaataatacgca

SEQ ID NO: 73410 - DNA, 137 bp, Triticum aestivum
  Clone ID: PAT_TA_73410
gactactaccacggcggcacggccagcatgcacgacgactgctacgacgccggcaggcacggcggcggcagcatgaaggcctactcgcgcaccgacgagcactatgaccacgtgcaggacgaccgcatcaggatgag

SEQ ID NO: 73411 - DNA, 159 bp, Triticum aestivum
  Clone ID: PAT_TA_73411
acacatttccttgtgtttttggttgaccactgaccacccctctcatctcatacgatccaagctagacaagtcccgcactagggtgtggtgctccagtctagcagcttttttgctcatgttagcttccaaatctgctccacaactccggcggcacaagaa

SEQ ID NO: 73412 - DNA, 521 bp, Triticum aestivum
  Clone ID: PAT_TA_73412
gattcggacgagggcgactgcttctcttgcccgatttattccccatcttgtccctccctataaggtcgcctttcctccctttgctaaatagaacgaggcagaggcatcttcttcgactcgacgtgcgcttcctcttcctcgctcgctcccagtcgcagtgatggctgatgttgatgagtaccgttgcttcatcgggaatctgtcctggtcgacgactgatgaaagcctcaaggatgcattcagcaaatttggcaacctaactgaggcgaaggtggtccttgacaaattttctggccgttctcgtggtttcggctttgtaacttttgatgagaagcaagccatggaggatgctattgagggaatgaatggactggacttggacggaaggaacatcactgttgataaagctcagccacaaggacctggtagagaccgcaatggtgaccgtgattatgaccgtgatcgtggatctcgttatgaccgtggtcgtgactatggtagtgggcgtgcacccgcgagga

SEQ ID NO: 73413 - DNA, 399 bp, Triticum aestivum
  Clone ID: PAT_TA_73413
gttctcttttgatacattattggggtatcgtttatgttttctgaatcattggtggaacatccttaagcaaaaatgggccgtcgtcctgcaagatgttatcgttactgcaaaaacaagccgtacccaaaatcacggttttgtcgtggtgtgcctgatccaaaaattaggatttttgacttgggaaagaagaaagctaaagtagatgattttccgttatgtgtacatcttgtatctgatgaatatgaacaactgtcatctgaggctttggaagccggacgtatttgtgccaataaatacatggtaaaacactgcggtaaagatcagtttcacattagaatgagacttcatccgttccatgtcattcgtatcaataagatgttgtcatgcgctggagctgat

SEQ ID NO: 73414 - DNA, 427 bp, Triticum aestivum
  Clone ID: PAT_TA_73414
gattcggacgagggatgttgctgaggccccagctgctgacgatgacgacgacgatgatgttgacctttttggtgaggagactgaagaggagaagaaggctgctgaagagcgtgctgctgctgccaaggcttctggcaagaagaaagaatctgggaagtcttcagttttacttgatgtgaagccatgggacgatgaaactgacatggccaagctcgaggaagctgttaggagtgtccagatggaaggactgctctggggtgcatccaagcttatcccagttggatatggcatcaagaagctgcaaatcatgatgaccattgtcgatgacctcgtctctgtcgacacactcattgaggaccatctctgcgcagagccagtgagcgagtacgtccagagctgcgacatcgttgccttcaacaagatctaa

SEQ ID NO: 73415 - DNA, 227 bp, Triticum aestivum
  Clone ID: PAT_TA_73415
agccaaccaggtttaccacttgagccatttacaatgatccggatggcagagattttagatgaatgtttgcaagctggaaaatgcctggtgatcaatgacagacatcgtgttgagagttcttccactgaaggcacgaaggatccaatgggaactgaggatgctgttccgataagcaatctgaaaaggcacacgagcaactgagcaagaatgtgatacaagaaaagtac

SEQ ID NO: 73416 - DNA, 333 bp, Triticum aestivum
  Clone ID: PAT_TA_73416
ccgcgccggggatctcgccgtcgctcaagaacttcctcctcagcatcgtctccggaggggtcgtcctcgtcgccatcgtcggcgccgtcgtcgccgtctctaacttcgatcccgtcaagcggggctgatcgagctcaaactacatgcatcgttgtgtgttggtgtaccctatgtactgagatctcttctcccgtgtaaacagtgttttaatattgcgtgaatcttttgccgtgtaaatttcgtttcatgctcgcatagccatcgtctgtatggcatatgactatatgagacagattcaacagcgcattcggtctaaaaaaaaaaaaaaaaaaa

SEQ ID NO: 73417 - DNA, 504 bp, Triticum aestivum
  Clone ID: PAT_TA_73417
gattcggacgaggcgactgctcccgtgatctgatctgatcggcgatcaactcggcatggcggactggggccccgtggtggtgggcgtggtgctcttcgtgctgctgtcccctggcctgctctgcgagctcccgggcacgcaccgccacgtcgacttcggcggcttccacaccaacggcaaggccatcttcgtgcacaccctcatcttcttcgccgccttcaccatcctcacgctcgcgctccacgtccacatctacaccggctagtactagtctatatgtatgtgtggtggtcgatctgggacttgcagaggtcagatcagaatcagatcggatcatgccgtcgttgctgctcttgttcctcttcaactcgatcgattcgacaagtgcttgtactgccttcctcaatcctagctatcactcgtatctatatcatgtaaaggccatatggccgtcggtctgtagctaacgcttgcaggaactagtgcctgcccttttaatcgaat

SEQ ID NO: 73418 - DNA, 490 bp, Triticum aestivum
  Clone ID: PAT_TA_73418
gttgctacctgggatcgagggctcctcagccatcacaaattgagtctgccgtgcgatgggctgtgagaaagcggtcacagaacaagcctgtctatgtccactgtgcctatggtcatggcagaagtgtctgtgtgatgtgcgcgcttcttgttgcattaggattggctgaagattggaaagctgctgagcaaatgatccgtgagaagcgaccttatattagcatgaacactcttcaccgcaaaagcttggaggaatggtcaaaacatttgctctcctctaaaagaagtggggaatcggatgtgagttctgttatccattcggattataaccagaaataaaattgaaccagcaagagacacgcgtgttcagtaactgtgatatttaagatgcattgtacattcggtagtattgtttgctgctgtcctagtgaatgcctatggttcattctaagctatccttttgtggtaattgttttgtaaaaactatatgt

SEQ ID NO: 73419 - DNA, 197 bp, Triticum aestivum
  Clone ID: PAT_TA_73419
gaagctgcagaatgtggagctacaggtggtaggggtctggagatgtttattcggcaagctagtgggcagtttgagcatttcacgggcatgccagctccagataggctgatgcgtgatattgttctaacaaagacatagtaaggtctgtccgaagagcaagcttccattcaatcgaaatttctgcacaattgattcca

SEQ ID NO: 73420 - DNA, 547 bp, Triticum aestivum
  Clone ID: PAT_TA_73420
tttattttaatcaattagtttctctggttttgttttattcaattccaatattatggcatggaattgatagctcaggtacaacatcaatattcgactgaaactaactacaatatacttgctaaagtgcatatctgcagctaaaacaagcaaaaaagttttggatcttaacgaacaatcatgtaaatagcttatataactgctaaattttattcacataatgctaactaaatttaagttccaaatgccttgctatgttttctttttctttctttcttttttctattgcagattagtgtagcggcttcctgaccaaaggtgtaaagcatcactgctaccaaagtcatttgactgatatctgattgacgtcctcaacggttgacacatactcatcggtcaagtcctcaacgtacatggagttggataagtttgttgcaatccattagcaaacaccaaatgcagagttagttttttggtggtaccagatgggtatgcacatgagcaagagaggcagagagcaagtgaaggggcgcgagcaacgatgtatcac

SEQ ID NO: 73421 - DNA, 367 bp, Triticum aestivum
  Clone ID: PAT_TA_73421
ctacttgttggtggaatgactagggttccaaaggtgcaggcggtagtctctgaaatctttgggaagagcccaagcaaaggagtcaacccagatgaagctgtggccatgggtgctgccattcagggtggcattctccgtggagatgttaaggagcttcttcttcttgatgttactcccctgtcactgggtattgagaccctcggtggtatcttcaccagattgatcaacagaaacactacaatccctacaaagaaaagtcaggtgagttgtcatacctctattctttctcagaatgcagtttcatcttgtttgattatcccttatttaactcgcatgggtgtattttttcttgacatgacacatattt

SEQ ID NO: 73422 - DNA, 276 bp, Triticum aestivum
  Clone ID: PAT_TA_73422
aacagcgtgctctccacacattccctgattgaacacaccgatgttgttgtgcttcttgacaatgaagctatatatgacatatgcaagaggtcccttgacattgagcgtccaacatacaccaatctgaacaggcttatatctcaagttatatcatctctaaccacgtcactgaggtttgacggagccattaatgttgacataactgagttccagaccaaccttgttccttatccccgaatacacttcatgctctcttcatatgctccaattatctca

SEQ ID NO: 73423 - DNA, 481 bp, Triticum aestivum
  Clone ID: PAT_TA_73423
gattcggacgagggtgaacggcaaggtagcgccagcgtcgtcgtctccgggcggcgccgcgtcgtcgcttctggccgcggcgagcgcgatgacgacgtcgtcgcccgcgctggcgctggtggacgagcggatgtcgacggagggcaccgggctcagcctggggctcagcaacaacctgctggggtggatcctgctcggcgtcttcggcctcatctggtccctctacaccgtctacacctccacgctcgacgaggacgaggactccggcctctcgctctgaaataatctacctagctgattcgtcgatcattcctagctacttgtatttttgttcagcctgaccccgtgtattgtagtccgtgtgtgagttcgatcgatctgtgcatgcgtgggtgcagacgaagcaagccatggttgtatgcgaccgtaactcagttgttgcatctcagatatggtacgtaatgacgagtacttaattagt

SEQ ID NO: 73424 - DNA, 231 bp, Triticum aestivum
  Clone ID: PAT_TA_73424
cgccgatggagcggcgtcgactcggcggctcctcacgctgtcccggcgtcccgcggcccgcgccgccaccctccactccccgcaccgcgacgcctcccgagagctccacacgaagattaccttgcaaattggtcttcatgggatgggaactcactgaggtcccagagggacccaactccctccctccgtggatctacaagggaagtgattgctgccaagattgagaccaag

SEQ ID NO: 73425 - DNA, 130 bp, Triticum aestivum
  Clone ID: PAT_TA_73425
tacgagcgaggaactcgtgtgcaatgagcgtgtatatatagctaggtggctacgatgtttgggtttcatcgaataagcgaacttgctgcaccgtggttatgcacataaataaggtctgcccgttgccctt

SEQ ID NO: 73426 - DNA, 509 bp, Triticum aestivum
  Clone ID: PAT_TA_73426
gattcggacgagggagagaactagtctcgagttttttttttttttttttttttttttttttaacaccaaaagtaagcataatacattgtacttgagcatatttgaggctgcatacataagggcttttataccatatttaggaatttatttatcgaacagaacaacaaggccagctgaaaatgcctcattattttatccatctacagcccgatcaaatatttcaggcctaactggactggcaacaataattagcctcttcaagggcatataggattacaagtttacaactgctcctttggtttcaactccaattgattattgttgaaggtaaataatgaacaattaattgttcattgaacgtgtcaccgttgtctgtgaagctcccaaagggctagggcattccttatttcaagccgttgttgtctaagtgaaggaaaccaccatggcctcgagcatttgtaaacttgtatacaggtccagaaacttcatagccaccgaacactggatct

SEQ ID NO: 73427 - DNA, 343 bp, Triticum aestivum
  Clone ID: PAT_TA_73427
acaactcccggaagactccaatcttcagctctccttccccctccccattccaattccaagaacagggcagcgggggggagtcaaccaggtacgatgtgctcaataacgaggctcgcgtttgtgcttgcactggctatagcctcatcaactgaggttgcagagagcagagattttaatatcttggctcagggcagcttgcctgatgcagccaagggaccaggtctaactgcagccagtggaaagctgtgtcaattatgtgagcagtactcaactgaggcacttttctatctcacacaaaacgaaacccagactgaaattcttagcattctacaccatgaatgtg

SEQ ID NO: 73428 - DNA, 234 bp, Triticum aestivum
  Clone ID: PAT_TA_73428
actcccatcccatagtttccactccacttcgatcctatcctccctcaactactcaaccaagaacctttccccccttccaagttactcgaggaatccatgtgcggcggcgcaatcatcttcgactacatcccggcggcgcggcgccggctgtcatccgccgccgacttctggcctggatccgacgccgacgccgaggactctcacgcctctgtcacccctgaccctgagagagcg

SEQ ID NO: 73429 - DNA, 575 bp, Triticum aestivum
  Clone ID: PAT_TA_73429
gtctcctgcattccaagctagcatatatactagcacacagtcaggcactcagatcactcagcacacacgaatagctcgatcgatcgacatggcacgcagcatgcagtttgctgtggcgatgatcgccgtcgtcgtggccgcggtgctgctggcagcggcgacgacgacgtcggaggccgccgtcacctgcgggcaggtgaactccgcgattagcccctgcctcgcctacgcccgcggcaccggcaccgcaccctccgcggcctgctgcagcggcgtcaggagcctcaactccgccgccagcagcaccgccgacaagcgcaccgcctgcaactgcctcaagagcgccgccggacgtgtcagcggcctcaacgccggcaacgccgccagcatcccctccaagtgcggcgtcaacatcccctacaccatcagcgcctccatcgactgctccagggtgaactaaacctagctagacgacgacggcggcggcggccgcctgatcgatcgatgatccatttccgccgtcgtcgatcggcgccggagcatcgatcatgactccatgagtatcgatctatatc

SEQ ID NO: 73430 - DNA, 586 bp, Triticum aestivum
  Clone ID: PAT_TA_73430
gccgaccctgcgccgcgcgccgcctctaccccgaccaagttcactatccgacccgccgcgccgcagtctagaagtctctgccggccgtccgcgctctgctctccccacccgcatcccatggctgtcgtcgaagaagacgcggcgccgtctgcagatcccgccgctggtgacatcgcctttgggagacgtcctgcatcacgtcgacaaggttagccatggccagtttgcctttaccacggtggaatctggcaattaccttgcctgcttctggaccgagactctggagaagggaatggtggtcaaccttaaccttaacagggatcgcagcaaaggactgggactccattgctaagaaagagaagcttgatgttccagtggaagaggcttctttcgtgcattctgaacctccccaggatggcagcgccccacccgtggtttcctctgacatggaggtgcttcatgacaaggttaagaagcaagtcatcaaagaaggccatggcaggaagcccatcaagttcgcgacgtgctttgcatgcatcgggggcggcatccaaccatgtcggagggtcgccaggatcgcacgacg

SEQ ID NO: 73431 - DNA, 407 bp, Triticum aestivum
  Clone ID: PAT_TA_73431
ttcccagcattataccagcaagggccaaagaatcttttctttgattggtaccggatccttggatggatggggaatggcctctactcctctctggccatattcttcctcaatctctgcatattctatgatcaggcaatccgtgctggggggcagactgcagacatggctgcagtgggaactgccatgttcacctgcatcatctgggctgtcaacatgcagattgcccttacaatgagccatttcacatggattcaacatctctttgtatggggcagcataacaacttggtatatcttcatcctcgcctacgggatgacattgagatcccgcgacaactaccagatcctgttggaagtccttgggccagctcccatatactgggcagcgacgcttctggtgactgctgc

SEQ ID NO: 73432 - DNA, 418 bp, Triticum aestivum
  Clone ID: PAT_TA_73432
tcggcacgaggcaaaggggcctacttaacaaggaatcagaggaatctgatgaagaagagaactacttctctattgagttgacaccaagtttgtttacatctgctgttgataacgcataccagtcgatacatgacttctcaaagcctttgatcaacatgatgaaggctgcaggttgggatcttgatggggctgctaatgccattgaacctggtgtggtttacacaagaagggcccacaagaagtttgcttttgaatcctatatttgccaaagaatgttcagtgggttccaagaagagagctttgctatcaaggattctaacatcagtgtttccaatgaggctttcttccatcaattcctcgcagtgcgagccatggatccgctggatgtcctgagccagaacccggactcagtattcgg

SEQ ID NO: 73433 - DNA, 533 bp, Triticum aestivum
  unsure (1)..(533): unsure at all n locations
  Clone ID: PAT_TA_73433
gaattcggcagagggtgatggtggttaagcggagaggtggtaaggaatgggacaaagatatgcctcacagcgaatggataaacactgttcaatcagaacctgatgttatctcaatgtccttcttacctatcacttctttgttgaacggagtacctggctgtgggtttctcaaccatgcaattaatctgtacctacgctataagcctccgattgaagaactacatcaatttttggagttccagctaccaagacaatgggcacctgtgtacagtgaccaccctcttggccctcaaaggaggaaacagagcagtgcatctttggccttaagttttatgggaccaaggctctatgtctgcactaatatggttgatgtgggtgaaagacctgttactgggattcggttgtatcttgaggggaagaagagcaacatgctgggtatccaccttcaacatctatgctcgcttcctcanatcctgcagctccaggatgatccatacaaccaccgaactccagaaccatatgaccgcaagtac

SEQ ID NO: 73434 - DNA, 459 bp, Triticum aestivum
  Clone ID: PAT_TA_73434
gaggctggaatgaagaactgaagctctctgttcctcagcactatggacctctgaagctgcaagtgttcgatcatgacatggtgtccaaggacgacctcatgggacaggccgagatcgacctccagacgatgatcaacgctgctgcagcattcggcgacccagagctgctgggcgacattcagatcggccggtggctcaagtccgaggacaacgctctcgtcagagacagtgccgtggtggtctctggcggcaaggtgaagcagggggtggcgctgaagctgcagcacactgagtccggtgagctggagttggagatggagtggatgccgctcgtgtagaaatctgctgtcaagatgcaacttttactccgaaatttgaaatcaaaattatctgcctattgccaggtaatgggtgttgtacaatggatttgtattgcttttgttgccgcaagaatatgca

SEQ ID NO: 73435 - DNA, 454 bp, Triticum aestivum
  Clone ID: PAT_TA_73435
tcggcacgaggcaaagagggaaatgcaggcaaagagagcgggggtggcaagagcagcagcggtcatgcaggctacggcggcggtggccactaccaggcgatgcagccggtctcgtaccctgcctatcagcagtacaaccccatgccgtcctaccccgccgtctactcctaccctgcagcttacccgcagcaagaacatgacccaggatgcagcatcatgtgaaaaactgtaaatcaacatcgcacaagataatcagctggagagttgattatattgaaggtggccaaacaaatggagattaacttggttgggttcgccaggacaagatgctgccttaacctgtttgtgcaaggctgctggatgatgatccaggatggatgtgatgcttagctgtgactgcgaccatcatcatccgtgtaattatgtacagggttggacagcaaaggtgggaaca

SEQ ID NO: 73436 - DNA, 391 bp, Triticum aestivum
  Clone ID: PAT_TA_73436
gaatttcacaattagtctgtgatttgattcatttacagtaaagttaaaaagcaaaaccaagttaaaatgaaatttgcttcagttctgtgcataatctttttcatttcttttgcagctctttttggtgatagttcatgctatcgcatgaagtcggagatgagatcaaaacggcaagtcgataacgctgagactggtaaaaccacgactgctaagccagttaatattgaagatatggttatgggtgcaacaacttccaagacatacacgtaataacgatgtgttatcataatacattggacttgtaacattaatagtcaatttgtgaaatttgaatgtcatgatgttcataaaatgaaattcatttttcccaataaatgaaataatttgaatt

SEQ ID NO: 73437 - DNA, 450 bp, Triticum aestivum
  Clone ID: PAT_TA_73437
atggtgtttcgttcttgggattcatagcagaacagaggaggaaagctgaagaagatgacaaattagtggaaggaacaaagaagcaacacaccgcagtttatgatattgatcattatttcatgatcgtatgatatcaaccttgcaagttcatcaattagcagctgcaacactgatattcaaaacaaataattttgttcgacgtatgaccaatatctccaatgaatccaagaaatttgaagcattaggcaacacattgctatgcttgaaggcatgagcttccttatttcttcaagaagatttcagcattgtcacaaatgtcatcctggtactctgcctcgattcaacatgttgaacatcaagtatgcttgagaagttgagagcatgagcgtccttgtttcttcgaaaatatttcagcactataaaagagcttcactgttacgctgcctggat

SEQ ID NO: 73438 - DNA, 547 bp, Triticum aestivum
  Clone ID: PAT_TA_73438
gaggtggcagtgctatcagctatggtgtgtacttctacaatgctacaagaggtagcttgaccacacttagttctctcactttcttaactcctatgtttgcttccatttttgggttcctctatctgggagagaccttctcgcctgtacagcttggtggcgcgcttctaacattggtcgccatctatatggttaactacaaaagcatcgtaggcgagaagtaaaaggccgttgcaagattcttctggagacactggcacagatgaatgctgtactgaagcacctgtaacatttcattggcgcaaaacagcaatgtgaagatttaaagtacatcccacggtcccaacatctcacacagcttgaactgtgaaagaagacagggatatggtggtataacctctgaacatagttagactggtaatttgggcatcagtgcatacttccgaggttcccaagttagtcatctacttcatttcggcttgcattctgaaatggataaaacttgagtgtcatcagatggttaaaacatagttgctatgaactgtgttgt

SEQ ID NO: 73439 - DNA, 554 bp, Triticum aestivum
  Clone ID: PAT_TA_73439
attcggacgagggcccatcatctctctcagcccttctgtagctgtagaaatgtcgaagatggctgcgcagactgttggtaattcagtatccgagttcctgtcaggcttcagtgacacgaagacagattcggcagcgagagtttctttcaagtatgggtgcacgaggggagtttatggcgcgccattcttctttgtgaatggtttccttcagcctgggggtggatcgcctatcgactacagcacatggatcggcatcctggacccccttgtttcccagaatggagaacgaattgagatgtttacttcgatgtaacgtaactaagtgcttgaagtggccttattatgaaggatacagtcgtacagatgttttggccagtgctgaacggctgataagcaaacagctcttatgccagttgtaagctctgcagtatacgctgatgaatatcataccactttgcctgttgtattgttaagctagcatttgtgtgagactggctaaactaatggataaagcccttgcatatagggttataggagcctgcaatatgttaaac

SEQ ID NO: 73440 - DNA, 318 bp, Triticum aestivum
  Clone ID: PAT_TA_73440
cggcacgagggccaagccaacaatgatttccgtgcgtctccaggaggcatctcgatcgccaggtatagctagctacttgcaagaggctggaagagtagttaccgcaatggcgcagccacagccaagaagaggagacgaagggctccaggcgcaggggggcaacggcaaggccccggcggcgcagcaggatcccatcaaatatggcgacgcgttccctgtcaagggcgagctggcggggcagcccatcgcgccgcgcgacgccgcggccatgcgctccgccgaggacagcgtgccgggcgtccaggtcccgcaggagag

SEQ ID NO: 73441 - DNA, 553 bp, Triticum aestivum
  Clone ID: PAT_TA_73441
ttcggcacgaggcaactggttgtatgataagtgttccatacccctttcagtggggtgctccaacatttgacgctggagaagcttttgcaatgatgatgacttcattcattgctcttgtagaggtttgtttccaatactcaactggaaatggaagtgaaaactgcattagaccaacatatatgatatcaatttatgagtagtgtacaaatttgataagttttaatcctgtagtcaactggcgccttcattggtgcttcaagatatgcaagtgcaactatgattcctccatcaattattagtcggggcgtgggatggcaggtaaggattcaaatattgtactgtgggctcagtgatctgagtttataccatggtgttggtaacattgttaaatgtgaaacatccttgtcagggcattggcctcttgcttgattcattttttgggacagccaccgggacatcagtttcagtagagaatatcggattgcttgcattgacacgtattggcagccggagagtagtacaaatatctgcagggttcatgattttcttctct

SEQ ID NO: 73442 - DNA, 302 bp, Triticum aestivum
  Clone ID: PAT_TA_73442
attcggccgaggagagagagagatagagagagagagagagagagagagagagagagagagagagagagagagagagacaactgcggcaagagcgcccaggggagcacggaattctgcaaagcccatggtggaggaaaacggtgcacttggagcacagggtgtgaaaagttctcccgtggcaagagtggcttctgtgcggcacatggtaccttgatggccaggcagcgagaacaagaggtggtgaagaatgtaggaagcatgattggaccaggtctcttcagcggcattgtggtgtcatctgc

SEQ ID NO: 73443 - DNA, 129 bp, Triticum aestivum
  Clone ID: PAT_TA_73443
tcggacgaggagcgattccagaatgtggtagtggaagtgcggattgatttgatttggtttgttgtgctccacgattatcagttcagaatgttagataagtgaaggttggctggttaggtagcaggaagt

SEQ ID NO: 73444 - DNA, 531 bp, Triticum aestivum
  Clone ID: PAT_TA_73444
attcggacgaggaggattcccgtcgcccgttcggatccacatccttcccgagcgagttcttggttgacctcttcctcttcgaccacctcctaggctcttggtgtagcttgccactctcaccaatcaagttttcatgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggtcattcaactccagggtgatcagaggaagaacgtctctaatttccttgtccaggccggcattgtgaagaaggaacacatcaagattcatggtttctgagcgaccgccgggtccatagcaagccctgcatgcaaagcagctatatatct

SEQ ID NO: 73445 - DNA, 533 bp, Triticum aestivum
  Clone ID: PAT_TA_73445
attccggacgaggccggcgccgctcactcctccccttcgctccgttcccttgcgccgccgtcgccgtccacgcgccgccgcccctgccgagatggccccgaagaaggacaaggccccgccgccgtcgtcgaagcccgccaagtccggcggtggcaagcagaagaagaagaagtggagcaagggtaagcaaaaggagaaggtgaacaacgctgtgctgttcgaccaggccacctacgacaagctgctctctgaggtgcccaagtacaagcagatcaccccctccgtcctctccgagcgcttgaggatcaatggctcccttgctcggagggccatcaaggacctgatggcgcgtggcctcatccggatggtcgctgtccactcaagccagcagatctacaccagggcaaccaatacctaaggatggggaagagcctgtatctgccctctctgtagtaggagctcgtcatctttagagcagttgtcatctttgtcaagagtttgctaatattatgttacctgtgacctgtggctga

SEQ ID NO: 73446 - DNA, 417 bp, Triticum aestivum
  Clone ID: PAT_TA_73446
gaattcggcacgagggcacatcatgtgtttaatgcaatttcatttctttatcatttgtttggtttatcaaacagggagacaaaatagcattcgttgaggcatacgatgaatccctagcacatttaatatatgcaggatctgatatcattctttgctcttcctttgaagatccatcactgcaaacagcgatgaaggcaataaagtatggttctgtgccggtacaattaaactttcccagcgatgaatcaagggagttggaggggcatgattgccccaatacagcaatgtctcagtacatcatctcaacctatggagatctgtctctttctcaaacactggatgactttaacaatgacccttcacattgggatcggcagattaaggatgggatgggtaggggttcgtcatgggacatga

SEQ ID NO: 73447 - DNA, 569 bp, Triticum aestivum
  Clone ID: PAT_TA_73447
attcggacgaggcctgaacccagtgaacaacctgccgctctcggccttttgtgggaaagaagtgaacaatcttccggtctcagccttttccggaaaagcaacaattgggcccgtccatgtgtccaaaatgaacattgcagatgatgctgaccatcatgttcacgaacatcgccatatcgatggtggccatgaccatttcgattcgaggaacatcggcttcctcttcctagaggacgccttgacacctggatccaaggttgccccttatatcgacccggctagcagccgaggtgctcctttgctgcctcgtgatgtggccgattccatcccgatgtccacaaagagcttcacggacatcctcagaatgttttcaccggtatcacgcgccatggcggagagcatatggtactcgctagagctgtgtgagcaccctcgccctatcaagggcgagaagagggggtgtgtgacatccatcgagtccatggtcgatttcgcagcgtccatgctcgggacaagcgacctccgggccttttcatccccaagcgtccccgtcgaaggccgtaatgctt

SEQ ID NO: 73448 - DNA, 478 bp, Triticum aestivum
  Clone ID: PAT_TA_73448
gcgaacggattaccaacatgtgaagacaactttctccaatactccacctagcaaaagagaggtctgtcggctattaccctgttcgaatggtgatcagaaagggttccgggattttatatcctatctgaaacagagagaatgcgccggtgtgatcaagattccatctgtcaagccattgtggtcaaggctactatttatccttcctcccacgcctgaggcctgtgggatgctagaacttccgccccatccgaccgaatgcctaattgcactgattttgccaaaggagacgactgctgaagcgacctaacatgattgtagcgtagacacattccgtaacctcgttgcttccagtttcgtgcacagtaaacaattttgcatgaatgatactaagttcctacagctgcttatgaataatatgcttccagtttcgtgcacagttaacaaattttcatgttttcttttgacgagacaccaatac

SEQ ID NO: 73449 - DNA, 577 bp, Triticum aestivum
  unsure (1)..(577): unsure at all n locations
  Clone ID: PAT_TA_73449
gattcggacgaggagcgattccagaatgtggcagtggcagtgcggcttgccttgatttggtttgttgtgctccacgattatcagttcagaatgtcagataagtgaaggttggttggttaggtagcaggaagttccctgatcaatctgttatttgtcaaaatgtgacaagcatacttatctctttgttttgtaatgtggtgctatctagctgggatgtcggtagcggtcgttgtagtggctgcggcgacgattgcttcttccttggatgggagccaccgttcgccgaccttgctgccgccgacgcccgcatatccttccatgtctgtgtgccagaggtaaacggcagtttctttctgttcttccaccgtttgtgctgatgaatgttgtgcattccctccttgtttgagctcggccatggaggagtcaccggtatctctgggctggcggtgctagaacagtacacacggtcgtgttgccggtggagctggacggccttttcagggatttgtgngatgcaagcagcagcagaaacagcgaccgagcacgtccgattccagctacgttcagcgtcatgtat

SEQ ID NO: 73450 - DNA, 203 bp, Triticum aestivum
  Clone ID: PAT_TA_73450
attcgcactagaaaaataacacataactagtttgtgaatgactggatttttgttgcgatggaggtggatgtccctgacaaatacctaaacttcttccttgaagatggtaacgagtgtgcactctgagaaaaggtattactacatatttatttttcatagacataatacgtaattgtgaaattacttaagttgtgcttacattt

SEQ ID NO: 73451 - DNA, 209 bp, Triticum aestivum
  Clone ID: PAT_TA_73451
tctctctcaccacgcatagcccacagtcccacgcgacaccaactgaattcagctctgctctgcgtcggactcggatccaagcaagcaaagcgtctccatggcttcgacgacggcgtccaacctgggcggggcgtggttcggcgagctggcgtcggcgctgcaggggacgtggcaagcggtggccgcccccgccggcgaggacccgcggc

SEQ ID NO: 73452 - DNA, 571 bp, Triticum aestivum
  Clone ID: PAT_TA_73452
agagtaccatgtatatgagttctttaagatatggaactgttctcgagaaagaggtgtgttaatggcttaatgctatctttgtttcatttggaattacacatattagcgttttaaacatacaactcatcatatgaaatcaagcactggtctgaaactctgcagctaattttcttgtccacgagttcttcacaacccaatacttccaagatggtattcatcctatcccaggggctagagatgctctccaaactctttcttctttctgtagcttgtctgtagtaacgtaagtcatttgtttgatataagagacaaatcaatttgcctttcattatacgagtttgcctaataatatacttcctttaaaagatctcggcaggatgtgattaagaatcacacattggaatggattgagaagtattatccaggcttatttgagcagatccatttcgggaatcatttcgctttggaaggtcgatcaagaccaaaatcagagatttgcaggtcttttggcgctcaggttcttatcgatgacaacccgagatatgctctagagtgtgctaatgatggcatg

SEQ ID NO: 73453 - DNA, 451 bp, Triticum aestivum
  Clone ID: PAT_TA_73453
acattcctttggacgaggacatgaaaggcaaaggaaaagcagcaattgatgtggtctgcaacccattggggaagtctggaggcgccttgatccagcagttcatgatcttatcatttggatctctcgcaaattctacaccctacctgggaggaattctattggtaattgttcttgcctggttgggtgctgtaaggtcccttgactcacagttctccccactggcaaagcaagagcttgagaaggagaaaatgctgaaagcaaagacggtcgaaacaactgctcaagttgttgggtcaggaaatggttctctccaagaaactctagccagtgagaactctgcgaatggttcggccatcaaacagtctcaggaacctgagagtacgacctcggagaagtctggtcaacaatctcaataagttctttgccttgcaaatttagttagtataagtct

SEQ ID NO: 73454 - DNA, 416 bp, Triticum aestivum
  Clone ID: PAT_TA_73454
attcggacgaggcgcgctctctgttggtgcttagtgaatttgggtaggcagaacaagtgatactgttccgcttaagatttttggggtgggactgatggaggtagcatatgttttgaacattctgatgcagcaggagaattagatgattctttttgagttccgaacatggatatacccatagggttatttttggcagtactaacaaaaaatcttattggtcactactttactatgcatggctgtttcgttatgttttggacattctgagccagcaataaaatctaattttggctttactaaccacaaatcttatgagttctggatacaacagtgaatggcagtttcgcttcacaattccagaaaacaaagcatggaatcaaattattgcttggtttttgcacctctgaacattcctt

SEQ ID NO: 73455 - DNA, 295 bp, Triticum aestivum
  Clone ID: PAT_TA_73455
agccatcctgatagccctttcggcttctccatcctagtagtttaggatttcttgcaattccattttggcacttttcttctgacctatttctctggctgctgcttcctgataatcgaccagttctctagtcttgctccctgcactcctccctcctccatctccggcacagtgttctgaccaacctgctccaatgggtgtcttgtctgctgctgaccctcccccagtctcagcaattgggtttgagggctatgagaagcgccttgagatcactttctctgaggcacctgtctttgct

SEQ ID NO: 73456 - DNA, 421 bp, Triticum aestivum
  Clone ID: PAT_TA_73456
ttcggcacgaggtcaagtcagatggtaagatcacagccttgcacattgatcttgggatcaatgctggaatatcgcctgatgtgagcccaatgatgccacttgctatcataggttctctcaaaaagtacaactggggcaatcttgcatttgacaccaaggtctgcaaaacaaatgtctcatcaaaatcagcaatgagggggcctggagatgtgcagggctctttcatcgctgaagccatcattgagcatgttgcctcggcactttcagttgacactaacaccataaggaggaagaaccttcatgacttcgagagccttgtggtgttctacggagataccgcaggtgaagcttctacctacagcctagttaccatgtttgataagctggcctcctctccagaataccagcgccgagctgaaat

SEQ ID NO: 73457 - DNA, 512 bp, Triticum aestivum
  Clone ID: PAT_TA_73457
attcggacgagggctgcaagatctgtattccgtccagagttcatgaatcgtgtagatgagtatattgttttcaagcctctcgagagagaacagatcaacagcattgtcaaattacagcttgcaagagtacagaagaggatcgcagaccgcaaaatcaagctcgaagtctcacctggcgccattgaattcttgggaagcctggggtatgacccgaactatggtgcgaggccggtgaagagagtgattcaacagtacgtggagaacgaactcgcaaagggcatccttagaggtgatttcaaggacgaggacagcatctttgtggacacccaggttacggtgccctccaatggtcagcttccgcagcaaaagctagttttccggaaagtgggtgagcaatcgaaggccgctgctgaagacgagaagttcttgccggctgtgtgatggagtacggttgcagttttacagatcttgagcaataaaatgtacatataacggtgacaataaactggtag

SEQ ID NO: 73458 - DNA, 570 bp, Triticum aestivum
  unsure (1)..(570): unsure at all n locations
  Clone ID: PAT_TA_73458
gcgcggatgcagacaccgaacggttcctggatgattcgatcgagcagagcgacagactattgatgcaagtgtggcaatcgctggtgtcatccgtgttgaacgtgttcatgacgaagacttcgatcaacgggttgctgcggagagggtccatgttcgtgttttccaccgaccagatcagacgactgctgaacttgacgtttttcgacagtggcacaacgctggtcgacttgggtgccggcgacggagctactaccgaaaaatacgcgcctctgatccgcgaggtctacacaaccgaaaagtccggcccgatgatccggatcttgactcaaaagggattcagattgttggacgtcgatacgtggtggactcgcgaagagaaattcgacgtggtatcgtgtctgaacttgttggaccggtgtagcgatccggcgaagctcttggacganataaaaagcgcagtgaaacccaacggcaggattgtcgtggcgctggtgttgccgtacagacccttcgacgaattcagatccgcgataccggaacaaaagttgccgatcaccggcgtgacgttcg

SEQ ID NO: 73459 - DNA, 215 bp, Triticum aestivum
  Clone ID: PAT_TA_73459
tgtgtaagctttgctcaatggcggaggagaacaagtccggctccggcgacctgatggcgagcggcaaggtggtcgcggaggcgaccatgtcggtgttccagcagaagagcgtggagggcgtcgacaagaaggaggtcgccggcgccgccgcggacctgctgcactcggcgtccacctacggcaagctcgacgacaagccggtcgggcagtacatc

SEQ ID NO: 73460 - DNA, 318 bp, Triticum aestivum
  Clone ID: PAT_TA_73460
cgggcggccgctcttctcggcgtccgcgtggcgcgccgcggaagagaacaatcagagtgacagctgcaacgcggacggcagcaggagcagcggcagcggcagcggcagtgaggagagcaatatcagctgcagcagctagggctaggtatcccaattcccgtcgtagtttttactgtaaattcggtgagggtagcgcggttggttattactgtaaaatcgcggtgcgtgcgtgcgtgcgcgcggtccaaatggtttgcatcggtcgtaaatggtagactgaaatgacatgaaattctgttaagcgtgtcgtcatagttg

SEQ ID NO: 73461 - DNA, 542 bp, Triticum aestivum
  Clone ID: PAT_TA_73461
agcttgcagtgacaggtatcaacaagaaaaattgccaagagttttgtttgtgccttgcccatctcagctctttggaatcactctcagtgcgctcatgggagaaggaaggtctccgtggctgcttggatagtctgtctatgcctccgaaagacctccagagcctgaagctgtttggcactctgggcaaactgccagaatgggtcacgggtctccagaatcttgtgaagctgaagctggaacgcactaagctaacagagctggatgtaaccatgcaagtccttggcaagctaccaaacctggccatccttcgtctactgaactactctttcagggcatcagagccctatcatttaacttgctgtagggaggcattccctagtttgacagcactggagctgcaatacgctggcatcaaatcagtgctgtttgaagcaggaacagcgcctaagcttgagctgctgctttgccaacatgggatcacattttctgggctgtcatctctcccgaaactcaaggaagttatgattgataataagtatagt

SEQ ID NO: 73462 - DNA, 249 bp, Triticum aestivum
  Clone ID: PAT_TA_73462
attcggacgagggacacatgcacacgcacttcgtcctgtaccatgatcccgtttgcttgttcaggagtccagtatgtatgcatgttttcagtgtcatgattttcgttctacggatttggtgctgtaagtttaattcgccgttgctgtggttcttgggtcatgaagagtgtctgtaaacgagtcgcgtggaagtgttctttgttataataaagttggtaaagcctaatatatagcatgtagcttgtggcc

SEQ ID NO: 73463 - DNA, 479 bp, Triticum aestivum
  Clone ID: PAT_TA_73463
tgcggctgcaggcgacgcggcgccgccgaagccagcggaggaggcgcccaaggagaaggagccggtgcctgcgccggcgcccaaggaggaaggcggcaagtcgtcgtcggaagggtttggcctcggcgacgtcgtgaagggcgctgagcaactcgtggagaagcagggcggcgccggggaggaaagcgccgccggtgggctgtttaagatggcgcagggcttcctcaagtagatggaactcgatcaaagctccatccacgcactgctcttgatttgtctgcccaacggcaacgtgtagctgtgtatgtctgttatgtaattattaacttcaaataatgttgccttcgctgtgtgtgttcttcaagatgtttgtgtaataataaccgagaacgttgtagcagtggtggcagtgtgcttttcgacctgtcttttgataatttaaaaaacattgtatgttgtataaaaaaaaaaaaaaaaaa

SEQ ID NO: 73464 - DNA, 438 bp, Triticum aestivum
  Clone ID: PAT_TA_73464
gattcggacgaggctccgtcatactatgacttctccccggtggttagtcatcgcagcccctcccctcccccctcctctccatggctgccacatctcgcacgccctccgttcgcctctttctcactagtgaacacgccaagaacggcggtgacatgctcaatttcatgctcctcttgagtttgagtgtgagtttcagtgacgggcatcggggccggagccggaagtgaggcctccgggaagtcgtcggggtagggggcgggcgggggggctgaagcgcgggcctccaggtaggaggcggagggcgtcagatctcgcgggtagactgcgctggcactggagctggcggcggccaacctcctctgcaatttctgcaagatcgaagcatggaattggccaacagcctgggttcttgttgggatggcgggttgcctccatctt

SEQ ID NO: 73465 - DNA, 341 bp, Triticum aestivum
  Clone ID: PAT_TA_73465
attcggcacgaggacttcggcgaccttggcggcgacgactggctcgcggggatcaacctcgacgacctgcagatgcccggggacgccgacttctttggcaacatgctgtcgccgatggccgccaagatggagcaggacgccggcttccccttcttctgagatcctctgcgactccgaggacggattcagctcaactgtgtatagttcagatttcttcaggattcagagaaaacaaacaaaaaacaaattctgctaatatctggttgtagtggtgtagtgcagaagtagcagtatgcttggtcagttattaagattgaagttcattgtagtactctactgat

SEQ ID NO: 73466 - DNA, 532 bp, Triticum aestivum
  Clone ID: PAT_TA_73466
attcggacgagggttgcttttctgatcatctgtaaaacctggttcacctctgcttgtcagtgtgtcactcttatctcatcttccttctccagttgtggttgatcagctggaggttcagttcaatcaatctgactgtaactttgtgatacatagtgcacaggaagattctcctcctttagattcaaatttgcacgaccaaattgttcaagatacttcttctcttacactcttcaccaacagatggatgcggttgacacatgagttaaaatcaggacagagtggaaagctagaatgtttgtctgtgaaggcgacaataaacaaacaccttgtgatttgctgccatgctgaaagtcctgcgtccatggaagacttcccattatggaaatttgagaaccaagtggagacactgcccacaaaggacactgctcttgccttttctggacagaagcttattcaagttgaagagccagatgctcaagttgaccttgtcttaaattctgctggccctgctttagttggagagttatttact

SEQ ID NO: 73467 - DNA, 496 bp, Triticum aestivum
  Clone ID: PAT_TA_73467
aaagcagcaactgtttatagttgcttccttggaacatcggcaaacctgcgatatcaggttatagctggtctgattgagcatcggctacgagaggatctgatgacctactataaccagccacttcttgctagcctggtgtcctttgtttcaaggacagttaactcatactggggaacacagcaatggatcgatcttgcacgagctacaagcgtgcaaagtactaagaaagagctgccttctcctgaggtttcaagcgcaactgaaatgccactgctagaatgtggcacgaccgaagtacagaatgtggacgacagcagtaataaccaatcaaatgacttgacatagtcacctcacagtgtcctaatttgttgcggccatacgaacaaaacacagagcagcttccttccatgacacaccaaacatgatacaactgtacaggcatacagacgatatgtcctcttagagccagactgaagctttagccatcgcgtcatgt

SEQ ID NO: 73468 - DNA, 370 bp, Triticum aestivum
  Clone ID: PAT_TA_73468
attcggacgaggccgaggcggccaacagggccgccgccgccaaaggcgacaagaagaagggtgaggaggctcatccgagctgatcgccacacatcagatcgatactcctgtgagctgtgaactttgtgatggtgtggatactactgatgacaagtactacatggaaacagactcctctccatgcactgttgtactcagaaattgagaggaatgtttgatctcttataacttctgctcgtcgtgtgtagcccctgtcactgttgtgaactttgtttgtaggttttgtcttgtcggtgcaaagggaggcgcccttgagcctcttatatgtacacagtttatcaataataatgaataatatagtcccttcgtt

SEQ ID NO: 73469 - DNA, 382 bp, Triticum aestivum
  Clone ID: PAT_TA_73469
attcggcacgaggcatggagggcttacaaagcctgactatgcaacttgtgtcttgatctcaacggatgcatccatcaaggagatgatccccccaggtgctcttgttatgctcacaccactgatcgttgggattttgtttggggttgagaccctctctggagtccttgctggtgcccttgtctctggtgttcagattgccatttctgcatccaacactggtggtgcctgggacaatgccaagaagtacattgaggctggagcttcagagcatgccaggacccttggcccaaaaggttctgaccctcacaaggcagctgtcattggtgacaccattggagatcctctcaaggacacgtctggcccctccctcaacatcctcatc

SEQ ID NO: 73470 - DNA, 386 bp, Triticum aestivum
  Clone ID: PAT_TA_73470
tcggcacgaggcaactcagtcattccgtcagctttacctgcagcattgtcctgattctgacacgtcatctcagtcgcttccggggtgctgattcttgctgcaaaattcaccattttaacaatgatggtggctccagtaagctccaatgagaaatcttatctggtaccaaattgacatgtggatctgatctcgtgaacataattcaccatgatgataaaataaggtgtgacaactgcttgtaagaagagagaatcggcaaccccagaatgtgagcaattatacttgctgagtgtacagggaggttggagtagttttggatttgcctacttttgaggcacgtaatgcagtcataggttacttctgttcaatagttgatgtgttgctct

SEQ ID NO: 73471 - DNA, 527 bp, Triticum aestivum
  Clone ID: PAT_TA_73471
gattcggacgaggacccgtcggagaattcatcgaagcgaagcgaagcgaagcgaagcgaatcctcccgatcctctcaagatggagatcttcgttaagaccctcactggcaaaaccatcacccttgaggtcgagtcctcagacactattgacaatgacaaggctaagatccatgacaaggaaggcatccctccggaccagcagaggctcatctttgctggcaagcaggtcgaggatggccggaccctaactgactacaacatccagaaggagtcgactctccaccttgtgctcaggctcaggggtggcgtgcagatcttctgcaagaccctcactgggaagaccatcaccttggaggtggagtcctcagacaccattgacaacgtgaaggcgaagatccaggacaaggaaggcatccccccagaccagcagcgtctcatctttgccgggaagcagcgtgaggatggccgcacccttgccgactacaacatccagaaggagtacacccttcacctggtgctccgccttc

SEQ ID NO: 73472 - DNA, 448 bp, Triticum aestivum
  Clone ID: PAT_TA_73472
tcggcacgagggacgcaagcgtcctgcacctaaaggtgctacttatggtaagcctaaaagccatggagttaatgaattaaaacctaaacgctgtctgcaatcaattgctgaggaaagagttggacgtcgttgtggaggtctccgtgtcttaaactcttactgggtaggacaagactctactttcaaattctacgaagtcatcactgttgataccgcacacccagccatccgtagagatgccaagatcaattggatctgcaatgctgtgcataagcacagagaattgcgaggaaagacttcagctggtcgcaagtcccgtggtcttggaaaaggacatggtttctcacaaacaaccggtggatcaagaaaggcatgttggaaacgcaagaacaccttgcaacttcacagaaaacgataaatccatttttattatattatgctctttttt

SEQ ID NO: 73473 - DNA, 548 bp, Triticum aestivum
  Clone ID: PAT_TA_73473
gattcggacgaggcttgtggtccttgcattggtcaatgggatcgacaggacactaaaaagggcgaaaagaacactattgtttcatcatataatcgaaactttactggtcgtaatgatgctaacccagccacccattcattcgttgcatctccagaattaacaactgctttagcaattgctggtcgtctagatttcaatccattgactgactctatcaaagatggatctggtaaagaatttaaactcgccgagcctactggtgaagaacttccagctcgtggatttgatccaggagaaaatacctactcagcaccaccaagtgatggatcaagcatccgagttgatgttgatccaaaaagtgaccgacttcaacttcttactccattcgatagatgggacggtaaagatatggttgaaatgcctattttaatcaaaattaagggtaaatgtaccactgatcatattagtgctgctggaccttggcttaattatcgtggacatcttgataacatctctaataatttattcattgctgccatcaattctga

SEQ ID NO: 73474 - DNA, 390 bp, Triticum aestivum
  Clone ID: PAT_TA_73474
attcggacgaggccggcccctcttaatccatccttaaagactaaaccctccataagcctcctctctctctctttcttccaggagacaggtgacaagggggatagatacacaacgatactccgcagcgcaggaggaggacacatccttgatttctgccatcggaggagctcctgcctcggagatacacgaagctgctacatcttcttccagctcaatcgtatcgacgcttgcatctcttttgctcagagtgatcgtcgtttttcacagcttgcaggaaaaaaagggcaagaaagactgagagcagcagaagaggaagatgatgatgaccgaggtcgccaatcacagcaaaaggaaccacaatgaaagctacttcaccgggaaagcagcagt

SEQ ID NO: 73475 - DNA, 423 bp, Triticum aestivum
  Clone ID: PAT_TA_73475
gccccgagctgcggtgggcgttcgttcgcaagatctacgtcatcctcgccgtccagctcgccatgacggccgccgtctccggcttcgtcgtcaaggtgcccgccgtctccaacttcttcgtctcctccaacgccgggatcgcgctctacatcttcctcatcatcctgcccttcatcgtgctgtgccctctgcactactaccaccagaagcatccggtcaatcttctgctgctcggcctcttcaccgtcgccatcagcttcgccgttggcatgacatgcgctttcactagcggaaaaatcattttggaggctgccattcttacagcagtggtggtgatcagcttaactgcttacactttctgggctgcaaagaggggccatgatttcaacttccttggtcccttcctatttgctgctatcatgg

SEQ ID NO: 73476 - DNA, 259 bp, Triticum aestivum
  Clone ID: PAT_TA_73476
gattcggacgaggctctctctctctctctctctctctctctcaatgctcactgtcggagcgtgctgccccatgcttacagaattggacatcagcaactgctatgacgtttcatacaagtcactggaggtgattggccagagctgccagaacctcagggtcctcaagcgcaacatattcaactggattgatccatcagagcatgttggaatagttcctgaggactacttaagagaatgccccgaattaccaaaaaaaaaa

SEQ ID NO: 73477 - DNA, 333 bp, Triticum aestivum
  Clone ID: PAT_TA_73477
agttcggtgtgataagttacgctatctttcaccagccttcactttggatggcgtgacattagagcagaggtgttcaagattttgttgtgcaaagcatgggaatagcattcatagctttgagagcagtcttcagtgactttggtgttgtaacatccaaaggcgctcctgtgatacatatatgagtcttgtttgttactatacaactgttctggaataagggcagttctgtgcaccaccagcaaataaaatggagaggtataccatcatcaaggaagttggtgatggaacatttgggagtgtttggcgtgcaaccaataaggaaagtggtgaagt

SEQ ID NO: 73478 - DNA, 454 bp, Triticum aestivum
  Clone ID: PAT_TA_73478
actgctgaggaaaagggaattcctgaagagaagtacaccaacgccttccttggctttggaccagaggacaccaactttgcagttgaattgacttacaactatggcgttgacaagtatgacattggaacgggctttgggcattttgcaatcgctaatgaggatgtgtacaagttggctgagaatattaaatccaagggtggcaagatcacccgcgaacctggtcctgtcaagggaggatccactgttattgccttcgcacaggaccctgatggctacatgtttgagcttatccagagggctgagacacccgagcctctttgccaggtcatgcttcgtgttggtgaccttgagcgttctatcaagttttatgagaaggccctaggtttgaagctcctaaggaagaaggatgtacctgattacaagtataccattgccatgttgggctatgctgatg

SEQ ID NO: 73479 - DNA, 641 bp, Triticum aestivum
  Clone ID: PAT_TA_73479
attcggacgaggctgaagctggacctgcacgacaacaaggacaagcagaaggtgctcaaggcggtctccactctccacggtatcgactccatctccgtggacatgaaggactcgaagctgacggtggtcgggctggtggatcccgtcgacgtcgtggccaagctgcgcaaggtcggcgccgccgccatcgtctcggtcggcccggccaaggaggagaagaaggacggcgacaagaaagacggcgacaagaaggatggcgacaagaaggacggcgacaagaagacgccgccgccggtcatactgtacccgcaccaccagtggtacccgtacgccgccgcgcagtaccacccccacccgtacccgccgcagtacgtcgtccacagcgccgaggaggaccccaactcctgcgtcatctgctgatgatgccgcttcggcttaggcgcagccgcgcgcgcaggctccgtcttctttttgtaaatctctgtgtagttggcctacctcaggccaggcaccatggaccgccacttcgtcggtgatcgccgggaccgggacaggttctggtggttggctgctctgctcgtctctatcatggcgagggggtggtcgctggcccgtccgcaggtcgttatactacgatggct

SEQ ID NO: 73480 - DNA, 412 bp, Triticum aestivum
  Clone ID: PAT_TA_73480
tagcttttgtgttcccttttccctagttcctctcctaatattcagtagcagttgtgtggtgaaagcaccatacaagaactcaaatagtattgtcaaagtcgcatggattctctccgttgtaattatggggatcaatatttatttcttttgcaatagcttcataagttgccttgtacatagtgaacttccaagactttcaatgctataattagcatccttgtcttcccattcatggcggcatatatcgcagctttaatctacttggctttcagaaaagttaatgctgctgggctattcccatccgtgccagtttccaatgggactgaagtagaagcatggaggcaagaacgcatcgctgatgatattggtgtacattgatatgtttaaaacctactctataaatctatccttt

SEQ ID NO: 73481 - DNA, 361 bp, Triticum aestivum
  Clone ID: PAT_TA_73481
ggcattgctcatgtgaagaagcagatgcttgaaaatgctcacagaagattgtcactgttgagcagaaattgacacggggatggggaggagaaaatgcttatcacgttagtggatatcgttatttgctcgttgatccggagagaagaatatcaagagcctccccacctgtgaaagtcaccaccctggcaaaggattctctacttgccctcaatatgctaagacaagaagtagatctagagaagtctagatacaagagaggtgacccttgtcatgacaaggattttgaagcatgtatcagaacaaaaaataatgcatgggttattgctaaaattagtcgaggaagggagctttacatggcttt

SEQ ID NO: 73482 - DNA, 344 bp, Triticum aestivum
  Clone ID: PAT_TA_73482
ggtcggcaaattcagcgtcatttggaatttccagcaagtcaaggacagcaaccatgagtgctaccgtgatcagcagggcctcaagagctgctactgctacaaagttgtcctcaaggatgaatcgattgtcgacagccgtttcatgcacgagaagtttgcaagcagcgattctccagaagctccgcttgttgttgctacaccaatgaaagtcagctccttcagtatagcaaatcgacgctgactccgaagctcttttacccccgttgtgcaaaatagttttgagtagttgcaggttcttgttcagtttgttccttctttagacggtttggttggttggttggttg

SEQ ID NO: 73483 - DNA, 392 bp, Triticum aestivum
  Clone ID: PAT_TA_73483
gggcagcagctcacgtcggccagttcattaagttcgatgagatgtcggagacatcctccagccatggcggccatacttcggcgggcagcgtccctgtccaggagctacctcgtctacatgagaaagtcaggagctcgatgttcttttgctgagcctctatagcttgctgcttcggcattggcctctaagccttacttttggtggatggttgggtctgaaccctggtagtagttatgtctggtggcagtaaacgctcttggatgctgcccataaacttgtgaacttgttgcggcatttggtgcctgcctctggaagacttaatcaagtaggatgttaaatgttagtttttaagcatcgctgcagttatgttggctgtcttgttgcagtgcttg

SEQ ID NO: 73484 - DNA, 320 bp, Triticum aestivum
  Clone ID: PAT_TA_73484
ctgttcaaccaggcgttcagcagaggtttggagatatctctcatccttgctggcaacaatccaaatgctgggatttgatggtggcagttccggtcttgcttcaccaatctgactgtggacctttcttactttaattaatcctcagttaacagtagcgatgtacatatctgatatctccatgttcaccggcagttgtttgccgtgggtataaatgtgaacggcaatatttctagaggtagcttgtatctgtatttgttcagccggtgtactttgtatgccacatcttatttttttacattgatatatgtgctgattgcatc

SEQ ID NO: 73485 - DNA, 434 bp, Triticum aestivum
  unsure (1)..(434): unsure at all n locations
  Clone ID: PAT_TA_73485
cctaatcatgtcgccatcaagattgcccttgagctcaagaagctgcttgtcgacaacagcctgcttgatgtctcccagagtgatctagaggctaatctattcaagcttatggaaaaacggggatatggcgaggactatataaatcgctataaaatgatgacaaggttccatcatcaaagggttccactagtcattttagtgtgtggaactgcatgtactggaaaatcaacaatcgctacacaacttgctcagaggctcaatttgcctaatgttttacagacagacatggtgtatgagctgctgcggacatcaacagatgcgccacttacttctgttcccgtgtgggctcgggattntaattcacctgaggagcttatcactgaattctgcagagaatgcagagttgtacgcaagggtttggctggcgatttgaa

SEQ ID NO: 73486 - DNA, 228 bp, Triticum aestivum
  Clone ID: PAT_TA_73486
aacggagtaccgcgccagagcaagaagccacggatggaggtgcctgaggacgacgaggactacttcatcgttcctgatcttggctgagatgagagatctttgcatgattctcctgtcatgtgatgtgtgtatgtatgcaaaatatgtatgtatgccatcatgagatgcactgacgcttactggacatatgtactgtaattataaggcagggccatactttcagcctga

SEQ ID NO: 73487 - DNA, 417 bp, Triticum aestivum
  Clone ID: PAT_TA_73487
cacaatacatcagactacaacaaccctcatagcagatgcagccagtaaagatgaaatccaagcgagggttgcacagctaaagaaggagcttgctgagactgattcagtttatgatactgagaaattggctgagagaattgctaagcttgctggtggtgttgctgttatcaaggttggagccgcaactgagactgagcttgaggaccgccagctaagaattgaggatgcaaaaaatgccacttttgcagctatagaggagggcattgttcctggaggtggtacggcatacgtgcacctatctaccgttgtcccttcgatcaaagaaaaaattgaggaccctgatgagcgccttggtgctgatattattcaaaaggcattggtagcacctgcttcattgattgcacacaatgctggagt

SEQ ID NO: 73488 - DNA, 307 bp, Triticum aestivum
  Clone ID: PAT_TA_73488
ttcctcccaagcgtgtatcagggcaatacaactctattcgctagaagattttggcatgttatgctgagaaatcctgaaagaccaaattttcctagaattatgtttgtcacagagcgaactgtgttatttgagcatggcctctgagaggtattttgtcatcttagcgccatggctatatgatataagagtaccccggtgctaaagggccaatttctggggggcattatatatattatattaatctccctgtacaagtgacttgtctatatttttattaactgtctaacggaaagaacagtttcagttg

SEQ ID NO: 73489 - DNA, 407 bp, Triticum aestivum
  Clone ID: PAT_TA_73489
tttcattcaggtttttggaaatgacaagaggtattggttcatccctgcgtactcagaagaggatttgagaagaatgccagttctacagggccttgattaccctgtcaggacagatttggatgggcaagaattgtgatgggacaatttcgcctgtgccctcacttcccatatgcaccaaatatgttccatgtaaattttacggtttccttccgatatcgtagagttaaatatttttaaaggtacaccttagtactgacagcattgctggttgggtactacatggcctccgaagagagtgttcccagaattacttttcaaaccctgtgtaattcacttgtgctgtctgattgggcaaagaacgtagaggtcttgctattgtggctaaaagaggcatgtgatgtaaattc

SEQ ID NO: 73490 - DNA, 255 bp, Triticum aestivum
  unsure (1)..(255): unsure at all n locations
  Clone ID: PAT_TA_73490
gctttgttaatttcggttgcgttgcgtgacgtcggctgcgcttgctctcgatcgatgtgataagcacaagcacagctgcgtcggttcgttcgttcggtggtatactacacctttttctctcagttcagactttttcgagagggagctgattttcgtggctccggtgctattcatctgtccatattttgcgacgcagagacgccggattaagaacagaagaacggctgcgatgtagctatctatacatagcacntt

SEQ ID NO: 73491 - DNA, 358 bp, Triticum aestivum
  Clone ID: PAT_TA_73491
taaatcctcaatggctgcattaattgagtcgtgctgggcgaatgagccatggcggagaccttcatttgctaatattatggatagtttgagatctttaattaaagttccactgccgcagttgattcgttcagactcatagccatttgtatattgaagagtcatatcatgatttgccttgataagatcaacatggagaagtttttcaatatctgacttgcttatacttggataattctgaccacattatttggtgctaagaaaatggagtcttgatttacatttttcaagcaaaacaaaacgtacctggcaactcctgtccatggtttcaagatctgttgatattccttgtatgaacatc

SEQ ID NO: 73492 - DNA, 428 bp, Triticum aestivum
  Clone ID: PAT_TA_73492
gcgcagttcgcactcacacgcacgcacgcgagtcagagcggagcgaccgcgacagccgcctcccctcatgttcgccgcgccaccgcctggccgccggcgacttcccccacgccccgtccagtcccagggactgcctcgctccttcccgcttgtctccctgacatagcccggggccgtcgctcttcctcaatcccctgctcggctgctccccgctgctcaagactgtggattgcctgtctgccactgttgctctagccaggcgacgccgccgctctaatccggccattgcctgaatccggattccccgtctccgcgccgccactctactctggccactccccgactccggactacaatttaattgataaaatagaagataagatatttctcaagcctatagggatcgcagagggcttctacctcctcat

SEQ ID NO: 73493 - DNA, 545 bp, Triticum aestivum
  Clone ID: PAT_TA_73493
ctgccctcacctcgccatggggggagcttctaattctaacctgcttcctcctggcttccacttcttcccatcagacgaagagctcgtcgtccatttcctccgccgcaaagcctcgctcttaccatgccagccagacatcgtccctacagtgtgtatgaatcactatgatccatgggaactgaatggcaaagcacttggggcaggtaaccagtggtacttcttcagccatgcgaagcacagcagggtcacaccaaacgggtactggagctctgtttgtgcagacgagacggtgagcagtggtggctgtagtgtcggtctgaagaagacacttgtcttctccactggagagccctctgaatctgaggggaccgagaccaactggatcatgcatgagtatcacttactggatgggaggaaggggattagcagtagcactacctcaactaatagttcaagcaagaaattgcatcacccaaacacagagtccaataactgggtgatatgccgagtgtttgattcgacgaccggtggatcgcaagcgagct

SEQ ID NO: 73494 - DNA, 400 bp, Triticum aestivum
  Clone ID: PAT_TA_73494
ctcacatgcctgtaagctagctagctagggccggccggccatgcatagtgcagatcacatgcatggccactcgcaccagttgtgtttgcgtaccccactactcatcacgacgcctttcccgccacaaaggcaaaaggttcagttaattagttgatgatcaacatcgatcgttcgtgcaacaacacaatctcaactttacttgcacgctagctagctgtccgtcaattgactgcttgatgtcatcataaactcttttttgtaaatatctgacgcacgcactggcaactcatcatcatcagctaataatctttaattttatatcatgtgtaacacgtcgtctttgtgctatacacaggatcagggtgcggtggaagatggaaacctcggcgaggtggcggcg

SEQ ID NO: 73495 - DNA, 330 bp, Triticum aestivum
  Clone ID: PAT_TA_73495
gacgccgtcgccgcggccgtgcagcgcaggcgacaccactgggcccccgtcctccacctccagcacgatgatgaggtcatttagtttgaaggtagaattttgttgtctcagatcgaattgccgagcggaagcatcgaggattctgtctagcgagattaatgacagccatgtatttgattatgaagtgcattgactcgttgtgcgctgtttcctgtcacttttggcagcctggcctcactctaagtttagggagatgaagctgctttgaagtcgggcggcgacgcggcgctgtgccacggtggcggcggcgaggatggggatggcggcgtt

SEQ ID NO: 73496 - DNA, 389 bp, Triticum aestivum
  Clone ID: PAT_TA_73496
gtagccagtctgctggctaccctgagcttaaaattgctatggccggtagtgtgggcagtgacccactaggtagtttctacagggcgaagttgcgccgtgctaatgtgcacttcttgtctaagccagtcaaagatggaacaactggaactgtaattgttctaacaacgccggacgcacagcgaactatgcttgcgtatcaaggtacttcgtcaactctgagttacgattcagacttggccagtttagtgtctaaatcaaatgtactaattgtggaaagttatctatttgagctgcctcatacaattgaagctatcaagcaagcgtgtgaagatgctcacaagaatggtgcactcattgctgttactgcatcagatgtatcttgcatcaag

SEQ ID NO: 73497 - DNA, 437 bp, Triticum aestivum
  Clone ID: PAT_TA_73497
acttcccggcgcccgttcagatccacatccttcccgagcgagttcttggttgacctcttcctcttcgaccacctcctaggctcttggtgtagcttgccactctcaccaatcaagttttcatgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggtcattcaactccagggtgatcagaggaagaacgtctctaatttccttgtccaggccggcattgtgaag

SEQ ID NO: 73498 - DNA, 396 bp, Triticum aestivum
  Clone ID: PAT_TA_73498
aacatgaactcgatctagatctcaccaccgcttgtgaacgaagctgaatctggaacactgaagagcaccatgcgagaaaccagaccggccccctacgagtcaccgacatcgctggccggctcctcgccgcttgtgaactgatgaatcacggctgatgaatcacggcacatgtaaaaactgaatctggcagagcacaaacgcgtaagcctcttaaggtttggcacctgaagaatttgcagggctatgtatagtagacatgtagattgagaccctgcagagcttctacatgcagaatgttattggtcacttgtgtatcagtactagtaatgcagtatcccttgtgaaataaaggttttcctgctgcttcgtcagtactagtaatgtagtatccctttg

SEQ ID NO: 73499 - DNA, 372 bp, Triticum aestivum
  Clone ID: PAT_TA_73499
gccaggttcctggtcctcaagtagctttgttttcgttaaggattctatatacaagaaacctgacacagctttgctcccatttcctacatatttcacgcaagaaggcgagcctgaagacttggagcccctgattgctgatcttggtgatgttgatccattcatggcagctgattaaaagacaatggacaaagttggcgaactcccttagtgttttatgcactccttgagcttgtctgttccacgagattgtgaaattctcgatggatttgtgagcagttcctgaatcacaagcttcatccggttactggccagcctgatcaatgttgttccatgtacattacctggcaagtataccagggccccaactcaatt

SEQ ID NO: 73500 - DNA, 441 bp, Triticum aestivum
  Clone ID: PAT_TA_73500
gtgtaccattctgttcatttattgaagcttgctcaccaggcgggtagatagtgcattgttgttacttttcttaaaaaaaaaaaggaaagaaagaaggtaggtagtatattcttttgaagatgtaccattgtccaggcatcatcatccccatctccaccattgtgtaaatatatatgtcccaagtgttcccacctttcccttttccttccacgagagttgaggtgggcatgaaagcaccatttttccctcagtctctttgtatgggatcttctgaaatcatgtacatgtatctttcgtggcaacaggagagattgctgtgtaatttccattgtaccaaccaaacccctctgttaccaatagaagtcccttggacagtgtttgtcaaaaaaaaaaaaaaaaacaaaaaaaaaaaaaaaaaaaaaaaaaaaaaaaaaaaaaaaa

SEQ ID NO: 73501 - DNA, 392 bp, Triticum aestivum
  Clone ID: PAT_TA_73501
ttgtgcatcaattccagttatgatgtggttgatcctcatctctcgactccctttgatgatggaaggagtgtggagggaaagatttggctatacgaggatggaaccttcggttttggatttgttggcagtaattcaattatagatctgaggcacgtctcatcagctggttgtattcttgatacttaacattagatctggatcttgctggcacataattttttgccagcgagccccttgtacagtacttttaagaaaattcaatagttggtgtgaagcatgttgcctccgattgttgtactattgatgataaagtcagtaaatacgggtcccttctggcacataactgttgctagaatacccttgtaaaccaaactttggttcctttgggcatg

SEQ ID NO: 73502 - DNA, 570 bp, Triticum aestivum
  Clone ID: PAT_TA_73502
attctctacatagatactaccccgtcggacctactgcagagatgtggtcaaaaagttgttgttaagtttaaatatttacattctgttgtcaatagtggatggcaataatggcaataataaaattatatttttggaacctatggtgaagactaatgagaccctatctgtaaatgaaaatggaactaaaaatgaaattagacctatgagtcttatgttcacagataaaattgttaatgaaactagacctatgagttctatgttcacagataaaattattaatgaaactagacctatgagttttattttctcaaataaaattagtaatgaaactaaacctatgagcgctatgttcctaaataaaactattaatgaaactaaacctatgaagataaatacaactatgaatgaatcactaaatatgaatgaaactgaaactatgaataatgaaacagttcatccacacatacaaaacaactcaacttcaaataatgcagaaggagaagtattgtcactaggtttatttgatgcaacattgaatattgacagatcaattgatagtttgcgatcata

SEQ ID NO: 73503 - DNA, 387 bp, Triticum aestivum
  Clone ID: PAT_TA_73503
tcgctccacctccgatttgacatgcatgtagagatcctgcgcagcctgcttatcggtcaggacgtcctgcctccccctcgtcggaatcggcttcccgaattggtagtagaaccggcccggcattttcagaaacagtcccgggaagaacacctcatgatcaacgtccctgcaaagagcagcattttcaggtagacaagattcacgagtcatcagtgtaagtagttgtcagatcctcacaactcaagggccgggaaagggtgtgtgtacctcagcttcaggtgatcgctatatgcttgcatcatttccttgccaaagggtgcattcctgatatcttcgaaagtacacagcagctgcacaacattttattagttacagaatgcataattg

SEQ ID NO: 73504 - DNA, 430 bp, Triticum aestivum
  unsure (1)..(430): unsure at all n locations
  Clone ID: PAT_TA_73504
ttacggtacaatgtcacatttctgtcacaccttactacatgaagctatacaatattatatttcttttatagcaagttggctgtaataggtgtgagggtaaccagtgcttaaatctgtaccatccaatatataatagctccagacatttgactgcagtctgaaacatagatgtttgagaacccaactgcattaatgaacttcactacgggcaatgagcatgttgtggaaatttataagtggcagattgcaaagagtgagcaaccaacattaatcggcttgagttgcttaggcttcttattgtcttgtagcagtatttttgattgggctacttgaattggatgttcttangcactttctccgaaccttttatctttagcactatttcagatccttggtgttaatatgacgtgattatttcaaatataacatg

SEQ ID NO: 73505 - DNA, 353 bp, Triticum aestivum
  Clone ID: PAT_TA_73505
caaagctgtacatggaggactggattggtctcaagacgctggatgatgaggggagagtgaaattcgtgtccgtgccaggggggcacctgggtatttccaagactgacatgatgaagtacatcgtgccctacttgaagggaaaggacaatggaaaggcttggattgctgcgacttggcgtgccatcaccaacaccatcggtggggaagcgtttgtgctcaactagctactagtactagtatcatgttgcagcctctttcttggctctgatgatgattgtaaaaagatacaggtgtacagtgcaggatacgcgtttcattccctgtgcaagtatatgtattcctcatcatgtata

SEQ ID NO: 73506 - DNA, 395 bp, Triticum aestivum
  Clone ID: PAT_TA_73506
gggcgatggtgactgtggaaccacaatgtatagaggtgcaacagctattcttgaagatatgaaaaagcgttaccctatggatgatgcagcgggaacaataaatgaaattggggcaacaatccgaaggtgatgggtggaacaagtggaatcttgtatgacatactctgcaaggctgcgtatgcaagcttaaagcagagctcaactgtcactgcaaacgaatgggctgatgctttagaggcctccgttgctgctgttagcaaatatggtggtgccagcgcaggataccgcacaatgttggatgccctaattcctgcttctgctgttctgaaacagagacttgaggctggggatgatcctgtgactgctttcgtagcttcttctgaagcagcatcagc

SEQ ID NO: 73507 - DNA, 260 bp, Triticum aestivum
  Clone ID: PAT_TA_73507
ccgcctcctcggctcaccccggcttaaccaccccaccttgcagatccagtgggcgattcccttcctctccgcgtgggcgaaaggatccagtgaactacttccacacactcgctgcttctcccctgcccatggctacgccgcttatagcaggacttgcagttgcagcagctgctcttgccggtagatatagcatccaagcttggaatgcttataaggcacggcctgtagttccaaggatgcgcaaattctatgaaggtggc

SEQ ID NO: 73508 - DNA, 472 bp, Triticum aestivum
  Clone ID: PAT_TA_73508
tcgtctcgccgcggccgatctcctccatccgctcgccgggccgcaacccggccggagaggagactgcgctcggtcgagcagcccagcgtcctcgcgatcagctccggcgcggcgtccgccctctgcagccccggtgtccccgcgaccgtcgctgctgtcctacttcgccactcgccaccttggccggcgacgagcaccaccaggacaccaggtgtatgcggcgatggctcggagcccctgcgacctccgcctcctcctccttgctgccgctgcagctttcatctacatccaagtgcggctctttgttactcagtcccattatgcagatcgtcttgcagaagcagaaagatctgaaaatcaatgcaccagtcaactaaagtccttgatcgatcaagtcagcatgcagcaggagaagattgtagcattggaagagataaaggtacggcaagatgaagaacgtgcacatctgaag

SEQ ID NO: 73509 - DNA, 503 bp, Triticum aestivum
  unsure (1)..(503): unsure at all n locations
  Clone ID: PAT_TA_73509
tattcattaataatcacacaactgtgtggggttcatggtggaaagacatcaatggggctacaagtgctgcaagcagactatcaagaatagttactgcacaggcttggctggaatagaagctgctgaggcatcagcagatctaatgaaggccaatatggcccgcaaggaggccgcagaagatgaacctgtacaacatgaagaaaagcgattagccacttggggaactgatgtgcctcaggatcttgttcttgatccgaagaagctcgcggaatctctaaagaaggagaaaggaaggaggaatgaggagagggatgagaagaaaangaagtataacgtgcactntgacgatcaggttactgtagaagacatggaggcctaccgtatgacgaagattcaccacgatgatcctatgagagcttttctcaagtgaagtgcggtaaataaatgtttgcgctgctgtatcacattggtagcaccctgccttgcagcgatgttgtgtaatt

SEQ ID NO: 73510 - DNA, 408 bp, Triticum aestivum
  Clone ID: PAT_TA_73510
ttcccggcgcccgttcaggaccacatccttcccgagcgagttcttggttgacctcttcctcttcgaccacctcctaggctcttggtgtagcttgccactctcaccaatcaagttttcatgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggtcattcaactccagggtgatcagaggaagaacgtctctaat

SEQ ID NO: 73511 - DNA, 439 bp, Triticum aestivum
  unsure (1)..(439): unsure at all n locations
  Clone ID: PAT_TA_73511
ttcatgcacaagttcaggcaaatcgccatgctgctgactccaggattccgttcgaatattgctacgatttgagctctagtgaagcaaggtttccaattcctgatataatcctaagaacagtttctggaagtctgtttcctgttattgatccagggcaagtaatctccattcaggagcatgagtatgtttattgcctggcaattgtcaagagcaggaagctcaacattattggacaaaatttcatgactggtcttcgtgtggtgttcgatcgagaaaggaaaattcttggatggaagaaatttaattgtttctcatcttcaacaactgagaactactctcctcangaaacaaggaaccctggtgtttcccagttgaggcccctgaacaattcatcaccagcagcattatatgatagcttgctcatgatgcttattttggt

SEQ ID NO: 73512 - DNA, 505 bp, Triticum aestivum
  Clone ID: PAT_TA_73512
gtcacccaatactggtgttcgcctgctccgactcccgcgtgtgcccgtcggtgaccctgggcctgcaccccggcgaggccttcgccgtccgcaacatcgccagcatggtgccaccctacgacaagaccaagtacgccggcgtcgggtccgccatcgagtacgccgtgtgcgccctcaaggtggaggtcatcgtcgtcatcggccacagccgctgcggcgggatcaaggcgctcctctccctcgaggacggcgcgcccgacaagttccacttcgtggaggaatgggtcaggatcggcggtccggccaagactaaggtgaagaccgaccacgcctcggtgccgttcgaagaccaatgctccatcctcgagaaggaggccgtgaacgtgtcccttgagaacctcaagacgtacccgttcgtcaaggaaggggtggagaaagggaccctcaagctggtcggcggccactacgacttcgtcaatggaaagttcgagacatgggagcccta

SEQ ID NO: 73513 - DNA, 380 bp, Triticum aestivum
  Clone ID: PAT_TA_73513
ctccatcaagtgatggagctcagaactatccccctggtgtagcaccaccaagttctggcacacccactcaccctgttgcaacatcagtatatgcatcatcaggcgcaccaaatgcaccatcgatgtaccctccaccaccttatagttattccccatactatcctccaccatttcagccaccacctccaccaccaccggttagtgttgatccctctcagagtattgcaactgcaccttgggctacacacagtgcagtgccgccaccgccaccacctttgtcctcctcaaccgaccagcctactgcttcctatggtgccgatgcagagtatgacaagtttatgtcagagatgaagtgatatgggcaaagctggtgattattc

SEQ ID NO: 73514 - DNA, 288 bp, Triticum aestivum
  Clone ID: PAT_TA_73514
tatctggagtaaactcaccaaaaaagttgctgcaaacatgtctcgtattgttgtctctcttgcttcattcaatggagaagaacggatttttgcttgcacatgaatatttgcaagcaatcaatctgacacaaagatcctgacttcagcgagcttggttagaatttctgatgatgaaaacaagattaatgataacttgaagattgttgtgcaccttccaaacaaacaacaaactgtaaggacattgcaacattatcatctgcattacaatgttgctattgtcagcatcaa

SEQ ID NO: 73515 - DNA, 347 bp, Triticum aestivum
  Clone ID: PAT_TA_73515
cggacgtcgccgggtctggggaggtcatggtggacgcgtttccgccggaaaccgctgggcaggaacgtgagggcaaggtggatgaggcagaggtggaggtgcacgctgcggtggcacaggaaccagaggtgaaggatgtgttggtggccgaggaatccgtggtgcaagagcctgtggctgatgcaccggaggtggaggcttcagaggtgaagaatgatgtggccaaggtgcatcccgtgcttgaatctgagccgaaggttgatgaagtggtggtggtcgaggaaacgcctgtagctcctgaggtacatgaatcagaggtgaaggacgccggtgctcatgttgtgctg

SEQ ID NO: 73516 - DNA, 359 bp, Triticum aestivum
  Clone ID: PAT_TA_73516
ggtgcaaattggtacctccaaccaaagattcttcaaatgagggggtgatcagcgtcacatcactcaagttgtcagtgctcactaatacaattacattgaggaggttgatcaggaaaggtgtgccaccggtgctgaggccaaaggtttggttatctgtgtcaggagcagccaagaaacggtcaacagtaccagaaacatactatgatgagctaattcgtgctactgaggggaagaccacgccagccacaaggcaaattgatcatgatcttcctcgcactttcccttgtcatccttggttgaacagtgacaagggtcaggcatctctgcgacgggtacttgtggggtactcattccgtgat

SEQ ID NO: 73517 - DNA, 381 bp, Triticum aestivum
  Clone ID: PAT_TA_73517
ctgattataaggatgagtttgtcatcaagcacggtgtcaaattgggtctgatgtcctgctttgtcaaagctgctgttacagcacttcaaaaccaaccaattgtcaatgctgtcattgatggtgatgacatcatatacagagactatgttgacatcagtgttgctgttggtacttccaatggtcttgtggtgcctgttatccgagatgctgataacatgaactttgcggacattgagaaagggataaacgcccttgcaaagaaggctactgagggggcactctcaattgatgagatggcaggaggaacattcaccatctctaacggtggtgtttacggaagccttatcagccgacctatcatcaaccccccacagtctgcta

SEQ ID NO: 73518 - DNA, 382 bp, Triticum aestivum
  Clone ID: PAT_TA_73518
acaacagcgctagctcgtcgcaggtttgcagctgtgaattgtgatcgtcgacccaccatgagctaccaagcaggctacccaccaccggcgggccagcagcaggcctacggcggcgcgcctccaccgccggcatacgtcgcgccaccaccggcgtacccgccgacacaggacggcggcgcgtactacggccagcagcagcagcagaccaccaccagccgcggcggcgacggtttctggaaaggatggtgagagcttaactaactactaacagtgttctcccttcttctccagctagcaagcatatatgttgaagcttgtgcctacgcgtgaatacgtctttaatttgcatgctatatatgctactcatcacaatatatatcgt

SEQ ID NO: 73519 - DNA, 298 bp, Triticum aestivum
  Clone ID: PAT_TA_73519
cctggccgcttgtggagtggaatgctgtggcctgaaatggagaagttagctagtacataggctcaaggcttgtgtgtgtaacgtacgtgcatggtgctcctgctctcaacggaattaaagaggacgggccgctctgtgccaatggcggatgcgcgcggggcgccgccgggcagttggtcttgagattcggagcgccatcgaagtgacctttggagtttggaagcatatcacccaatgccattactgctttcgatgctgcaaaaatcaatggtatttgttcaaaaaaaaaaaaaaaaaa

SEQ ID NO: 73520 - DNA, 198 bp, Triticum aestivum
  Clone ID: PAT_TA_73520
tctttattatcagtgataccattaatgtgccttgcctcttgttcgtgattgtacaaggcaatgaacggaactcatccctggacctccatgtccgggggtgcatgttactaaccttggatatgccagggacatgaatggtaatgttccaattagcaccacaaattcctctgggccaagtattggagttagctcgttggt

SEQ ID NO: 73521 - DNA, 399 bp, Triticum aestivum
  Clone ID: PAT_TA_73521
tggcgatgatggcgccggggacagcgacctcacggttctcgaagtgggcggacaagctgcgcggcggcgcgccaggagaaaacgaagcccaggataagaggaagctagttagcaaatggaaaccaacaactaaaggcacgctgaagaggacttaccgagttcgttcagtagaagaaggtcggcggattcttaaagaaattgctttggttctctctgaagatgaccactttgtggacgcctccagtcacaagggttgtcaaataaggagggaaagtgcgcacggcgagagtgtgtgctgctataatgtgagagctctgttcgatgagcttcctacccctcacctagttctggagattacagctttccctgctggacctctcactgataatgactaccgca

SEQ ID NO: 73522 - DNA, 327 bp, Triticum aestivum
  Clone ID: PAT_TA_73522
ttgattagttgtaactctcttaaaaagaagcaattgctgcctttgaagatatgtatagggaacggaagttctgtgggttattattgaataacgatctgccattttcttctactgccatagtatagtcttgtacctgctggaagatgtacgctgctgctgctgttggaccactatgccatacaaatatacaactatcacagttgacaacagtctatatgcctgcaaagcttgtttgctccctccattcccatattcatagtactaatggaggggagagggttgcctgccgattgctcattctgcgcatggatcgcacggcaaattgac

SEQ ID NO: 73523 - DNA, 436 bp, Triticum aestivum
  Clone ID: PAT_TA_73523
ccactggcatcgcgcaaccgtcatcgagggccgccgtcgcgcacccgtcagcgaggcccgccaccgccatggaaggacgccgttgtcgccgtctgcggacgtcgccaccatggaagggccccaatacttccgtctccggacgccgccagcaggaagcaagcgttgccgttgtcgcacagccgtgggggctgctgctaccatctgcgcatcaccggcaagctgggaggccgcgtttcttccacacctttgacctttcttcctgcggcgtgagcatacgagggcatttgggaagaagatagaaggtaaggacatgtttgtcatttcgtgcagctgtctactaaaatcaactacaacaatgagtctagtgtctcgtggcatagttgttcagattttggatgtcttttggcaaagacagattttttaagtggtctatgac

SEQ ID NO: 73524 - DNA, 519 bp, Triticum aestivum
  Clone ID: PAT_TA_73524
taattgatgagctaaatatagttcaaactcatttagtttcaaatgcttcagttccatcatctgctgtgagcaagagtcaaaatggtaccatagaagttcaccagtatcaagaagcattgaactggttaaaccaaggggagctttttgttaagagatcaagtcgatcagaccttaagagtctttggtctggttgttttgatcagtcctcagagtatcatccaaccttaagttggggctcttttgcaacatgtggtcgaagggagactatggaagatacccattttttgcttccccatatgagcgaagaaaaggatgtttttgcctttggcatttttgatggccacagaggttcagcagctgctgaattttctgtccgagcagtccctggatttctcaagcaatttggtcagggtgcaagcccaaccgatgccctttcagaagcatttgtaagcactgacttagcatttcgagaagaactaattcttcaccggaagtcaaaaaggataatccaaaaagact

SEQ ID NO: 73525 - DNA, 380 bp, Triticum aestivum
  Clone ID: PAT_TA_73525
ttttttttttttttttttttaacataaaacaccacaaatccataataataacaataatcctctcagagccggtgagcagtaggtacaggaacgcacacaataaataatactataatagtaataataaactcacaccaatcacactagatcaaatccaccatcaaaaaacctctccaaaccctcagatccatccatccatccgccacgcggaccaaaacaaatgcctcctcttcataaaactatcaccaccgctaacgacacactgctactaccactactactagactgcaggactcccactaccactgtaccactagatctgaagacgcgcgcgcacgcagacgggggcggcgagcccaccaccaccaccacatctcctc

SEQ ID NO: 73526 - DNA, 339 bp, Triticum aestivum
  Clone ID: PAT_TA_73526
gctccacgtgggctcttcgactgtcctctgatggacgacctcgccgccgccgccggcttcgacgccgcccccgccggaggcttctactggacgacgcccgctcctccgcaggcggcgctacagccgccgccgccgccgcagcagcccgtcgcccctgccaccgcggctccgaacgcctgtgctgaaatcaatggctctgtggactgtgaacatggcaaagaacagccaacaaataaacgtccgagatcagaaagtggcactcgaccaagctccaaagcatgcagggaaaaagtaagaagggacaagttgaacgagaggttcttggaactgggtgctgtc

SEQ ID NO: 73527 - DNA, 433 bp, Triticum aestivum
  Clone ID: PAT_TA_73527
tgccggtggtgtacacggagatggacggcgggttcaacagcggcggcgccggcgcgccccgccggatctcctgggggtccaggcagacggcttccacggacaggggcaccgtccgccgcttcctccgaaacgtcttcgcctgctttggtggacgcgggtcggcggcatcgcggtcgcacgccatgcctgagctcgacgacgacgacgcgtctgatcatagtgcagccttcagccgtggtgggtccaggagccgcagcaccagctggagactcgaggacggccatgccgccgacgccatggtgcagagatgatgatgatgatgattgctctctctctctctctctctgcctgtagtacagtagtacgctgcaaaaagcttgctgctttgtttcatcatggtgtatttatttaccatactactactcctgctact

SEQ ID NO: 73528 - DNA, 374 bp, Triticum aestivum
  Clone ID: PAT_TA_73528
acacggcacaacaaccaggttatggggcaggtcgtggcggcggtcctgcttggacgacggagcccccagctgctggtggcggcctctcccatctcctggtgattgcagcccccgccctcatgcgcacggcaagcatcgctctagccatgactactcccgcaccaccaggatggtgccccaaccacgacgtctctcgtaccggcagcggtggcagcatctacaccaccagcaacgacaacctccacatcactgtagattcgtcgtcaccttccccggatctggcggcccctgtaccccgacggcatgtgcggatcctggatgatgcagtagtggacttctacttcatgattgattctgatgtctactacaggaac

SEQ ID NO: 73529 - DNA, 352 bp, Triticum aestivum
  Clone ID: PAT_TA_73529
tgtcgcgctcgacgctgctatggagggcggcaaagctacccatctactccgtggcgctagtgccactcaccgtagggagcgcttctgcttatcatcatgcgggtttattctttaccaagcgctattttgttctcctgacagcagcagtcctcgtgatcacttggctcaatctcaggggctgataagaacaagaaagaatctgttgtcagcattactggcagtcgaacaatgacacaaaacgccgcaaacatttccctattcctcggctttgcagggctattttgggcctttgcagaagccagggatatcagattcattttattgggtgatgtctgcaatattctgtgggtat

SEQ ID NO: 73530 - DNA, 329 bp, Triticum aestivum
  Clone ID: PAT_TA_73530
agtgtgaagatgaggaaccaggtattgttgtaacttcgaagttgtgaatgaagctcctgaggagtcaactgcagaaaaggatatgccttctgatggagatgatgctgagccaacgggtattactatcctgaggcgacgccatgctccaactgcaagttcgttttctgatggagatgatgctgagtcaacgggtattaccatcctaagacagcaccaagctccaaatgcaagcttgctttctgatggagatgatgctgagtcaacgggtatcactatcctaagacgacgccaagctccaactgctagctcagctagttcatttactcaac

SEQ ID NO: 73531 - DNA, 318 bp, Triticum aestivum
  Clone ID: PAT_TA_73531
aggtcgggctcaccaacgaccacctgtctcgtgcccgcgccaccgcgtctgctcctccgccgccgctgccgcccgcgtttaactgattctgctgaccaccaccgagagagagacacaagggagagaagaagaaacttatctaaggaacaaccgatcgaccaaccaagaggagaaattaaggaaaagagtgagatatagcctctagtagcagtagtagcagtagtagtatacaaaagagagtgtgctggtttgcaagtgtgtatgatgatcgagtgtgtgcttgtgtagattaattacggcggctcccccctaattagc

SEQ ID NO: 73532 - DNA, 357 bp, Triticum aestivum
  Clone ID: PAT_TA_73532
ggtgagggtttggggacgacgggatggcgcggagcgtgtcgtacgtttcggcggcgaagctggtgtccatggcgcgaggcaatccccgcctcgccatcatcgacgtcagggatgaggagaggagctaccaggcgcacatcgcaggttcgcaccacttcgccagcggcagcttcgaggcgcggatgccggagctcgtgcgggccgccagcggcaaggacaccctcgttttccactgcgcgctgagccaggtgcgaggtccaacttgtgctcggatgttctcagattatctatcggagaccaaggaggattcagggataaagaacatcatggtactggagctcgggtttaacggatggg

SEQ ID NO: 73533 - DNA, 105 bp, Triticum aestivum
  Clone ID: PAT_TA_73533
tcactaaacttgtgtaccgtcaaaccgtactagtatgtgacttgtaacttccacattgttgtgtttgtgctgcgctagtctctgaaagcgaaagaaccataaccc

SEQ ID NO: 73534 - DNA, 421 bp, Triticum aestivum
  Clone ID: PAT_TA_73534
accacaacacaccacagcgggtaggccgagagcgcgaatggcgtccctggcgcagcacgtcgcggggctggcgagcccgccgctctccggcgcgccgcggcgccgccccgcggcgcccacgcggccgtcggcgctggtgtgcgggacgtacgcgctcaccaaggaggagcgggagcgggagcggatgtgccagctgttcgacgaggccttcgagcggtgggggaccgcgcccatggagggcgtctccttctcgcccgaggacctcgagtgcgccgtcgagtccaccgacatcgacaccgatatcggctcactcattaaaggaacagtgttcatgaccacttcaaatggtgcatatgttgatatccaatctaagtctactgctttcttgcctttggatgaagcatgccttctcgatgtcaac

SEQ ID NO: 73535 - DNA, 376 bp, Triticum aestivum
  Clone ID: PAT_TA_73535
tcgtggttatgttgaggctgttttgagcagtcttgcagcaaatgttccgaaggctattgtgctttgccaagtggagaaagcaaaggaagatatgcttaaccagctatacagctcgataagcgggcaaagcaatgttaagattgaagagcttcttcaagaggaccataatgctaagcgcagaagggagaagtaccaaaaacaatcatcactcttgtcaaaacttactcgtcaactcagtatccatgacaacagggcatctgtttcctcttattctaatgacaccactgaagctgagagccctcgaacaccgagccgctcaggtgaggactggaggtctgcctttgattctgcatcaaatgggcctgttgctgcaagc

SEQ ID NO: 73536 - DNA, 479 bp, Triticum aestivum
  unsure (1)..(479): unsure at all n locations
  Clone ID: PAT_TA_73536
ccggcttccgctacccactccagatgccatacaggtctttacacaagatgccgaaccggctggacgccaagttccaggtgccggtgttcatggtgatgggggagaaggactactgcttcaagttcccggggttcgagaccgccatgcgcagcggaatcatgaacaacttcatgccggacctcaagatcacctacatcccggaggggagccacttcgtgcaggagcagctcccggagcaggtcaacgagctcctcctcgacttcctcaaggccaagggccaccccgtcgcatcgtgagaattgattggcatctgttgccatcggatgatgcttggccctggtctgaattttctttatgcgtcttgttgaattgattgatttgnggatgctgtactatctcaactcgcgattatgttggagcaatttgcttgacggacattattggtgcttcgcctgtgcagtgaactgatggaaagaatg

SEQ ID NO: 73537 - DNA, 576 bp, Triticum aestivum
  Clone ID: PAT_TA_73537
atatgaactagcttgcactcgccatatcagctcactcatttatctccaatttgagaggttatttcaattcaaccggaaagttgaagaattgacatacaccattgctgctgaggagattccgtttcagctggggttgtcaaaaactgacctaaggagggtgctgaagtccagcttatctgggattgataagtcgattggcgccatgtacaggaggttgcagaagacactgacgtctgatgagttgtttccttcgctgtgggacaagtgcaagaaggaatttctggacaaatatgagagctttgttcagatggtaacacggatatatgggaatgagccgatcatgtcggtcaacgaaatgaaagaagtccttgctagtttttagatacaagtacagcaccatgtattccattcatttcattgaattttgcactcacttgcgttaggccttttttggtttaatgtgtgtatgtgtatgtcctctgtatagaagtgaacgcggcatgctttccctattatacgtgttctggtgtcacatcaagcctctgattgtacttgaacaggcactgctgcccgtag

SEQ ID NO: 73538 - DNA, 324 bp, Triticum aestivum
  Clone ID: PAT_TA_73538
gcaccggcatggcggccacggcgtactccgtggcgctcctcggcggcgcacgcctcccggccgccccgcgctccgccctcctccctcgccgcagcgtctgccagcttcgcctccaagatgcaccgaggctctccctgctgcgtgcgaaggccgcgtccgaggacacatcggcctccggcgacgagctcatcgaggacctcaaagcaaagtgggacgccattgaggacaagcccaccgtcctcttgtacggcggcggcgccatcgtcgccctctggctgacgtccgtggtcgtcggcgccatcaacgccgtgccgctgctcccca

SEQ ID NO: 73539 - DNA, 424 bp, Triticum aestivum
  Clone ID: PAT_TA_73539
cacggagagcagacgcgtgatggtgatgcttccagttccagcgaacggatgcgttgctatttgctaaacagctagccgcaggcctcaggatgaactcaggagtcagcactactcgatcgtgctcgtctccttcccctcgccatattagaatgcgtggggtgtcctagctagtgtgtgtgtatatggatagatataatatatgggcatcattagaaaaggtggtactgctgcatatatagtggatcatgctgtactgctgctcgatggcttaacggtctgtactactagctagatgcttgcagttgcaggtagatgctctcagacgatctgaatgtgaatgtctgtctgtagtactatttcatagacgaacgcccagcagtccatttctgctgctgagaaacgcataaaaaaaaaaaaaaaaaaa

SEQ ID NO: 73540 - DNA, 363 bp, Triticum aestivum
  Clone ID: PAT_TA_73540
tcaagcaagttggcaaaagatgaatatgttgcgagccggaacatgtgtgatgggttggacatagatgctgatcatggtggtaatggggtggctcctatgaaatagactgcttgtgccattctgaggttattgctggcaacaggagctggcaccgcagccagaaactagaaaaatgaacatagtaacttttgtttgtgaccatatggaaccaacagcagcagtacttttaaaacagctcaccatcgatataggtgctggttttcctgattacatgctgcaacagcttcacattagaagaatctgatgaggcttctgtggaattatgagctgagatgaacctgctcatagcttaattgatgctct

SEQ ID NO: 73541 - DNA, 150 bp, Triticum aestivum
  Clone ID: PAT_TA_73541
acgcttggcttgccgccgcacgcctccgctccgctccgccgccgcggccgatctctctagggcttccaacctcgccggcgacgcgacgccacgccatggccgccccggtcgtggacgccgagtacctccgccaggtcgacagggcgcgcc

SEQ ID NO: 73542 - DNA, 417 bp, Triticum aestivum
  Clone ID: PAT_TA_73542
atggcagcattagtcaacaaaataaacagatcttcaatactctccaatggcccccaatatactcatcagcactaaagcagatagtgaagagcatgttaaggaaaaatccagaacataggcctactgctggggagctgctgaggcatccacatctgcaaccatatctggctgaatcgtgcagctgttcaccaatctatcttccagtgaagcccaacaaaagtaacctggtagacaagcaatcaaagaagccaagcagtggcagaaagcgaactgtgaaagccaatggatccaatgaaacattagatactgcagcagagcacactgtggaagcaagagacagctcgacgaacttttcagatgtatcaactattggtacccaggaagccttgattttgcaaatgccggtggatcttgatg

SEQ ID NO: 73543 - DNA, 347 bp, Triticum aestivum
  Clone ID: PAT_TA_73543
gctctggttgctcctgactatggcgcagttgcagaatatactgctccagggactgacaactggggcgctgattggggaactggtgaagctgcagctgcgcctgctggcattccagctgctggtgcagactgggctgctgctccagctcctcctgctgatggtgtctgggatgcagctgcggctcctccagcagccaccggatgggaacaaggcactgcccctgccgcggcacctactggatgggagtaaagagtaaatcagcatggttgatggtttataattgtcgtcatcagaagttgttggtagacactgcttcagtagcagctttgaactttttacgtgctact

SEQ ID NO: 73544 - DNA, 227 bp, Triticum aestivum
  Clone ID: PAT_TA_73544
gtttttttttttttctttttttttttgagtgtaagctacttttgttgaccacactgggcccgagtattacaaatgctatataggagtattgtaaatgtggggaccacatttaaatatatagcatctgatgatgttgctatcaaacggtgatgagcgtcagctttatttatctaaccgtctgcgcttcatgctaggtgatgcagtatgatgctgagaagagaccaccg

SEQ ID NO: 73545 - DNA, 129 bp, Triticum aestivum
  Clone ID: PAT_TA_73545
tttcaggttattgtggtcactgatggtgagcgtattttaggcctgggagatcttggttgccagggcatgggaattcctgtggggaagcttgcgctgtatactgctcttggaggtgtacggccatccgct

SEQ ID NO: 73546 - DNA, 284 bp, Triticum aestivum
  unsure (1)..(284): unsure at all n locations
  Clone ID: PAT_TA_73546
ggaagagcaccgcatcacgttcccggagcagttgttgcccttgcaccaccagcagagcaggggcctgtcgtctcgtggcgccagcagggagagccgtggcggtggcggggagccaggagtctcggaggtctcgcacctgngcaggagctcttttgaaccgcgtccatgttcgccggtcagtccacctctatctacacctccttccccacagaagcttctcgatctgctagggtttcatccacatctctttctggttgatcttggagttaccggtatgtgagctc

SEQ ID NO: 73547 - DNA, 173 bp, Triticum aestivum
  Clone ID: PAT_TA_73547
attcctggagttgcgccatttgctctttgcctcttcttctccaaattggttgcatataccttcctgtattggctaccgttctacatcagccatacacgtattggtggtcaggacctctctgatgctatggctggcagcttatcaacaatctttgatgttggtggtgtgttggg

SEQ ID NO: 73548 - DNA, 170 bp, Triticum aestivum
  Clone ID: PAT_TA_73548
tcatcttcataatcatgcctctgaccggggggagtataaatcctctttgtaatttggatgtttaccaaagcatgaaattcagtcatatttctatcaatgagtagtcatgtaatctggtacagtttaaatcaacgtgaaatctctatttttctaaaaaaaaaaaaaaaaaa

SEQ ID NO: 73549 - DNA, 412 bp, Triticum aestivum
  Clone ID: PAT_TA_73549
ttttgccttggttcttgagtctggcggcagtgatcttcccatcattatatcatgcgctagtcttgcactggcagatgctggaatcatgatgtatgaccttgttacatctgtatccgtgtcctgttttggtaagaacatcatcatcgacccaacctcagacgaggaagcatggcaagatggaagccttgtggttgctttcatgccagcccgcaaggagatcacacaactcacgctcaccggagagtggagtgatggcagaataaccaatgcagtagagctctgtatggatgcttgcagtaagctcggtgacatattgcgtgaccacttgaaagataccgccaccttgacgagtgaatgatgtggcagagacaacacttgcaacaacagatatccttagctgtacaaaatctgt

SEQ ID NO: 73550 - DNA, 381 bp, Triticum aestivum
  Clone ID: PAT_TA_73550
cgtctcgcccgcggccgatctcctccatccgctcgccgcgccgcaatccggagaggagactacgctaggtcgagcaccacctggggctcagcgttctcgcgaccagttccggcgcggcgtccgccctctgcagccactcgcccccgcgaccgtcgttgttgtcctacttcgacactcgccaccttggtcggcgacgagcaccaccaggacagcagcttggtacaccacaaattacaaaatgtcagccaacgtcgatgaatcaaccagtggtggcagcagcagcgatgcagctggggggagctttgagtgcaacatatgctttgagctgcctcaagagccgatagtgactctttgcggccacctcttttgctggccatgcct

SEQ ID NO: 73551 - DNA, 494 bp, Triticum aestivum
  Clone ID: PAT_TA_73551
cctaactccatttgcaaagtcgtttctcatagaattggagccaaagatccatttggaagttttccaggaggccgagttgcttataaacatcaaggagcatgttcttgttcctgagcatcaggtgctcacaaatgaggagaaaaagacgctattggaacggtacaccttaaaggaaactcagcttccaagaatacagatttcggatcctattgctaggtactatggcctcagaagaggtcaggtcgtgaagatcatcagacccagtgagacggcgggcagatacgttacataccgctatgttgtatgagacaaaacgtcagaacgcaggtgaacttaagaagagaaccatagatatggtaattttttgaagctacacataccccatgtgcttggagacatcagtatcgctttgtagcagacactattaacgataagtggctgttgtgtaagtgaattgataagctgagtatatggaccatacgtgaattctcatg

SEQ ID NO: 73552 - DNA, 298 bp, Triticum aestivum
  Clone ID: PAT_TA_73552
aggagatgcctgatgtcaagaagttggacatcagaaacttcctgtaggccataaatctctcaagcattttgaaatgctcggacactccataatggttttcttttccagtgacagccggcgctgtaagcataccaatgaatgttattcttgctttttgtaataaaaactgcaccgaagtacaaagacaagtcaacggttgagttggattgcttgttaccttcctgcgtggagaattttgttttttgtattggcaatgtgaacgccaagcagcttactgtctccctgatgatgcacctgt

SEQ ID NO: 73553 - DNA, 429 bp, Triticum aestivum
  Clone ID: PAT_TA_73553
gaaaaagaaacccttgcccaggggacaccgcaaattccagatgaacatgggagctgctgctaaaccactgtcccaagatattgctgttattgacataaatgcaagtgttggtgataaggcgacaggagaagttcttcctggaacaaactgacaagacaaccacttcagtttctgcggagcaatcgagcctaggaacaacaggttcttcccatcatgtgcacacaggtacagatggaccaaaggatccatcaagcgctggtgcagttgaacataaatctctggctgagacatatttactacaagaacctgataattctaaagacatgggtgctaaggaaagtaaacacgatggtgttattagtacgggaacttctgatgatgggaaaattgtacttgatatcatagaggctattgatgctgctgaaagaa

SEQ ID NO: 73554 - DNA, 392 bp, Triticum aestivum
  Clone ID: PAT_TA_73554
agattctcgtgcctggaactgtgggggagcacagcgaaacgatgaataagatctattcagcacatgtgttatctgattgagagatggatctattaccataatcagttgttactctacgtgatttgtcatttacatcagccagtaatgttttcatgaaagttatcctgaagttgctttgtccatttgttttcccagaatgttcagtcagtcggatacatgtaaagttgtgatcattactcgtcaaatgaactcgtctccactgagggcttgtttgaaatgcagggatttcataggaattctgcaggaagtttacagaaatcagttcgatttcacgagaaaacctccgcgttccaaacagacctagctgcatatccaccatcggtcgcactcgc

SEQ ID NO: 73555 - DNA, 275 bp, Triticum aestivum
  Clone ID: PAT_TA_73555
ttttccacgccggcaggaccaacaccgacgactgctacgacgccggcaagcacgtgcacggcagcaggagggtgtacggacacgacgacgcgagccgcagtaggccagcgtacgccgacgactgctacaacggcggcgagctgggcgccctcgccgccggcgccgcctccgtcttcgcctccgcctccgcactggtaaatatatataatgatgatatgcatgtaaatcctagctaaataacatctgggcggttctggtctgggctggtgtgatgt

SEQ ID NO: 73556 - DNA, 307 bp, Triticum aestivum
  Clone ID: PAT_TA_73556
cgccctccccgcgtcgtcgccctctccctgctcaccgcgggccggcgtgccgtggagatccgtccttgctcgaactgactcgttcctttgctgcaagtacctactatcagccatgtttggacgcatgccaaggaagagcagtaacaataccaagtattacgaggttcttggtgtgtcttttaccgcaagtcaggatgagctaaagaaagcatacagaaaagctgccataaaaaaccatcctgataagggtggagaccctgagaagtttaaagagttgtctcaagcttatgatgttcttagcgacccc

SEQ ID NO: 73557 - DNA, 369 bp, Triticum aestivum
  Clone ID: PAT_TA_73557
ctggctcggcatgcccatccacgactccgacttcggctggggccgccccgggttcgtggcgcccgcgcagatgttcggcagcggcacggcctatgtgacgcagggctacgacaaggacgaccccatcaacgtcctcttcgcgctcgagcctgagtacctgcagaccttcgagaaggcattctacggggagtgaccatgaccgtgactgatcgaccagccatggcgaggtctatagaggagtgggagagccagtcgtcccgctgtggatgcgaagtgattgtgatgccgccgtggtaacttccatcggttcgtgtggagagttggtccatgtgcatcgatctgctgggggcctctactgtactatatcgt

SEQ ID NO: 73558 - DNA, 423 bp, Triticum aestivum
  Clone ID: PAT_TA_73558
ctactcaggtggtgagcttgagtccgctgatagtatgacaccatttgatgttgctgtccggatactggataatcaactgcgttccctgatgtggattgatgaaaaggttaacgagttctctggcagaatacagaggctgcccagcaacagcgcttcagctgaacgtgactctgggattcccaggttttggttaagctgattaattcacggcatttgcttgctgctctgatcagttttagtaagcattctttgcttggttattctgctgctccaccagccaaggtttcgcattattttgtacccgttcaagtacttcggtgccatgtagctctagctggttcactctggattgataccatccaatgtcacttgatgctgtttgatttcagcataatttctgcttgttaaccttggatgtgaaaa

SEQ ID NO: 73559 - DNA, 318 bp, Triticum aestivum
  Clone ID: PAT_TA_73559
cgaggtggaggagtcggcggcgagggagtcgcggaccatcgggaacatgatcgaggacagctgcgccgacaacgacatcccgctgcccaacgtcaacgccaggatcctcgccaaggtcatcgtgtactgcaggaagcacgcctcggcgcgcggcggcaccgaggcgggtgatgcggagccaaccgctgcgactaacaaggcatcagaggatgagctcaaaaccttcgatgctgagttcgtcaaggttgaccaggccaccctctttgacctgattctggctgcaaactacctggacatcaaagggctgctggacctgac

SEQ ID NO: 73560 - DNA, 123 bp, Triticum aestivum
  Clone ID: PAT_TA_73560
ttgcattgttcgtgctgttcctgctggacctgagggtggaatcaggattagttcaactctgccaaataggcttgggaaaatgttggctcctcttcactggcatgactataagaagcaatatgg

SEQ ID NO: 73561 - DNA, 393 bp, Triticum aestivum
  Clone ID: PAT_TA_73561
tggttcttggggccgcctggtgctgcgggtcgggcagacgttcttcgccgccgcctgcatcggcgtcatgggcagctcgctcggattcgccagctacaccgccttctgctacttgattgcatcaatgggacttcaaatgctgtggagtttcgcacttgcttgtcttgatggatatgccattacaaccaacaaggatctcaccagccccattctagtgagcttgtttgtcgttggagactgggtaacagcaattctgtcattcgccgcagcaagctcatctgctggtgtagtaattctatttcaaaaggatgtgttcttctgcagaaggtatacccaacttccttgtggaaaatatgagctcgccacagcgtttgccttcctgtcttgggcact

SEQ ID NO: 73562 - DNA, 409 bp, Triticum aestivum
  Clone ID: PAT_TA_73562
tgcattggtcttatcaattgcactacgcaatcaatgacaactcaacctaaaacgttgtgctaatcaatctcgcgacatatgaggatttagaacatggtcgaagacgatgctggaaaacgtccactccctggttggtcagtcggcatcgccaaattttcttcagaagctcacgtaccctccgctggatcggaaccactagaaggctgtgactctgtgaggcgcacggcgcgggcgggcgtacacattcggttcctttgccactacttcgttgaggccttgtttggatgtagtgagattcgtatcaatccacatgtattgagctgggttagagtggaacttgaactaaattccacctcaatccactccaatacatgtggattgagatgaatccgacaacatccaaacaaag

SEQ ID NO: 73563 - DNA, 197 bp, Triticum aestivum
  Clone ID: PAT_TA_73563
aacgtggagcacagatgcaagtggaatagatttcttagtctttcactagctatcttgagggaacaatgatcaacaaatgacgaccagtattatgatcacacatgacaattgatgtttgctgtgtgcccttttatctcgtgccctttgtgggaaatatgttgctacttgtgaataacaggactaaacattttcttagg

SEQ ID NO: 73564 - DNA, 302 bp, Triticum aestivum
  Clone ID: PAT_TA_73564
gccgccccgccctcctcctcttcctccttctcctacggcgggtacccgcccccgcccgcggccgcctaccctccgccgcccgcgcaggcggcggcgagcggattcggctccggctacggctacggctcgggcctcgtccccgtggcgttcccgccggggacgcacccggatgtctagcgcgccttccgctccgcagaccgggactgcagcggcgccatcgacgagcgggagctgcagggggcgctctcctccgcctaccaccgcttcagcatccgcaccgtccgcctcctcatgttcctctt

SEQ ID NO: 73565 - DNA, 239 bp, Triticum aestivum
  Clone ID: PAT_TA_73565
aaaccagtaatggtgacttgttgggcttattggtggagtcaaatatgagggagtcaaatgggaaagcagaactaggaatgactacggacgaaattattgaggaatgcaagctattttattttgcaggaatggagacaacatcagtattgctcacttggacattaattgtgctaagtatgcacccagagtggcaagagcgagcaagagaagaagtgctacaccactttggaagaaccaca

SEQ ID NO: 73566 - DNA, 204 bp, Triticum aestivum
  Clone ID: PAT_TA_73566
cctcttcctggccaggcaggatcgatgaatcttgcttcactgaatttggtgacatcatacaactgcgcccaaacagcagggtagtaaactgccagatggcactcttgttgcggccgcttccgggagagatctggctgctgggtgggggactggctgggctgggaaatgcaagacaagatctcaactcttgagagtcaacacagc

SEQ ID NO: 73567 - DNA, 363 bp, Triticum aestivum
  Clone ID: PAT_TA_73567
ctcttcctggtgacaacgtcgggttcaacgtgaagaacgtcgcggtgaaggatctgaagcgtgggtacgtggcctccaactccaaggatgaccctgccaaggaggctgccagcttcacctcccaggtgatcatcatgaaccaccctggccagatcggcaacggctacgccccagtgctggactgccacacctcccacattgccgtcaagtttgctgagctggtgaccaagatcgacagacgatctggtaaggagctggagaaggagcccaagttcctcaagaacggtgatgctggtatggttaagatgattcccaccaagcccatggttgtggagaccttctctgagtaccctcctcttggtc

SEQ ID NO: 73568 - DNA, 322 bp, Triticum aestivum
  Clone ID: PAT_TA_73568
gacgacggcgtgccgctcgagggcgtcatccagattgagaagcctggggacgcgggcgtcgagtccaagctcgtctcctacgcgaagctgggtcttctcgccggcggggacgtgttctgcttgctgctgttctctgcgattgggaggttcatccacggcctgcccgtcctcgacgcggagacgttcaagacggccgatcccttcattgctgggtggctgctgagcgcctacctccttggtggatttggtgatgatgccaaagggcgcaatggcgttggaaatgctgttatcgctgcagctaaatcatgggctgttgggatac

SEQ ID NO: 73569 - DNA, 329 bp, Triticum aestivum
  Clone ID: PAT_TA_73569
acatctttggtggcaatggtgcagaagaaccatatcctattaggggtaggtactcacagttcacattgttgaccatgacctatgatgcccgattttggaatctgaagatgtttgtggagcattactctaaatgtgcatcggtgagggagattgtagtggtctggaacaaaggtcgagccccagtgcaaggtgaattgaactctatggtgcctgttaggatcagagttgaaaataagaatactctgaacaacagattcaaaatagacaaagaaattaaaacgggagctgttatggagcttgatgatgatatcatgatgacatgtgatgac

SEQ ID NO: 73570 - DNA, 418 bp, Triticum aestivum
  Clone ID: PAT_TA_73570
cggcgatctgcctcttcttccacttgccgccgtcctaaacaacacacacgctgacacgcacgcagccaacaaaaaccgcacacgccgacgacaatgtcgccgtcgtcgttgagaggcgccacaaaaaggaaaaaaaaacgcagattgttacatgccagaagaacaatgcaatttgccgcgatgattgggacggtgcacgattgacctgacctgccggtgatgaactctgctgctgctagtggatgaccgggaaaaatccaatcctccggctttcacaccaccgtcattgtcaaaaagttgtccgagattcaattcaacagcagccacaagataaaggcagggaaaaaaaagatgcattttgtcctcatttttttttctgcatgtatcatatggctccagaatttctgtggtggtggtg

SEQ ID NO: 73571 - DNA, 174 bp, Triticum aestivum
  Clone ID: PAT_TA_73571
gagacatcaccagcgatgacgccgccttctagttccatccatttacgactccgagtacaagttgattttttttgttcgtgtacccaactagtaattggtccatcctgtaaattccaaagaacgcggtccatcgatttagcctgttcgctttattgaaaagccatgcctgaaaat

SEQ ID NO: 73572 - DNA, 182 bp, Triticum aestivum
  Clone ID: PAT_TA_73572
gttcattcctactttacacaatacaataatcaaggctggtttgtgcagctttacattttacatcttacagaatccccatgaatgctggtgatttttatgaccaatgtgtctgtttttttttttcactctcttttggtgctatggcataccacagcacagggaagattgtgactaataacctg

SEQ ID NO: 73573 - DNA, 311 bp, Triticum aestivum
  Clone ID: PAT_TA_73573
tttttttttttttttttagaaacatttacaacaaattatattatactaatccaacttaatttaaataaacaatacaaaacacgtggtacagtacaaaacacgtcgtccttacatattgtgaaactacatgtcatctcaaaggtaactgaacattacaggatctaagtttagttgcttttcttgcacattctctatttggcactactccaacatgtgcatcccagtgcctgactagtgatcagattgagcatcaatcaataggtcttgtctgtttactgctttgtaaagtaaccagctgctatgtgaagtct

SEQ ID NO: 73574 - DNA, 400 bp, Triticum aestivum
  Clone ID: PAT_TA_73574
aaaatcacatgacagcattggtttaatgtgagggcttttgtcacgtagagttcttcgtcttcgtggatcaattccacgtgaaactaaatggagtgttgttgttgatttgtacttctacagagacccagaagaggttgaaaaagaagaagaaattaaagaaattgctgctccaccagcaaaagaatatgttggtgaaatggttgatcaaggatggggtaatgaagccgaagttgttgctccagcagctgaaaactgggctgatgattctgcaccagttgcaccagttgtaccagctccagttgttccatcagaagattggtctgctccagctacacaagctgcaccaactgcaccagcacaaaactggggtggttcaactgctgaaaatgggattaaatct

SEQ ID NO: 73575 - DNA, 247 bp, Triticum aestivum
  Clone ID: PAT_TA_73575
ctgaactgcatccaaaatgtccctttgatggatgttgtgtttgtccatggccttcgtggtggcccattcaactcatggcgaattgctgatgacaaatcatcaactaccaaagctggtttggtggaaagcatcgacgaggatgctgggaaagaaggcacatgctggccaagagatggcttgcggcagattttcctcaagcacgtttttttacagtcaaatacaagacaaatttgacccaatggactgg

SEQ ID NO: 73576 - DNA, 437 bp, Triticum aestivum
  Clone ID: PAT_TA_73576
cgtgaagttgttgaacttcctatgcttcacccagaaaatttgtcaagcttggtattgaccctccaaaagtgtcctttgctatggtccacctggtactggcaagactcttcttgcaagagctgtagcaaatcggactgatgcttgtttcatccgtgtaattggaagtgagctagttcagaagtatgtcggagaaggtgctaggatggtcagggaactgttccagatggcccgctcaaagaaagcatgcattgttttctttgatgaagttgatgctattggtggtgctcgtttcgatgatggggtgggtggcgacaatgaggtgcagcgaacaatgttggaaatagtaaaccagcttgatgggtttgatgcaagaaggaacatcaaagttctcatggccactaataggcctgataccttggatcctgcgcttctgcgtc

SEQ ID NO: 73577 - DNA, 228 bp, Triticum aestivum
  unsure (1)..(228): unsure at all n locations
  Clone ID: PAT_TA_73577
gaagctagagataggcactaagcttgcagagttttgttcacgtgctttgcttgctttggatgtccttgtccaccctcgagccctttctctagaaagaacagttccttcacagggaaatacagtttttggtgctggaacataccanatttcacgattcggggatcagcctcaagcaatggaggttgaagacatgtacgatgattggctgacatccaacaacgatgaacc

SEQ ID NO: 73578 - DNA, 331 bp, Triticum aestivum
  unsure (1)..(331): unsure at all n locations
  Clone ID: PAT_TA_73578
ctgttgaccattatccttacctagtatggggtccaccaacaaaatttaatttggctcagtggaaaccaaagcaagagaatagtgaattagaattaattgatgatgcaagaacagcagatcggttacttaaatggtataaataagaanaatgggaagctgagggggatttagacgacaaaaagtacgagaatgaaagtatgctccccaaggggcttcagatcctgaacagattgttcgagcaatttatgatgttgaggaagctacagctcatgcattgcagataattttggagcataagatgatcaaaccagacactcgtgactcacttatt

SEQ ID NO: 73579 - DNA, 271 bp, Triticum aestivum
  Clone ID: PAT_TA_73579
tcttggttgacctcttcctcttcgaccacctcctaggctcttggtgtagcttgccactctcaccaatcaagttttcatgtctgatctcgacgttcagatcccaactgccttcgatccctttgctgaggccaatgctggggactctggtgctgcttcaggatcaaaggactacgttcatgtacgcatccagcagcgtaatggtcgcaagagtctgactactgtccagggattgaagaaggagttcagctacagcaagatcctcaaagatctc

SEQ ID NO: 73580 - DNA, 311 bp, Triticum aestivum
  Clone ID: PAT_TA_73580
tagtagaagaaggaccacatgattttcttctgtcaaagggggccgatacgcagaattgtggtatcagcagaacagcagtgacgccagtgattctgctgcagttagcctagaggtttgattgacgcaacgtaaaaagaagggaaaccacaatcataactgagagacagagagggatggagccatcttgtctgccttgtaaatggaggtaggatttttggtatgtgggggggcagaaacttacagttccattttcaagatacccgggaggattttcttttttccttttcttttgagattatatagacgatccc

SEQ ID NO: 73581 - DNA, 272 bp, Triticum aestivum
  Clone ID: PAT_TA_73581
tatgggaattagttttgaactgagcttggggattggggacgtatgttgtaaacaagcaaacaccaaacagacaaatctggctttcttcacctgtaagtggacctctctagtttgactgggatgtggcaactaatggttggatatacaagcgaactggagctaatcttgtgcagcttttggagaaggagattggtgagctttgtcatactccagtagaactttgataacagtactgtagtacaggaaataccacacaactagattggatggag

SEQ ID NO: 73582 - DNA, 157 bp, Triticum aestivum
  Clone ID: PAT_TA_73582
actgccagactttccattgcgaatctgaataaatattgtaaagccatttgttgtgctgaactttccgtttctggccagtcgatgtgtatatttagttatgtcggatacggttcttgtgaaaaatagttgaagttgtcagttcatctcctattttgtt

SEQ ID NO: 73583 - DNA, 221 bp, Triticum aestivum
  Clone ID: PAT_TA_73583
gggtaagcagggcgccgaccgcaacagtagtgactttctggattcttctcggccacagtatgctctgcatcgtgagactagtagagctatgggtggtctgcagagtgacagcaatatacatagcttggctgaagttcagaacaatgattcatcagcacatacatatgcctctcttttaggatcatctctttctagaagcgcatctccagatcctgagcttg

SEQ ID NO: 73584 - DNA, 391 bp, Triticum aestivum
  Clone ID: PAT_TA_73584
acttcttggaccgatctcagaattttgccagatcggtagggatgaaggagatgcagaaaatctgtgaatgcctaagggctactgtttctgatttgagcaagttttctaagggtaaaattgctgcgcccaagctaaaggccctgttgtttaagcctttgaaccaggttaacccagtcactaatccctgtcagaaaactgttaagaggaagcgtgctaatccaaataagacaagcactaaccctattcagaaaaacgctaagaagaagaaggctcttgagcaggataaactagccatatctcctggtcagaaagatggtacgaagccccttgatcaggagaagtcagttagttctcccattcagaaagatgataagaagatcaagccccttga

SEQ ID NO: 73585 - DNA, 430 bp, Triticum aestivum
  Clone ID: PAT_TA_73585
ccctgtacagttcactgatgcttctaagcaggtaaactagagttgaagaggtgctgcaagggattgaagttgcctagagtaatatgactgaccaaggggagggatgtctacttgtgccttttggataatctggcaacctcattgtgcttttgggacaatttggcacgtcttaccagctatgcaacctcattcctctaaatggttgtgctgatatagttttggatgagattttgtaaagatagtgttactgcgcctcttacgctcttaacagaaaaccatgcccctccgtatatatagcaagtcgcgtgggcccacgaatgtgccctcaacgacgtgctgctactatatcatcagtattcagtacttcctccgtttcaatgttgaaattaaagacgaagccgttgatcacactcgaagactaaacaggtgc

SEQ ID NO: 73586 - DNA, 168 bp, Triticum aestivum
  Clone ID: PAT_TA_73586
tcatggtgccgtgctgtgtcaataaggtgctatgtgcgtagagtggctcatggtcagggctgtgtgtgggctttgccgcagctttctgtgctgctcgctgtgtcgtgtgtgtttcctctgctgctatgtcataacggatggtgtgtggaggatggggtcatgcatgta

SEQ ID NO: 73587 - DNA, 411 bp, Triticum aestivum
  Clone ID: PAT_TA_73587
cgaagcgtacccgctggctgatgcgcagctgacgatgggtatccctcgactcatccagcaggcggccaactacaagcagctcaagaagggagctaatgaagcgaccaagaccctcaacagggggatatcggagttcgtagtgatggcggcggacacggagccgctcgagatcctgctccacctcccattgctagctgaggataagaacgtgccatatgtatttgttccatcaaaacaagctcttggccgaacttgtggggtgacaaggccggtcattgcttgctcagtgaccagcaatgagggtagccagctgaaacaacagatacagggtctcaaggactctattgagaagcttctcatctgatttaccgaagacgtttcagtgtgatgggcctcagggacacaattttc

SEQ ID NO: 73588 - DNA, 520 bp, Triticum aestivum
  Clone ID: PAT_TA_73588
gggctcttggtgtagcttgccactctcaccaatcaagttttcatgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggtcattcaactccagggtgatcagaggaagaacgtctctaatttccttgtccaggccggcattgtgaagaaggaacacatcaagattcatggtttctgagcgaccgccgggtccatagcaagccctgcatgcaaagcagctatatatctgaagtggagcatatctatctggctgtgtacaagcaggcctactactacgcctgcgcgttctcctatactacacataacac

SEQ ID NO: 73589 - DNA, 276 bp, Triticum aestivum
  Clone ID: PAT_TA_73589
acaagcacgctgccaccagtcgcgccgtgctgaacgccatcacgagtctacgccggccatctccccacgcccctcccttgctcgtgcgatgctcggtgctcctagcgacccggccagaccatggccacagctttgatggccccgatgcaggagaccagccataccagcaggtggcgtctacagtttactacttggtgcggcaatctgtaggaaagatggatcttgcgtctcctatttctcatcttgatagtggatagcagcagcagcatgtggctc

SEQ ID NO: 73590 - DNA, 360 bp, Triticum aestivum
  unsure (1)..(360): unsure at all n locations
  Clone ID: PAT_TA_73590
ttatgatcctaagcgtcttcttggagtgacaacgctcgacgttgcgagggctaacacctttgtggccgaagtgcttggagttgatccaagagatgtcagtgttcctgttgttggtgggcatgctggggtaactatattgcccctcctctcccaggtcacacctccaagctcattcactcaggacgaaatcaaatatttgacagaccgcatacagaatggtggcacagaagttgtggaggcaaaggctggatcaggttctgcgactctgtcaatggcttttgctgctgcaaaatttggtgatgcatgcttgcgagctatgcggngcgatgctggcattgtggaatgctcatatgttgcatc

SEQ ID NO: 73591 - DNA, 449 bp, Triticum aestivum
  Clone ID: PAT_TA_73591
tactccggcggcggcggcggcggcggcggcgaggcgaggagagagaggatggggcggcggatcctgaacgacgcgctgcggacgatggtgaacgcggagcggagggggaaggcgacggcgctgctgcagcccatctccggcgtcatggtctccttcctcaacatcatgaagcaccgagggtacattaaaaagtttgaggtcatcgatccccatagagttggaaaaatcaatgtagagcttcatggaaggattaaagattgtaaggctcttacttataggcaggatattagagccaaggaaatagaacaatacagagttcggatgcttccaacacggcagtggggctatgtcgtgatcacaactccaaatggtgtactggatcatgaggaagcaattaagcagaatgtgggtgggcaagtgcttggttattttcattgagaagtaacatt

SEQ ID NO: 73592 - DNA, 284 bp, Triticum aestivum
  Clone ID: PAT_TA_73592
acaattgattaattagatttattgccgatcgaagttggctcaaatacatttctgttcctagttatgctgcagctgtgaccgtgagtaacggcagagatagctcatcaaggtctttttgagactagtttggtatattatgtccttttttcttgatggaactgaagactaaataagaactcaggagtcttctgccagcggttacgattgtttggtggatacgagtatgggattcgctctgtgaaaattgactaagcagttgtgcctcgttgcgtatcaaaaaaaaa

SEQ ID NO: 73593 - DNA, 357 bp, Triticum aestivum
  Clone ID: PAT_TA_73593
ttcctgatggttctggctggggtgaccatatacaattgcttcagatattcgaaagctgggaccaatctggctatgatccaagatggtgctctgatcatgatttgcacgtgcggagtatgaaattgagcaaagatgtgaggaaccaactatgccagattattaaaaaaattgcaaaaggttcaactgatgtgcatgcaaggaaaagccggaagagtgaccctgactatagaaagctgaggagagctctctgcgttggatatggtaaccagctagctgagaggatgctgcatcacaatggctaccatactgttggctataggtcccaacttgtacaggtgcatccatcttctgtactgg

SEQ ID NO: 73594 - DNA, 138 bp, Triticum aestivum
  Clone ID: PAT_TA_73594
catcggcgattcagcgagcatccacctgaccaaccgaactctgtagccaccaagaaccgaggaggagcaggagaaggacggacatggcggcagcagcgaaggcgtcgtggatggtggcgatgagtgtgggcgccgtgg

SEQ ID NO: 73595 - DNA, 263 bp, Triticum aestivum
  unsure (1)..(263): unsure at all n locations
  Clone ID: PAT_TA_73595
cgttaactgctagcggtttcttatatactgttatgcttcaggcccctttattaattggctgtgatgtcagaaacatgacttctgaaacaatggaaatattgagcaacaaagaagtaattcaagtaaaccaaggtattattctgattcttctttgggagagaacatgttatcctggtttagcgtctcaggctacaaatatatgttntttacatagcaattgacaaccttctccttttctatacataatttcccaacatacctta

SEQ ID NO: 73596 - DNA, 455 bp, Triticum aestivum
  unsure (1)..(455): unsure at all n locations
  Clone ID: PAT_TA_73596
cttcttggaaatagcagtcgaagcagcagtaccaatgcatcaagtacagtcactgattcactgctatcctcgctagttttaaatctatcttcattagaagtggaggacacgtcaaagtcttcagctccttctgtggtggaaaataattggtttaaacgatcactaccttcaaagacttggaagttaagtgctgttgattcgagccttagtcatgaagagagggagcgtangaggaggagagcagttgtgagatcagcttttgtgcagcatctccttgtcactacccttttcgaagactagcagatcaaacacagctatgcacgggaatcgcactagttgttttggatatcatgaagttgttcatccggtctgctgggtaaccttgacaggaaaactgaagcaccgggcgtcttaccttatttattctgtggaagcagctctgtcatttattttct

SEQ ID NO: 73597 - DNA, 372 bp, Triticum aestivum
  Clone ID: PAT_TA_73597
cctggtctcggtatgcgactggataggagtaacttgaatctccattatgcagcaaggtactcaaagagataccggtgcttatgagagctctgcttgatgcctcgaagtgagcgcaggcttttcatccgctcggatgagttggacgctgcatggtcactcttcacacccctcctgaaggagttggaagagaagcggatagctcctgagctctacccttatggaagccgtggacctgtcggcgctcactatcttgccgcgaagtacaatgtaagatggggcgacttgagtgcagagcactacaaggcatgaaacgaagatggctatatctttgtaatgttcttggttttccatttctgtaagtttgcacgccct

SEQ ID NO: 73598 - DNA, 365 bp, Triticum aestivum
  Clone ID: PAT_TA_73598
tatttgcgtaacagtacttgtgtctcattatttccttggtggttctgatggtgtagtggtagtaggttttatctgaaagtacattttctccctaactgcatacatatggagtagaaattgcattttcaataagtaatagttacactaattgaaatgtgcaattttcttttccattgactgaaattatcagcatggtataaatggtagaacaattgattctgccttcaaatttgtggagtttataattcgtgctgtatctaaacttgactatgtcttgaagaaattatcagatactaattccactttaaattcttttgcactaccaaggtgcagatctaaacaaatatttgtaaatgggatcttga

SEQ ID NO: 73599 - DNA, 105 bp, Triticum aestivum
  Clone ID: PAT_TA_73599
agcttttggaaagcatggtatgggagaaaggatcatcattgtataactcactgattgttgccaggccatctattgcttcataaataaaacaccttggtcttttgg

SEQ ID NO: 73600 - DNA, 336 bp, Triticum aestivum
  Clone ID: PAT_TA_73600
cccttccctcgcctccatttcttctggttggttttgcaccactgacatcaagaggatcccagcagtaccgagccctcaccgtccccgagctgacccagcagatgtgggatgccaagaatatgatgtgtgcagctgacccacgacatgggcgctacctgacagcatcagccatgttccgtgggaagatgagcaccaaggaggtggatgagcagatgctgaatgtgcagaacaagaactcatcctacttcgtggagtggatcccgaacaacgtgaagtcgagtgtgtgcgacatccctcccacgggcctgaagatggcgtccacattcatcggcaact

SEQ ID NO: 73601 - DNA, 435 bp, Triticum aestivum
  Clone ID: PAT_TA_73601
tgcattgctatagttagtgctgggacagcgatcctcaaccccccagccattgtttgcggtgaaggtattctgcactatgactggatctttagtaaccttgtcgccattcagacggacattgtaatgcagtgcaataggcttttcagattcccctggaagtgccgtcccaacaagatcaatccagaagttaccagagagtactccaggagttcctataagagttattgaagaacctacaatcagcccacagggtacgtcaatgttctcccatcgctgatcgcctcgctcgcatgaggaaggccgttggtgatgttggctaactgcttcatctggttccatgtgtatagccactgaaacacttcaggggaggagtttctggaatccgagctgtttgaagctggaggagcatctgctgttgttactactgctacttcc

SEQ ID NO: 73602 - DNA, 399 bp, Triticum aestivum
  Clone ID: PAT_TA_73602
atccaattccaagcaggattgcagatagagcagctctaagcaatggagagttttgcccagaaccagaagcatgtcattggaattcctttggcctcgtatgcatatgccagtgaggaaggaaaaccttcctgttctgccttgattcataagaagaacaagaagacttccttcatttaccggatgaacaagctgaacctgaaaacagatagctacatgcaagggttcaaacaacacttaactctggggccaaaaatttctgaaactatcaaagggaaactaagcttcggtgcaaaggttctacaagctggcagcattgagaaaatcttcaggcaatactttgtagtggagaaggatgagaaattattgaaggctttccagtgttatctttcaaccacagct

SEQ ID NO: 73603 - DNA, 238 bp, Triticum aestivum
  Clone ID: PAT_TA_73603
ccggtctcatcggagcctccatgattttgctgaaagcagctatctgttgcaactcagctctgtgtagacaggatctaaagcagcagcccattttggttgttggtagcactaactaaattcttgaattttttctgtttcttctttgatcattccctttgcaatagtaataaaaattgcttctaagtcagttcttgattccaatcaagtgttgatgggattctttcgtgtaaataactcg

SEQ ID NO: 73604 - DNA, 257 bp, Triticum aestivum
  Clone ID: PAT_TA_73604
tcgctctgctgggtgccgcacactggctgaagcaaagatacacatagaacaaaagaggaaaaaagaatacgagctgaatgcccaaaaagctaaggagagcagccttattgcaaataataaatcggtacagaagatgaatcgacctatgaaaattgagtctgatgggaatttggagccaaagaaaggtggtgctggcttggattctcctaaaactacaggacttacaagtgttaagcagtgggatgactgggatatag

SEQ ID NO: 73605 - DNA, 464 bp, Triticum aestivum
  Clone ID: PAT_TA_73605
taaatgatgctttcggcactgcacacagagctcatgcttcaactgagggagtgaccaaatttttgaagcctgctgttgctggcttcctgatgcagaaggaacttgactatcttgttggagctgttgcaaacccaaagaagccatttgcggccatactttggtggatccaaggtctcaactaagattggggtgattgagtctctgttggcaaaggttgatgtcctcatccttggtggtggtatgatcttcacattctacaaagcccagggatatgctgttggaaaatctcttgtggaggaagacaaacttgagcttgcaacttcacttattgagaaggcgaaggcgaagggtgtttctctcttacttcctaccgatgttgtagtggctgacaagtttgccgcagatgctgaaagcaagactgttgctgcctccgctatccccgatggttggatgggtcttgatgt

SEQ ID NO: 73606 - DNA, 328 bp, Triticum aestivum
  Clone ID: PAT_TA_73606
accggcaccggcatcaacccggccagaacatcggagcggccgtcatcttcaacaacgagaaggcgtggcacaaccattggatcttctgggtcggcccgttcgtcggcgccgccatcgcggcgttctaccaccagtacatcctccgggccggcgccatcaaggccctcggctccttcaggagcaacgcgtgatatcaaggggttcgagaagccattgttgggggataatggctggaaggcgttgatgaagcaatggccatgatgatcgatgatgagttctaccgtgttaagattctcccttttaaaaaaaattaagttcgccgctggtc

SEQ ID NO: 73607 - DNA, 350 bp, Triticum aestivum
  Clone ID: PAT_TA_73607
tactcagccagttgcaactggttggttttggatatacaacgttcatctgaagctgcatattaccgtccagctcctaatcgctcttgggatgctgcaactgcctttgctttacttctttcagtggtagccatttgcctgtccatctttgtgggctaccgattttctaggaacaggagcactgcccagtttacaccacttgaacagatccagtttgctgaagaacgccattgattggaattgatattaggcgaagcagcaagaaacagtgtttcatctgtttcaccattgtacctccaaagttgacagattgctgcattgcagttttgaaccgcgatgttgtgagctagcat

SEQ ID NO: 73608 - DNA, 437 bp, Triticum aestivum; identical to SEQ ID NO: 73497
  Clone ID: PAT_TA_73608

SEQ ID NO: 73609 - DNA, 350 bp, Triticum aestivum
  Clone ID: PAT_TA_73609
aggtggcggagtacacgctgaagctcctgcaccgccggatcccgccgtccgtgccggggatcatgttcctctcgggaggccagtcggaggtggaggcgacgcagaacctcaacgccatgaaccagggcaccaacccgtggcacgtgtccttctcctacgcccgcgcgctgcagaacacctgcctcaagacctggggcggccagccggagaaggtgacggcggcgcaagacgcgctgctgctccgcgccaaggctaactccctggcgcagctcggcaagtacacctccgacggcgaggccgccgaggccaaggagggcatgttcgtcaagaactacagctactaatcgccc

SEQ ID NO: 73610 - DNA, 348 bp, Triticum aestivum
  Clone ID: PAT_TA_73610
ctgctacaataatgggggtggtgacttccaggctgaggcttagtagactaacagctaaatctgtacaaagctggagtaggttgtttgttacagatgaaaggaataattgaaggatccagagttgtgcagcctacctaagggaagggaaagcaaagaagcagcattctttgaagcgtagtttatctggataagcagcagttgttttgcagtgcctcactcactctagctgtgtgggacaagcacgcactgtcccaagtcgtcgtcttgtacaaatgtaagtttcagtcagacgtgtgtcagtccaagctagcttaacatgggtggaacctaaacgtgtccatatatctg

SEQ ID NO: 73611 - DNA, 355 bp, Triticum aestivum
  unsure (1)..(355): unsure at all n locations
  Clone ID: PAT_TA_73611
ccagcaaggcggcgaggtccgtgcgcgtcttcttcgactggaaggactacctcaggttctacgagatgggcacgtactggccatacacgccatccatccagctcctctacggactccgcaccgcgctcgacctcatcttcgaggaagggctcgacaatgtcgtcaagaggcacaatcgtcttggaacagccaccaggttcgccgtggaggcgtgggggctcaagaactgctgccagaaggaggagtgtttcagtgacacggtcaccgncgtcgtcgtgccgccatacatcgacagcgccgagatcgtcaagcacgcgtggaagcggtacaacctcagccttggcctcggccttaa

SEQ ID NO: 73612 - DNA, 330 bp, Triticum aestivum
  unsure (1)..(330): unsure at all n locations
  Clone ID: PAT_TA_73612
gcaccacctccataacaccacccagtttggactcatggccgtcagcctgggctactacgagacgctcatgtcctgctccgggagcagcaccagcagcgagatgccgcccgaggaccgcgccagggccggcatctccccgggcctcgtccgcatgtccgtcgggtacaacggcacgatggagcagcgctgggcgcagttcgagcgcgcgctcgcgctcatgcacccgcccacgcaccacctcagcctcaaaggcgccgccgccgccgccgaccgcgacggcagcgacgccgngggcaacaaccaccgcaagcactgactgacgcttgcgct

SEQ ID NO: 73613 - DNA, 149 bp, Triticum aestivum
  Clone ID: PAT_TA_73613
ccaaatacatacaacaacaggaaggccgagggtattacacttcatcagaaaatcatcaagcctcatgtttaacagcacaagattattggtgcaatacgtgaccataatatgctccacagagcattttatttagttactagcctactgcc

SEQ ID NO: 73614 - DNA, 357 bp, Triticum aestivum
  Clone ID: PAT_TA_73614
ttgtgttggtcaagttttgctttttgcgggcattacagttcagtgagcttgacattgaggttgctattgggtataggcatttcgctttgttttttgggtacataacctccaacaggtcatagatgttttgtggtgggaaaaatgtttccattttgttgttatggcaggcagtcctttagtttcatctgctcatatttggtgagtgaatgatatcaaaggagaggagccattcattgttgacagcgactgggttttgcatttggtggtattgggtgaaatgtaatcgtgttcaccattataccgaattaccaatacagaaaatatcgagtactgatttgctcatgactagtattgact

SEQ ID NO: 73615 - DNA, 429 bp, Triticum aestivum
  Clone ID: PAT_TA_73615
gtaagtacataacattagatgatggccggaaactctgtttggaatgcctgaatacttcaataatggacacagacgaatgccaaccactatatattgatattcaagaattctatgagggtttgaacatgaaagtggaacaacaaattcccttgctgttggttgagcgacaagctttaaatgaagccatggaggccgagaaaactggacatcaccttgctgaaaccagaggtctctgcctatctgaagagcaaattgtccgaactatactaagaagaccagtaattggaccaggaaacaagattgtagacatgattacaggaccatacaaactggttagacgctgtgaagtgactgcaattcttatcctatatggccttccaagactgttaactggctccattctggctcatgagatgatgcatgcttacc

SEQ ID NO: 73616 - DNA, 416 bp, Triticum aestivum
  Clone ID: PAT_TA_73616
atgctggtgaggaagataagcgggaatagttttcattcgccatttcgtcgacatctgacccacattgatcaagattggaagttccgagtcgatatggagctgacagtcatttgaattgatttctttgtgccagacctatctttacatgttgcctttttatacattcaaatacatgtagctgaacacagttaagtagaatgctacagttgtgtcttcccatcggtgcctttcatcagcgtgtagtctcctgtatgcgtagggtgcaagtacaacacgagtatggctcgggagaagtacaagactacaaggagttactgccacttagcaaggataaaagggaggctgatgaattgacaatgtgtttgcgagacgctgcccgcatgtatggatgatgagtgcagataggttgagtgtgc

SEQ ID NO: 73617 - DNA, 145 bp, Triticum aestivum
  Clone ID: PAT_TA_73617
acaaacacatgggatcggtttgcgttccgcatccacaagagggtgattgacctaatcagttcccctgatgtggtgaagcagatcacctccatcaccatcgagcccggcgttgaggtcgaggtgaccattgcagacgtgtaaggac

SEQ ID NO: 73618 - DNA, 143 bp, Triticum aestivum
  Clone ID: PAT_TA_73618
gcctttttatgagtttccaatcacctattgagattcctgctatcagcaattttgattttctgctcatggcattcaatgctcgcagagaaaagagtggtctaccaacattggggccccttgagttttactcagttgtatcgccc

SEQ ID NO: 73619 - DNA, 121 bp, Triticum aestivum
  Clone ID: PAT_TA_73619
cgagttattgacaaacggactaacaaaacataaggaaatgctgatgagaatgtcggtgatgaagttgacgaggaagtatgggggggagacgaggatggaggcaatgatgataatggtgatg

SEQ ID NO: 73620 - DNA, 539 bp, Triticum aestivum
  Clone ID: PAT_TA_73620
gattcggacgagggttcgctgcgcagatggcgtccgaggcggccaaggtggtggtgccggagtccgtgctccgcaagaggaagcgggaggaggtgtgggcggccgcgagcaaggagaaggccgtcgccgagaagaagaagtccatcgagagccgcaagctcatcttctcccgcgccaagcagtacgccgaggagtacgaggcccaggagaaggagctggtgcaacttaagcgtgaggctcggatgaagggtggtttctatgtcagccctgaggaaaagttgctgtttgtggtccgtatccgtggtatcaatgccatgcacccaaagaccaggaagattttgcagctcttgcgtttgaggcagatctttaatggagtgttcttgaaggtcaacaaagccaccattaacatgctgcgcagggttgagccatatgttgcatatgggtacccaaatttgaagagtgtccgtgaattgatctacaagaggggctatggaaagctcacaagcaaagaatccctcttacaaacaacaaagtcatcg

SEQ ID NO: 73621 - DNA, 575 bp, Triticum aestivum
  unsure (1)..(575): unsure at all n locations
  Clone ID: PAT_TA_73621
ttcggacgagggtaaaggcattactgcactagaggcctagggactacaaagttgtatgagttctcactaatgcctatgcatatgatacacgagtgcaatggattttttttcgttgtgctttcttttcttatccgtatgttcctctttttagaaatacctttggttattggtccacgacgccctggtgatgctgagattctcttttcgtcagctgctaaagcagagagagaattcaagtggaaggcaaaatatggcatcgaagaaatgtgcagagaccaatggaactgggcgagcaagaatcctttcgggtacgcctcgcccgactccaccaagcagaatggtcattcacactgatcaacgccgattggtctgtgtgaactcagttgtacatgcaacgtagaactacaggtcgagatcgatgtagatctagtcgggcagtcatacagagaaagcttagaaaagatttgttctcttcttttggaccagtantggtataaatctacccttctgcatatagttcaaaattgttgtaggaacattgctatagtcagtcagctaattcaattctttttctt

SEQ ID NO: 73622 - DNA, 572 bp, Triticum aestivum
  Clone ID: PAT_TA_73622
gattcggacgagggagcggcttatcctgtggagtgagtgccccggtgcccgtctcgatgatgacttccgcaccaggctcaacattggttacgtccaggagctcaaggtgctcggctacctggacctaaggatccacgtgctcgagatctccaacactatcatcgaggctgggacaaagccgagcccacgtaccattgttccaagtgtcaatatcctggctttgaaggtccggtttggagttcgcaaggaagctagaatgctgccaagctacctcagatgctttcccaatgtggtgacattgcatatcatgtcggatgaagctgatgaacccacgggcaagctcaacttcaagttctggcaggaagctggacccatcagctgccttcagtcccaaatcaagagggtggtgttcaagaacttcagagggaaccgcagtgagcttgcattccttaggttcatctgggagagagcacagctgttgcacaagatggtgattgttttggccgatggagatgatcctgcttcgttggaccagatggtagccaaactgaaacctctggcttgtgcaaagc

SEQ ID NO: 73623 - DNA, 366 bp, Triticum aestivum
  Clone ID: PAT_TA_73623
attcggacgaggacccaacaagcgtttgtgactgttgacaagaaagcaccgatcaaccaagacctcatcagcaacttcatgtctgaccctgttcacggtgccattgaagtctgcgctcagctgaggcccactgttgacatctcagtgactgctgatgcagatttcgtgcgtccggagcttcgacagtcttcataagctcgtatggatcttcagtgtgtcctgcaatggttagtttgtaagaactaatatgtgtgggcttttgaactattagattacctgtattgctcctgtttgaggaccagacaagtaaactcttggggtgtagtactgttgtggttttcaagaataagaataaatggttgatac

SEQ ID NO: 73624 - DNA, 505 bp, Triticum aestivum
  Clone ID: PAT_TA_73624
ttgactatgttgctcaagctactattgcggttggtgttacatcttcactcgtcctgttatgggctccgtctatatttggcctggctggagtttgggctggtttgactacactcatggggttgcgtatggctgcaggcattctgaggttgctatggaaatctgggccttggtcatttttgcatgaggagccataagctgaggtttatcaattatcagcctgtgcagtttggagttgttaacttattgctggggatttacatcactgcaaatattatccaagtgtcatggactcagtgaagctgttacctcggtactcctctggctcagaagaaaatctgacttgattgcaattcttgtcgagagaataaaatcagtctgctagatggcatggcttagtgaaccattggcacgaccttttgctaactctttttttctgctagcagctgtgtagcttctctagatgaaaagataaaagggtcgtgtatagcgttgacgcatgtaactc

SEQ ID NO: 73625 - DNA, 430 bp, Triticum aestivum
  Clone ID: PAT_TA_73625
ccaagctgagatctctggtgttttatactgatttcagaccaagcacactacaattgtcatcgccatataaatatctcaacagccttgagaaacttactgtggtaaggtccttgaaggttcctattggtttcacagggcaatacttttttcgtgtgcttgatatcagggtctgcaagctggaggaggatgatctgaagatactccaggagctgcctagattgcagagtctcattttgcggcttgaagtcctcccaacaacaatggtacggatcagctgtgaggggtttgcagaacttgagagtttgtatgttgattgcggaatgcctaggatgacatttgaggaaggagctatgccaaatctggaagatcttggactacagctttacgctggatcagctagtgaagaacatatgggcatcaagcacctcct

SEQ ID NO: 73626 - DNA, 432 bp, Triticum aestivum
  Clone ID: PAT_TA_73626
acgcgactgcctcttctccgacccggggcgcgacggctcaagcctgctcaagatctggaacctgaacaagtgcggcggcgtggtgggcgtgttcaactgccagggcgccgggtggtgccgcgtgacgaagcggacgcgcgtgcacgacgcggcgccgggcacgctgaccggcgccgtgcgcgccgacgacgtgtacgccataacgcgcgtcgccggcgacggcggcaacgaatggcgacaacggcagcaactgcgagtgggacggcgaggccgtggtgtacgcgcaccgcgcgcgggagctgggtgcggctgccgcgtggcgccgcgctgcccgtgacgctggcgccgctgcagtacgaggtgttccacgtgtgcccgctccgcgccgccgcgccgggggtggcgttcgcgcccgtggggctgctcgacatg

SEQ ID NO: 73627 - DNA, 624 bp, Triticum aestivum
  Clone ID: PAT_TA_73627
gattcggacgagggttcatatatggtttgacagaaagctgaaaaacacatatgaccatcttcttttcagcaggagttcacttttaagtgtctatgcagacatgtcagtaacctgcaaggaatactatgatccaaaccgttcaatgctggagttggtctttgctcctgcagatgaatggattggtcgaagtgacactgaaatcattgatgcaactatggaagagctagccaagttatttcctgatgaaattgctgccgaccagagtaaagcaaagattcttaagtatcatattgtgaagacaccgagatcggtttacaaaactgttccaaactgtgaaccttgccgacctctccaaaggtcaccgattgagggtttctatctggctggtgattacacaaagcagaaatacttggcttccatggaaggtgcagttttatccgggaagctttgcgcccagtctatagtgcaggattatagcaggcttgctctcaggagccagaaaagcctacaatccgaagaagttcccgtcccatcttagttttagttagtttagctatcgtcatccccactgggtgccatcttatcgcctatttcatgggaacccaccaaatggtcatgttggcg

SEQ ID NO: 73628 - DNA, 546 bp, Triticum aestivum
  unsure (1)..(546): unsure at all n locations
  Clone ID: PAT_TA_73628
aggattcggcacgaggcaaacctgctactgctacaagccaacaaaccaaggtccgcccctaacaagcagttcccaaagctacaacnttgagcacacacataagcaaagccatggcaaaggcacaggcaatggccgcgctgatgctgaccgtcttggtggtcctggcggcgtctgccgagatggcgcacggcgtctgcaacctgtcgagcgccggcatccgggcgtgccagccggcggcagccatccgcaacccgacggagcagccgtcggccgagtgctgcgccgcgctggcgggggccgacctggcgtgcctgtgccggtacaagaacgccgccggcgtgtgggtgaggttctaccggatcgacatcaaccgcgccatggggctgccgggcaagtgcggcctcgccatgccagccaactgctgaggcatggtcaccgtgcgtcactggctcatccacaataatgcaatgcaactgctgatgccgcgcgcgcgtgctgcgtgcgtattctactgctatatatagctacgacatctatcgaataaat

SEQ ID NO: 73629 - DNA, 124 bp, Triticum aestivum
  Clone ID: PAT_TA_73629
gctgcgcacttattgaggcagcagaagctatttcttcaggcacagcagaagcagaagatgcagtttcaaaggctggaatcatcattctgcctgacatgcttaaccagaaagaatatggcaatgc

SEQ ID NO: 73630 - DNA, 520 bp, Triticum aestivum
  Clone ID: PAT_TA_73630
tctgcacctgtcctggcatatgctggtgctgtttttgcagatgcatgcttgaagggtctgaatggagttccggacgttgtagagtgctcttttgtgcaatcaactgtgacagagttgccgttctttgcctccaaggtacggcttggcaagaatggagtggaggaagtgcttggtcttggtgagctcaacgacttcgagaagaaggggcttgaaaacctcaagggcgagctcatgtcttccattgagaagggtgtcaagttcgcccacagcaactaggcaacttgctcggcttctaacaattgatatcccttgcattttttgtttgactgcctatttttcctgcccccttatggttggcgcaacgaggctttgtggtccaaaataaaactcagcggaacgaagaaaacatgtaccagaaacagtttacaaacaccggtgttttttgtgctgaactcccagtagttgagccgtgagggaatcgagaacaaactttccactttctcaaaaaaaaaaaaaaaaa

SEQ ID NO: 73631 - DNA, 188 bp, Triticum aestivum
  Clone ID: PAT_TA_73631
aggattcggcacgagggggtgtcgtcgccgagttttctccggcggagggcggcgcgaccggcaaccagcgtgagcgcgaccactcggcgacatgactcatatccttcctaaaccccgattagatctgactctctcttccctctaatctatctttttcgattctgttattgccctgttcctccttcctt

SEQ ID NO: 73632 - DNA, 499 bp, Triticum aestivum
  Clone ID: PAT_TA_73632
cccgtcggttccccaattcccgcatcgcctcgatcgcctgtgccccctgccacctcgccgccggcatgacgacggggtcgaccccgggttcgccaccctctcaaggatctcagagaaagcggggttctaccaaagattctgttgccttgtatgcagtgcaatgctataagtgctacaaatggagtacggttccaaaagaagaatttgagacacttcgtgagaacttcactaaggatccatggttctgcagcagacgaccagactgctcttgtgcagatgatgctgacattgagtatgacagcagccgcatctgggttttggacaagcccaacataccaaagcctccaccagggacagagaggctagtgattttgaggagtgactacagcaaaatggacacatattatgtaatgcccaatgggaagcgtgcaaggtgtgctggtgatgtggataagtttctggaggcaaatccagagtacaaaaacagcatatctgtttc

SEQ ID NO: 73633 - DNA, 288 bp, Triticum aestivum
  Clone ID: PAT_TA_73633
ccgtgcagctgcacagcagcagcagcagcagctcgcacggcgaggagatggagagatggagatggtgccccttcttctcctcccctccacaactttccttttctttgagaatggattccctcaccaccacattattattttagctagtagtacagtactagctcttcttcttgttgttcttgttctttcttcttcccctttttaaatccattcaccaccacaaactagcttagcttagcttagctagggttcgtggtcgatcggtggaggagttggggaatggaggga

SEQ ID NO: 73634 - DNA, 480 bp, Triticum aestivum
  Clone ID: PAT_TA_73634
attcggcacgaggctgacgttcctgtccgggatccgcgcgctggcgccgctcagcgccgtgctccacaacctggcgctctccgacgtcgggctcctggaccagatcgcgaccgccgacgacctgcgctccgtcgagcgcgccgacggagccggcccaggtgtactacgagtacgaggtggcgggcgccggcgcgcacagcctcatctccgtgacgtgcgcgcggaacaagctgtatgcgcacttcgtcaccgcgcccaacgccgagtggagccgcgacgaggccatgctccgacgcctgcacgagtccttcaagaccatccagcccggcgccccgccgccggtcaccgagacctagctcttatctgagcaggaaggctactgagcagagcagtgcgattcgttgtgcattgtaattgctagtagtaaaaatcatcagttttgtataggctgggaaagtaaccagatgcttccttcatttg

SEQ ID NO: 73635 - DNA, 575 bp, Triticum aestivum
  Clone ID: PAT_TA_73635
aggattcggccgaggaggaaccgaacggacccccgagaaaagaatcggtgcgtcggaaggaagagcaatcccgcggtggcggagcgagtacccagtccctacggcgagggatgtggtgggagtgggaaggcggcggtggggaagcgccgcgggaggagacccccgtcgacttcgacttcatctccctcctttccaagcccaaggattactacaagatactggaagtagactacaatgcgtcagaggagacgatcaggtccagctatatccgccttgcactgaaatggcaccctgataagaagcagggcgaagaaagttcaacctccaaatttcaggaaattaacgaggcataccaagttctgagtaatcctgcaaaaaggcaagagtatgacaagaaaggcattctatatgttcaagatcagaatgtagtggactacctgaaccggcacaaggggctaatacttacctgcaatggtcttggcataaggtactcagtatggtgaacatgctcaggggtccacagtttgcacccatctgcagtcttggagaatctaattgtaaaatagcattgatct

SEQ ID NO: 73636 - DNA, 577 bp, Triticum aestivum
  Clone ID: PAT_TA_73636
tcggcacgaggccggtgatcagggagccatatgtttacccagctgaggaggtagccagtgtcaacgtcggcattcccatgccatactccaccccacccatgagctaccctgccccctatggcggttatggcaatgggatggcagcttacaccaatggaatggctcctgccttccaccaggcttactaccggtaggttcagtcaggaaacaaaacaagtcgctgatgaatgacatgacaacaactgatgatgccaacgactcagaatcgcacaatggccctattttgtagtgactgactacaacggtaggttgggtatctcatcttatatgtccttaccactactactagatgtgttgtgtttagctctcgtctcatcttagaccactacctttttttactactaaggaacctggatgtaaattatgtatggtatcagcgagactgtcgtcgcatccttatgtaattctattcagaactttggaaaactaaaaaaaaaatcagcatgtaatccttaagtaccggatgtaccatgaacttaattaaaagtgtttttagtttaaaaaaaaaaaaaaaaaa

SEQ ID NO: 73637 - DNA, 688 bp, Triticum aestivum
  Clone ID: PAT_TA_73637
gattcggacgaggcttcttccctcgccacccatggccaccgcagcgcgcgccctcgtcgccgcacgcccggcgcggccgctcctcccgtcacggcgcctcccgtcctcctcttccatccgccccccgcggcaacgtggcggcggcgttgggtccgtccgctgcatggcgcggcggccggattcctcatattccccgctgcggtcgggtcagggcggtgaccgtgcgccgacggagatggcgcctctgttccctggctgcgactacgagcactggctcatcgtcatggacaagcccggcggcgagggcgccacgaagcagcaaatgatcgattgctacatccagacccttgcccaggtggtagggagcgaagaggaggcgaagaagaggatatacaatgtgtcctgcgagcgctattttggattcggctgcgaaattgatgaagagacctccaacaaactggaaggccttccaggggttctatttgtgcttcctgactcttatgttgatgctgagaacaaggattatggtgctgagttatttgtgaacggtgaaatcgttcagcgatcgccagaaaggcagagaagggtggagccagtgcctcagagagctcaagatcgaccccggtacagtgaccggacccgctatgtgaagcggagggagaaccagtcttaccagcgatgatgatgc

SEQ ID NO: 73638 - DNA, 636 bp, Triticum aestivum
  Clone ID: PAT_TA_73638
gaggggcaatctgtaaacgttggctcaagtggggtcttgttcgcggggttgctagtgcactagctagccttcctgacagcttgaaagaaaaactggtgccggatgttcagcatagagggaaattacaggatctgcacaactccgtgcacgaaatatcagctgatgatgctcttcagatgttccatgagagtctttgccaaagtaatcgtccttcagagggatcaggatcacatgtaacgtcaacctcaaatggagctacagaatcaaataggatggaaagcctatcaaaggatcttgtgttgttgttgcacgaatgctcagatattaaggtaagtgaagagttggcatgagattcatgaacagggtggccaggaatttctaccattacggattttccaattctggcagaatcgcgttgaattcctagattactgaacatatacggatgaaactgggctatactaggtgaatgtgatccgggaaatttattttgaaaggagctgatactcaaaaggctcaaacctctgagacctagaatgtaaccgtggatcctgttattccatatttcccttttgctgcaacctgtaactagaattgtaacctgttactcctataaaaaaaaaaaaaaaaaaaaaa

SEQ ID NO: 73639 - DNA, 617 bp, Triticum aestivum
  Clone ID: PAT_TA_73639
ccctcctgtcccaaaaagaatctccacttcatgattctttgagatcaataccggcatcaatttgggaatctcatattcgagttggaatcactgccattctccaaaatcgtgttgtatcctctgaaaagctgcacacacttcttttggcggagtgcatgatgtccatactaggcgagaattggttgtcagaagattttcatgtcccggataatcaaaatgtgttgcctgttgacaaattcatgttgcttgtcctcgaatccgcaagggttgaagtggcagtcctgctaaatgagcttgcttatctgaagtatgagtcgtcaaaaacttctcagacagatgaagccatctgtcagaaacagagaaacctggctatactattttcattaatagaaaaaataatcaaaatgatatcaaatgccagtagtggtgaaggtgcaccaattcagaccatccatgaaagtaccataatgcaggccattacgggattaaatgagacaatcagtttagtcttagattttcttcaggacgcaaaggatcatggtcaacagaaaggtgatgatcttttggcagctgcaagaatagtaggaagttatctggcagaagcaccatatgcctgc

SEQ ID NO: 73640 - DNA, 254 bp, Triticum aestivum
  Clone ID: PAT_TA_73640
ttcggcacgaggaattgtttcactcatggttagatgcaataggtagcgttctggcttcaaagggccaaagtttcgttgtgcacatttttttttccaaatgaattggtatatactgagaatcagcgcattccatagttcacaatttcttcagtgtattcaagtagatcatgaacgacgccatgacccagaaagatcagaacatactactgaaaatgaaaatgtttatatagtagcataagactttacaacaagtt

SEQ ID NO: 73641 - DNA, 363 bp, Triticum aestivum
  Clone ID: PAT_TA_73641
gtgatctgtgaggacgtttcagtgctcaagcaaagggtggatgagcgcctatcattgagcaaggtggagcgctcatgtatgtctagcctctcttcttcactgcattcttctcggcacaagagctggacttcctcggataggactactgaagcaatggagtctccagataagcgcacccttgttgaacctgcaagcccagtgtgcaaagatctggatggagatgacgaccagtgcactgtggaagtgtcatatggcaacgacgctgggaaaggtatcttgaagcgcgtgaattccaaggaggacggagatggatgggagctttgctaaagatgttcaggaatagcggccttgccatatgatgct

SEQ ID NO: 73642 - DNA, 469 bp, Triticum aestivum
  Clone ID: PAT_TA_73642
ccgtccagactgaaaagaaagaaacaccacaagaacgacttaaaagaataatgagcaaacaacttaacaagcaaattcgaaaggacactgctgctgagatagcaaagaaacgagaacaggaacgccaaaggcaggaaaaacttgcggaggtaggtcggtacaggggtcgaagcaggagccttagccgatctccaccaagaaggcgacattatagcagaagccgtagtaggagtagaagtccaaggaggtaccattcacgatcccagtctcattcccgttcgccttctcgctctccaaggtacagaagcaggtcaaggcactgaataccagctgcaccaatcaccaatgaagtaacccgtctctgtactctatatattcacattgtggtgtttttagattttatttgcttttgcttctccacgttattatgttttaattcttcttgactgttagaagcaccctggatccc

SEQ ID NO: 73643 - DNA, 215 bp, Triticum aestivum
  Clone ID: PAT_TA_73643
gagggttcggatccacatccttcccgagcgaagtcttgggtgacctcttcctcttcgaccacctcctaggctcttggtggagcttggcactctcaccagtcaaggtttcatgtctgatctcgacagtcagatcccaagtgccttcgatccctttgctgaggccaatgctggggactctggtgcggcagcgggatcaaaggactacgttcatgtac

SEQ ID NO: 73644 - DNA, 641 bp, Triticum aestivum
  Clone ID: PAT_TA_73644
ccaattgttaatctctcccattagctccataggagtgcgtgtgggtctgccatttttccccttcatgagcctatgatgaagattccatactcattactcaagaatatgatatgatgttaaatatttctaggttctattgtgtactctgattgacacattctatttctataataattcaataatatatgttcacaaggtctatttgaccttttcaatacaaaatggttgtttaagatactaaaatgggcatcctatcttattggcttatctgaaaatcattgttgccttctttgccagatcaattgttcttcttcgactaatatgatctctccttcaattgggaatgcgtccatgaacaatcagcgtggacacgttagtaaaaaatggtggtatatgggttgtgaattatgcaagaaaaggctacataatgaaggtggctcatattactgtcagccttgcgattgccgaagcgccataccaatgtataaattttcacttattgcagccgatgaaactgctgaagcaagatttttctgccatgatatagttgctcatcacctcatatgtcgcaactacaattcgctgctcaaactattagctatccaccaggcttacctgcacaaatgctagctattatccct

SEQ ID NO: 73645 - DNA, 436 bp, Triticum aestivum
  Clone ID: PAT_TA_73645
gattcggacgagggtttggatgcaccgatgccacccaagtgctcaaggagctcgaggaggcaaagaaggcataccctgatgccttcgttcgtatcattggctttgacaacgttaggcaggtgcagttaatcagcttcatcgcgtataagccaccgggttgcgaggagtcaggcggcaactaagcgctttcgttccttcgtgcatgttctttctttttctttttttttttttgtgtgtccgtgttaagctgcacgtaattgttctctcgcgctccgacctgccgttgttgcaagagtactactacaactatcggtctatcgttcggtgacggtgagacagggcacgtgaatgcaagatctccggctatacacacgtactcatgtaatatgatgcctagagcatatctgaatccgtcgacaatgaaattttggttttg

SEQ ID NO: 73646 - DNA, 568 bp, Triticum aestivum
  Clone ID: PAT_TA_73646
gattcggacgaggcttgattgtggtgcttctccagggaccccggtggcctcgagtgaactgcagcggagtcgcccgggattggctacccatcagcaagcgaatctggaggccccaagttgccggcggcaaagctctggatcgagtcgagccgctagccgtctcatccgccactggagcagcgcgaccttgccggtgcagtgcaccgcgactcccacgttgagtgcagtgggtgtgtacccctcctccccttgcagtccagccgcccttggcttgcagtgcgctggcacgcgcgttgccgtgcagttcattgacgcatttccctgacttttttgtttcctgctattccactgaagtgtgcctcgccttcgtccagttccctttgcctttaggtgtttttcaaagggataccaaaaaagaggttcaaacggcgtgcaatatacggtggagcgctgctacactccgctgtcgagcgacagccacaaaacgatgccagcatgcagttcggtaccaaacgcgatgcaccccgggcatgagagttccttcgggcatcaacttgaagtgcacatg

SEQ ID NO: 73647 - DNA, 277 bp, Triticum aestivum
  Clone ID: PAT_TA_73647
tggtggagtgggtcctcaagaactcctcgtcatgaacaaaaccccttcggcccttccccacatgttacatgcttttccaagctgccagcggtgaagaaaggtggagagggtttaccatggttttttccccccttttgtgctaccattccattccacagttgcagccttgcaaactgcagacccgcctcttggcatgccaagtgggcgtgtgtgataccgttgtgatagaataatcatcataaagggtttggacttttagaaaaaaaaaaaaaaaaaa

SEQ ID NO: 73648 - DNA, 472 bp, Triticum aestivum
  unsure (1)..(472): unsure at all n locations
  Clone ID: PAT_TA_73648
ttcggcacgaggaagcacccggagcaacctggtggtcactcttgagatgtgcatgactgggctggacaagaagaaagcttctgtcttcttcaagacttctgctgatggacacacaacatgtgctaaggaaatgaccaagctctcaggtatctctgacatcatcccagagatggaagtctgcgacttcgatttcgagccctgcggctactccatgaatgccatccacggccctgctttctcaaccattcatgtgactcctgaggatggcttcagctatgccagctacgaggtcatgggcttcaaccctgcttcccttgcctatggtgaccttgtcaagagggtgttgagatgctttggcccgtcggagttctctgttgcggttaccatctttggtggccgcaaccatgcagggacctgngccaaggggctggatgtcggggcctattcttgcagcaacatggttgagcaggag

SEQ ID NO: 73649 - DNA, 423 bp, Triticum aestivum
  Clone ID: PAT_TA_73649
gagcggtctgcttacgaagttgcgatgcctgccatggtcaagcccgcctcccgcgctgctaagcccgcgtcggcgccgaagaagcagaaggcaaagccctccgccgccgccggtggttcctcccacccgccttatttcgagatgatcaaggaggcgatcacggtgcttaaggagaggaccggctcgagcgcgcacgccatcgccaagtacatggaggagaagcacggggcgtcgctgccggccaactacaagaagatgctctccatccagctgcgcgggttcgcttccaagggcaagctcgtcaaggttaaggcctcctacaagctctccgacgccgccaaggactcgcccaaggccaagcctgccgcccccgcccccaaggcagcagcgccgaagccagcgaaggacgccgccaaacccaag

SEQ ID NO: 73650 - DNA, 428 bp, Triticum aestivum
  Clone ID: PAT_TA_73650
attcggacgaggagaactcaaggccctctgggactcgcaggtcaacgacgaggagcagtgggcgctcaactataagctgctgaaggctgctggtctgtttgcgggatccatcttcctgatgcggaactttggtgatctgatggccatttaagcaggcttagtgttgtttagaagcatagtggtttggcagtcaatatcgtgggattgtgcccctgtggagttactctacttggattctatgagtttgttttggtgttccaagaattcatactatgcataaagaggacgatctggtcattagcctcttggccattgcaaactcaggccgtcaggcgtgatgtagcaatagaaattagatcttgctttaatgtggccctgtatcatgaatattttggaatgatggtatctacctccatatttttcaccta

SEQ ID NO: 73651 - DNA, 487 bp, Triticum aestivum
  Clone ID: PAT_TA_73651
gaggggaaagctctgctagagacgatgaaggggaaggggttcgtgccagacgaggaggctgtgcgtggcggcactgtgaagcgggggcaggtgttcgacggcataatgaacttgctctttggcaagtaatagtggcctaagcacggcatggaacttcagtgcacagaaatggacggaatcagcggcaacagagaagcaagaggtagtacataatctacatctatcaggttaggatggtgtcattagttctgcaattttttcatatatgaatttctataggattacgttgaatagtgattacctgatagtctattccatgatgttagctggatcttttttttccccttcagagagtgtgcgtcagaattcagaaagataatacatcacgtggattatcatctgacctacgcaagtacaatatgctctcctgtaggcataagagattcagtaagcaataattcaataaccacaccaatgattaacactc

SEQ ID NO: 73652 - DNA, 375 bp, Triticum aestivum
  Clone ID: PAT_TA_73652
gaggtggactttgaatcagagtcagtcccatcttacctccaaccagaccaagaatctgaactcaacttgcctgctgcaccaactggccatgcagcagtcccagcaaatcagcagcaggaggatgagctagggttgccgacagtaccacaagcttccattcgtacctagttaaacagaatcacgtttcttggagtgaatgatgtaaagagagtcgtatgatatctacaattggatgtaaaatgttcttatgtaccgcaccactgatttttttgccacttcacttgtggacggtgtaaatgtgattgaattgaattggttgggacataataagatcctccttgtatttggtggtggagggctgtgctctgccaaaaa

SEQ ID NO: 73653 - DNA, 557 bp, Triticum aestivum
  Clone ID: PAT_TA_73653
gaggctgacgagggccgcctggtttacaaggcattggaaaatgctgcagatcgtaagatcaaaatcaggattgtccaacactctggattcgctcctgattttgacaaagagagcgccgatctggctgcaggaagaccaaatgttgagaatgcaaccgttctttttgaggattggtggggatctggtgttgtgcatgcaaaggtctggatatcagataaaaaggatgtgtacatagggtcagcaaacaacgattggaaatcccttactcaggtcaaggagcttgggatttattttgctaattgcccacagatagcaaaaactgtggaagtatattttcaaaatctatggacgctttcaaccctcaactcaacttcttacaccaaacaagcctgggataaggagtggcaagtttctagaaaggttccatgctggtctcatttcctacagccaaaagaaagatgcaggtcacccataccactttcagttgacatcccatatgtagatggatatccagctcttgcaatcctgaaatgattgatgtttcatttgaaacccct

SEQ ID NO: 73654 - DNA, 533 bp, Triticum aestivum
  Clone ID: PAT_TA_73654
attcggacgagggtggaaccgggcgtacaagcgctgcatgacgatgcttcggtcggtgtacgccacgctccgcttcctgccggcgtaccgcgtcttccgcctcctctgcgccaaccaatcctacaactacgagatggtccaccgcgtcggctccttcgccgtgccgctctcccgcgacgaggaggccgccatgcgctcctaccagttcgtccccgtcgagacgcagcacggccgcctcgtcgtctctgtccagtacctccccagcctcgctgccttcaatctcgagatctcctccttgtcgccctccatgctgatcgccgactacgtgggcagccctgctgccgagccaatgcgtgccttcccagcttcgctcacaggagccacaggttccgctttcccgcaggcgctgtccaatcagccgcagcgcccgcacagctgggcgacgccagcgctctggccgcaggcgcctaggcagcaagctagattttcgccacctcatttgctcaacgcatcacccactccatcgccaccca

SEQ ID NO: 73655 - DNA, 436 bp, Triticum aestivum
  Clone ID: PAT_TA_73655
attcggacgagggagagagagaactagtctcgagttttttttttttttttttttttttggacagaccctactggatgacccattaattcaattgagttaacctactcatccttaccatactgacagtcaggtacaactgcaaattctgagctgtccatgtccagatttcccgtatagcactgcaaccatacaaacaggtgtaggcaatggaaagcgtacacacaaaccgggttcaccaagaacgcagactttcattacatgatatcagactctgtttttattgtgatgttcaactctggataaaacgtcttagttgaacacaacgacacaagacagtagcgcgacacccacaaagcgtacatggacctcgacactggggctgggagttataggatacagagtggttttacataattacatcatccatgggctactt

SEQ ID NO: 73656 - DNA, 465 bp, Triticum aestivum
  Clone ID: PAT_TA_73656
accttcctcccttccctcccgtaggggccaaagggttagagaggaagagaagtagtagttcccaagcctataacaagctcatcatcgtgattccagcaactgttctttcagttgtatagcttgtgttgggaaattcttgtgaccctattatattatttgtagctccccctttctgtcgtaatggcaggtctatctctgcagcacccctgggcattcgcgttcggcctccttggcaacgtcatctccttcatgaccttcctggccccgataccgacattctaccgcatctacaagaccaagtcgacggagggtttccagtcggttccatacgtggttgccctgttcagcgccatgttatggattttctatgcactgatcaagtccaacgagaccttcctcatcaccatcaacgccgccggctgcgtgatcgagaccatctacatcatcatgtacttcgtctatgcg

SEQ ID NO: 73657 - DNA, 535 bp, Triticum aestivum
  Clone ID: PAT_TA_73657
gattcggacgaggcctaacgggaggttgttttgggggaaaaactattggccctaatctcttttttagtaacttgtgcaatctgattcgtaccatccatttaaggcctgttttaatcaaagtggcctttggaaattgtgccaatcaattggggtgtgttcggttgctttcctgtgactgtattctggctgagtgtaagcatgttgagtgcatgcagtgacctgaaagtagtgtttggttggctgcttgggcagatgcagcaaccctgcatctgtgcatgcaataaccatgtggagatgtttggttacctgtatgggcggatatagactctttgcctgaggatgacgtgtgggccagcatgatatacatagcatccacttttgaacacatccattgggccatcccttaacagacaaccaaacaggcttgtttctgggattatatggattcacttggctaggatggagcatatcccacccaaccagacccttggtggactacttctttaatgaggggcatcgctcagatatatatttt

SEQ ID NO: 73658 - DNA, 554 bp, Triticum aestivum
  Clone ID: PAT_TA_73658
gattcggacgagggaaaatgatgaattgcctaaagatgatgataagagtgcgaccaaacctaaggaggctattagcaaaggtaaggattcaaaagatgaagggaaatccactgaaggaaaagctaggtcaggtcggaaaccaagaaatgctggtactcccctgaagagtgatgctgacaaagagaagcggaaggagaaagaagtcaaggcagctgaaatagagcaggaggcatcaggaaatgcttctacaggaaagtcagggaatgcttctacaggaaagaagcgcagaaggaaggcttgaagttaacactgatgaacttctcttgtaaatggatgtgctccctaggtttgctcctttaggcagaggcgttggcgctgcaccttgtactattgagcgttaactcgaaatttcgtctgattggtctctattagttaggtgtggaagcaacatttgctatagctgtaatgttaggagtaacatgtgttcgttgtggtcagatccatgttgcattggcgctgagccttaagcggaatgaaccctatgctcgctgtga

SEQ ID NO: 73659 - DNA, 460 bp, Triticum aestivum
  Clone ID: PAT_TA_73659
gttgagcagagccagcaccaaaccaaaccctcgtcgcgctcgtcccctccccctctcgtgctctctcaccccggccagcggcatctgagattcgcgcctcgccggcggccatgggcggcgactggcaggagctggcccagtcggcggtcatcgggctcatcttcgccttcctcgtcgccaagctcatctccgtcgtcctcgccttcaaggaggacaacctccggatcacccgctccgcccccgaccccgccccctcctcctccccggacgccgccgcccccgcgctcgacggcggcgacggcgacggcgacagcgacagcgacggcgactgggagggcgtggagagcacggagctcgacgaggacttcagcgccgcctccgccttcgtcgccgcctccgccgccggcgtccccgaggaggcgcagctccgcctctatggcctctacaagatcgccaccga

SEQ ID NO: 73660 - DNA, 424 bp, Triticum aestivum
  Clone ID: PAT_TA_73660
attcggacgaggagaagggtttggatcctctgagcttcaagtttgttgagcatcacaagacaccagcatttacctttatctcatcacatgatgaaagtatctggaacttggacggagagatgtttcaggcgagtgaggtatctgtccaagcttgccggggccttgtcaacctgtttgcttcggggccagaggtgtagtaatgctactcgcctaggagagagacatccttatttagacttgtatgttgtacacccttgactcttctttgtattttagtagagacctagaatactttgttgatagatatactgttagctacatggcatggaaacaacaacccatttgtgccatagaatagaggaacaaagaattttgactgaattaatgaagtaaaaggttcttcttcaaaaaaaaaaaaaaaaaa

SEQ ID NO: 73661 - DNA, 595 bp, Triticum aestivum
  Clone ID: PAT_TA_73661
tcggcacgaggagacatgccaactgcaaaagttgccctagttgaaaacgtgaacgaggggaacagagatgagccaaatgtctctctttgtggggaattaaattggctatcctcctcaggatcatgcgaggaggacattttcagaaggtatcttgcattcacaacagcggatgtagagaatggctggtatggtggaacacttatatatgaccgagatgaaaacagcggagcttacaaacactactctgaactctgccagggagctgtcatggatcctttcgagcacgaccctgagaaagagcggcattatgcagaggcccttatcgtggatcttgacgtttcaaatgatgcacgggtagaggccgaaatgcaagctgcgctggatgactaccagatcatagggtcggacctgagcattatcccttcatgcggagcactcgcggaggatccgagtcagctgacgaggtggatcattggagatgagaagctgcttgtgggtgctgcacagtagaccagtgcgtttctatggaagtttgtacagcaacagattaccattcatcgactcagcgtttgtgttctagttagctatttctctg

SEQ ID NO: 73662 - DNA, 520 bp, Triticum aestivum
  Clone ID: PAT_TA_73662
ttcggcacgagggtcaactccactgcccgctgcgctgctcttcgagtagtgcgcgcgtcccgcggcgtggtctccgttcgaaccgaggcccagctgctggatcggatcggatcggcgaggcagccaacctatcccgcccggtccagcgatctccgcgccggcagcgcacgagagggatggacgcgtcgcacccgaagggcgaggccgcggcggggtgggtgacgatcgaggagtggagcggctcgtcagcctccgcgctctcccgcaccgccgtcctcaccgcctccgcctccgcctcctctctcaccgcacacaggttcggcagccgatgggggcagatcgggagccgcatgctcggcgccttcgtgcctgagggctttcctgggagcgtgactccggattatgtcccgttccagatgtgggatacgttgcaggggctctccacgtacatccgtgcaatgttgtctacacaagctcttctaggtgcaattggagtgggagaacagtctgcaactgtcat

SEQ ID NO: 73663 - DNA, 576 bp, Triticum aestivum
  Clone ID: PAT_TA_73663
gaggctgtacattgctctgtgatctgtcacgaaagttgagaggcgaggactgctcctttcaagtagacactagcttagcattcgaggattctgctgatggttcttctctgagttgaaattgatacttgatgtacctcagctgttggtgaacttccagaagaaacctggtggaagaaaatggattatcaaagggaaatatgcccataggtactgcaaactagtgcctgtcttttgtccctactatgtatgatacatcgcatgcaaaagagcagatcagagcctgacagatcagagcctcgaggatcagagcaaaactaagggcatgtgtttctgtagtgcgtactgcacatcgccatgcatgatagcaggtatgtgagctcttactaaaaggctcttggcatccattgctcagaaggtcaatgtccatagtttaagctcggttgtcggaccacatttaggaatggttgcatgaaaatactctcaagagcagacttcatgtgccttcttgaggatagtggtcaatgaccagatctttcatgtttatatgcaaagaaatgtaacatgtactggctatga

SEQ ID NO: 73664 - DNA, 509 bp, Triticum aestivum
  Clone ID: PAT_TA_73664
tcggcacgaggaagaaaggaggctttttgcagaaaataaggaccagcctggtgtatctctgcccagctgagcacatacctccaaaaattgaggtggacctaacaaatcttgatgtcggagatagggtattaatgcatgacattccggtccatccatcgctcaagttgctgagtaaaaacgagaccatgcccatctgcaagatcttggcctcaaagccaattgagccagtcgagtagccagcactgcaaatatttcagagttgataacattgtacctttgggtggtactgccctccagcatctccatctcttggcttggttttttgttatccgttccctaggtttcaatgtgatagtgtattcagacaagctatgagcttcaagtaaagatatatgaaggaacaaaatgaagaacaatcactggagaaaccttgtctgtaccaatcactatagaataacatcctttctcttttgagtgttcgggttcagggacacatgacatgtaagaag

SEQ ID NO: 73665 - DNA, 414 bp, Triticum aestivum
  Clone ID: PAT_TA_73665
gattcggacgaggaggacttcccggcgcccgttcaggatccacatccttccctagcgagttattggttgaccgcttcctcttcgaccacctcctaggctcgtggttgagcttgccactctcaccaatcaagttttcatgtcttgtctcatactttcagatcccaactgccttggatccctttgcttaggtcagtgctgtggactctagtgcggcagcaggaatcagaggactacgatcatgtactcgtccaacagcggaatggtcatgggagtctgactactatccatggattgggaaaggagatcgagtacagcaagatcctcagagatctcaataaagagtattgctgcaatgtgacatgggaccatggacccagaacttggacagggcattcgactccagggtgatcagag

SEQ ID NO: 73666 - DNA, 469 bp, Triticum aestivum
  unsure (1)..(469): unsure at all n locations
  Clone ID: PAT_TA_73666
acatgtccataaaactactcatgatatattttcttancacttgagaaattataatatgttcagcataagtgataattgataaatgtatgccaaacagcccactgatgtaattataactgcacttcaacaaattaattattataaataattttgagaaaaaaaatacatttagaattagtaaaggtgtctcatgcaaaacataaagaaactattttttatgggaataaatgaagaactattttcatcacatcatattctctttgtttccatgaagggcaccgagcatgaataacagaacttgctatgctaccacaagtatagcagggggcacacatatggttgagttgaagcaagcccagaggaggccaccattgataagagtgctcattcctacttatcaatgcaatcttctttaagggtgccgataactaactatgattaattaaaattatgctccacactaactgtg

SEQ ID NO: 73667 - DNA, 542 bp, Triticum aestivum
  Clone ID: PAT_TA_73667
ttcggcacgaggcaacaaacaagtttcatgtctgatctcgacgttcagcttccatctgccttcgatccgtttgctgaggcaaatgctgaggactccggcgctggccctggagcaaaggattatgtgcatgtgcgcatccagcagcgcaacggcagaaagagtctaactactgttcagggcttaaagaaggagtacagttacaacaagatcctcaaggatctgaaaaaggagttctgctgcaatggtactgtagtccaagatccagagcttggccaggtcattcagcttcaaggtgatcagcgtaagaatgttgccacgttcctagttcaggctgggattgctaagaaggacaacatcaagattcacggtttctaagctgcctatagatgctcgtatgcaatatcgtgtgctgccagatattgggaagcctctgaagctaccagttactgttctctatatttgaagtcataagactatttgttgctattaaagcgattcttgcttgatgcaagttgtgtcctcattatgcactaccggcatat

SEQ ID NO: 73668 - DNA, 651 bp, Triticum aestivum
  Clone ID: PAT_TA_73668
aaacaaccaatcatcaaaagggggacagtaacaaagtatatactaatgtgcacgctgcaacaagttcgcatgatgaacatattatttgccagtcacaaaaccatcatttgaggtacgcagccatgggtcatccgaccacaattggaatagttttgcatagtgtaaaggaaaatcagcaggctcttgctaactttgaggcgatacttaaagagtagaccagaattggcgatatcagacaagatgatgagatagctagttcaacaacactccaaaaaacctccatcaagatggaccgatccaaccaaacagcgtttacttgtcttccccttcagaatgagcagaaggaacggtcgaaactttgggtgaccactttggaggagcaccattgaataagtatgaacattcagtgtacgcagctcctatccccacaccagctccgagcgcaactgatgcccagcgagtagttgggctacggaagaggaggaggcccgcgaaggtgccacccagggtggagtaggcgacgcggcggatggatttttttgcaacgatgccaatgttctcacattgctgacaagttagcatcaatttgctgacatcagatataataaacaaataacaacaaagcgaaccaaaatgtgctcagattgacag

SEQ ID NO: 73669 - DNA, 515 bp, Triticum aestivum
  Clone ID: PAT_TA_73669
attcggacgaggaagacacaacctgctcggcaagttcgagctctctggcatccctccggcgcccaggggcgtcccccagatcaccgtgtgcttcgacatggatgccaacggcatcctcaacgtgtcggctgaggacaagaccaccggccagaagaacaagatcacgatcaccaacgacaagggccggctgagcaaagaggagatcgagaagatggtgcaggaggcagagaagtacaaggccgaggacgaggagcacaagaagaaggtggacgccaagaactcgctcgagaactacgcctacaacatgcgcaacaccatcagggacgacaagatcgcctccaagctcccggaggccgacaagaagaagattgatgacgccatcgagggggccattaattggctcgacaacaaccagctcgccgaggtcgacgagtttgaggacaagatgaaggagctggagggcatctgcaaccccatcatcgccaagatgtaccagggcgctgctggtcctgaca

SEQ ID NO: 73670 - DNA, 553 bp, Triticum aestivum
  unsure (1)..(553): unsure at all n locations
  Clone ID: PAT_TA_73670
gattcggacgaggctccggtcacctcgtaagtccctcgttgcgtcgcagactaatcagagagaattatctcctaaaattccgccgagttgctggcttgttgctgccaggaaattctccaaatcactggacctgattagcgtaggagaaatcagcttgacgagctgtagtgcaccacatatgtacctgtagtgcactattgctgtactgacaaagagtaggcagaacaacagcgccagcacggcgaaggaatagaaggagaaggagaagaaggtcagttcttctgcctgtccacatcagcgtctgatgcttcttgctatcagtagacaacaaggccagaaatttcatctcaattttcatnggtttggttcctgaagaaaccaagtgattttttttttttttgttttgatttgcatgaagttgtgagttgtgactgtcaggtgaacatgaccaagacaaaaaagaggcaaagtgcacctgaccgggagaaggaaattgtgataagagtctgacgaactgacgatgaatcaatccattctgaatgctgaaatctct

SEQ ID NO: 73671 - DNA, 229 bp, Triticum aestivum
  Clone ID: PAT_TA_73671
tctcatctactgaattcccaaatttaaaaaaatcaaaatacaaaatcaaaaattgggtattcaagaaatccaattaggaaaagaacttcttgtcttaggtgatatggcatggaggaatagagcacctcacggatgctgtttctgtttgtgctcatcctaatcaacttcttcaggctctgtaatcaaactttgccaccacaaatattgcaaggaattattaatctactac

SEQ ID NO: 73672 - DNA, 562 bp, Triticum aestivum
  unsure (1)..(562): unsure at all n locations
  Clone ID: PAT_TA_73672
cggcacgaggggacttcgaaatttagagaaaacactagaggaagggggggaactatantgggaagacagtttacttgtttggaggcaccgagccacaactattggatgtcaatggtgaattgaagatagtacttgttcctgttgtagttgctgttgactgtccttttcctccatcagataagattggcataaattttgttcaaacgggaaaagaagaaatagtaccaatgaaagagatgaagatggcatgggtgccttatgttcctcttgaggaccggtttgtcaggattgaaagtttgaaaacaaaaatcttcactctctgttgcacccagcggaggtctgtgctgaagtgtatgaaaactgagagagccaacaagttctattactgcacgccctattacatgccactaaatcctcctgaagatgaagatggcacagctgtcaccgccatatatcctctagaccccccgatactttgtgatttttacttggaattggatgattatgaggttttagctgctaggatagtcagagatgaggggttgccagaggatgagacgga

SEQ ID NO: 73673 - DNA, 483 bp, Triticum aestivum
  Clone ID: PAT_TA_73673
gagggtgacctccgccgtggagctggacgcgcgccagaccgagctcatcgcgcgcaagatgcgccgcctcaccgggttcgtcaacctcaaggtcgagaacgtcgtggacacgtccctcatcgccggattcgtcatctgctacggcaccgacgactcgcacgtcattgatctcagcgtcaagagccagctcgccgcgctcaagaaccgtgtcgactccatcgaccagaccgtccatgcccacggacacccacaccactgctgaacgatcctaagattccaacacctgatgcactggagcaaggcgcgccatcgctaccccgtgctacagcttactatacaagcctatctccatgatgattatgagactaccatatacagaaccgagcgccatggcaacaacagttttcctatctaaagttgttgtaaatggcaagaaaacttagatgttaccttcttcctgagcctaaaaaaaaaaaaaaaaaa

SEQ ID NO: 73674 - DNA, 498 bp, Triticum aestivum
  Clone ID: PAT_TA_73674
gatgggatgtgggtctcaggcgatagattgctcatgaggcaaccgaccttaagacttggcgtcttgatatattggattgcactgcatgcgttgcttgctagttttatttgaactctatgtgtaaagctgtagtgacctccttggcgagtgactgtacagtattatgtgtctatgtccatagcaagttatctaagcaaaagcagtttgcactaataccgtgattccttttgaaaatgttaccggatgcttgagccatattggcagctgcgagacatcttcaggtgcattttcacccatcttcctggtgctgtgatcccgtcatagcttattagtttaggtccagtggcatgcaatgatacaaatggatggaagagaactgaaggaagcagctgcaaagaaccccctgtacatacatttttgtttgctctattctttgctttttagaaagatggagggcattctacatgctagcatctacttactacactatatgataca

SEQ ID NO: 73675 - DNA, 452 bp, Triticum aestivum
  Clone ID: PAT_TA_73675
gaggccgccgccttgctctcggctccaccactgccccgtctctgtccccgcctcgccgccggagacgcgcaagcttagggctagcaaccgtttgcgctgacaagtacccggaggcccggcatgggaaagaagattcgcagcgccaatggcacctcgacgccggtcaggtccatgaaccaggccgtgtcgctccgtgaggagacctccgggaggacgcacgtagacgatgtctccctgctgagggtcaagcacctgcagaggctagcggcgtgggcgggcgcagaggccggggtgggcccgatcggcgcgctgctggggcgccgcctcgccgcgagcgccgaggccgccggagtacccctcgacgccgccactttcctttgccagaggtgtgagacaatcttaaagccaggcttcaactgcactgtccgcataagggacaagagaaataaagc

SEQ ID NO: 73676 - DNA, 521 bp, Triticum aestivum
  Clone ID: PAT_TA_73676
attcggcacgagggcagtttatctgttacttgtattttcagttaattgggatgcaagattgtcccatggtttctctagcattcttggttctttctggatcattgaagggctgttgaccatggagtattgtgaaaggtggtaaagtcgatcgatgttctacatgaagaaacatgtgcattacttcagcagtatagatcgtcaggtcagtttagttttttttcccccaacagcaccatatcagggcgttcctgatgtgtgcagttgatctgggtttttacacgacgcaagggtgtcggctgtcgcccatgcagtttgagtctttgagagcttttggtttctgcacttcagtacatggaacagagttcgcatttggtggccagcaccccagcgtggcatgggtgtttgatgatttgtactcggagctgtttgttttattccttttcatgaaacaggtgttattgtttgtatagggataaattgtttatccttcaaatgttttagataaaaaaaaaaaaaaaact

SEQ ID NO: 73677 - DNA, 572 bp, Triticum aestivum
  Clone ID: PAT_TA_73677
tacttagcatccctaattacaaaggtcgtgaggcatacatcagtggaacaacaaacccaactgctcttcctgctgagactgtgctgaagatggctactattaatggtgcaaaagcagtcctgtgggacaatgaaataggttcgctggaggttgggaaaaaggcggacttggttgtggtgaatccatttacatggtccatggtccccttacatgacagaattgccaacattgtctattccatgcggacagagaatattgagtctgttatgtgcaatggtcagtggatcatgaaggaccacaaaatcatgaatctcaatgaggaagaggaaatttcgtcagctgtgaaaagagcgaacgaccttcttgagcgagctggcatcaatctccccagtcggatgaactacgtatagttattctctttccatttcgtcatgtatggtcagttggcaccatgcccgctaattgcagtggtgcaagcttgcatgatggcccggcaggatttgtactcgtactgtttggttcatcctcgggtaatgtgagctcaaatgtaatcagctcatgtcggtttagtc

SEQ ID NO: 73678 - DNA, 534 bp, Triticum aestivum
  Clone ID: PAT_TA_73678
ttcggcacgaggtctagctaccatatatcccaaagctatagcttgcgacttggcaaccacttgtacagttgggcgggctacacgagattcaagccgggatggtggcgccggtggtgatcgcgtcggcggggctgggcatgctggccggcgtggcgatggccaaccggtcccttgggggggacgggctcccagcggcgtccaagtgggacgcgcgcccgcgctgcgccacgtgcggcggctccggccgcgtcgagtgcatgtgcaaccgctggtccgacggcgactccggttgccggacctgcgcggggtccgggaggatgccctgccgcagctgcggcggatccggcacgggcaggccgctccccgcgcggctcatcgtccagcaccagaagccgccgccgccgccgccggccggccacaactgatgatggaatatgattgtcgcaggcgaggtgaaagtgcaacccatccgagaaatcagttaaacgtactgcgatatttgtcatcctctagctagctagtttaagtatatat

SEQ ID NO: 73679 - DNA, 520 bp, Triticum aestivum
  Clone ID: PAT_TA_73679
gattcggacgagggttatgcagagaacaggctctgggtgaagtgagccaggagctgctggacactcaggtgaacccagccgtgtgggagataagtggccacatcgtgctgaagcggaggagcgactatgaggaggcatctgaaacctctgcgtggaagctcctcgctgaggtctccctctctgaggagcgcttcgaggaagtgaaggcgtacatcttcagcgctgctggcctggttctgtctgacgaggaagaggaggaagccagtgagggcaagggcaccaccacctttgctcctgtcccagtttccccaatgcctgtcgctgaaggctgcctcgtccaccagtgagtccgtggactggctgttgtgtgttcccggtctcctatagctgtgccgtaataaaggtccgttggcacggtatatgcttgcgagcccttgtgctctgctgctactttgctctcgtttgtgtcctgctgctctcgtggtgactcggtaattcagtgctctgcaatattaagcag

SEQ ID NO: 73680 - DNA, 508 bp, Triticum aestivum
  Clone ID: PAT_TA_73680
attcggacgaggggaaactcatgggtttgatgttgcatggtatttccgcttctgctaacttgattggtaacattttgacaaagcttgtcttgtccccagaattgcaagatcagctacatgtggagattgtttcagtctgtaatgaatcatctaaactggaggttgacgatctgctaaggatgcaagtcctacttgctactgtatgtgaatctgctcgccttttgcctgctggacctcttctgcagcgatgttctttgaaacatgatttgaagcttggctcgggtataactgtgccagctcaatcaatactagtagttcctttgcatctcgtgcaaatggatgcttctgtttggggtgatgatgctgaccagttcaatcctcatcggttccttaaaaaggatgtcgatcttagagaaatatttggagcacctaaaggatcaaataggataaatgttttcagtgagtgtgccaagaccgaatcatttcttccatttggttctgggagtcg

SEQ ID NO: 73681 - DNA, 587 bp, Triticum aestivum
  Clone ID: PAT_TA_73681
attttagattttctatgagctggacaagattattaccaacttggatatacaaataaaccaagtaaagatggaattaaattttacaataatattcttgatgagttacatgcaaataatattgaaccagttgtaacaatttatcattgggatcatcctgattcaattgaaaaaaaagaaggaggatggttaaatgaaacaatggttgaaatatttgcagattatacaagatttttatttaatgaatttggttctaaaattaaaatttggataacaatgaatgcaccatctagcttttgtaaatatggatacggtacaggagttgctgcaccaggtgtagaaatgccaggaattggtccatatatttgtactcataatatgttaaaagctcatgctagagcatatagaatttatgatgaagaatttagaaatacacaaaatggacaagttggagttgttttaacttgtgatcattattatccagttaataaaaatgatactaaaagtccagatattgcatttcaatttgattgtggttggtttgctaatccaatattttcaaaaaatggtgattatccaaatattatgaa

SEQ ID NO: 73682 - DNA, 243 bp, Triticum aestivum
  Clone ID: PAT_TA_73682
gattcggacgaggcttagaagttctgtaccgttttgcagcaccgattcctgattttggagtgtaaagtttgtataatacctagtgttatcggttatgcaccagttatgtgctgagtgccatgttttttgcagtttgctgctgtatcacaacgagaggacattttacaacagttgtattgtgatgttctgtagtgatacatagtgcctattctgggtgaactgtgtttttttcctgtaggaagt

SEQ ID NO: 73683 - DNA, 634 bp, Triticum aestivum
  Clone ID: PAT_TA_73683
cgaggccaatggctcatccgtaatggaaacaacagacggcaccaccacagctgtcgagacctctcgcaacccaagcatgggctacggcgacagcgaaggaaccgcaccaccccttcgcgcgttccgcaagaagcgtcgtcgcgaattcccagaagcctcagcacaaccacaagccaaatactggagcgaatacgaccaccctgaagacggttcagatgccggtgacgcctacgtaatttacatcgatcctaacgagcgctcctccttcgacctcttcttcgacaaaattggcagattcttctcgcgcaagtcgaagagcgccgacgacaacgtactccctccctcgccatccatcggaggcgacgacgaaagctcctcagatgaagaatcgcgcctgctgcctcgcaagccaaagtcctacggcgcaatgccctcccttcacgcacaatcccagcgaagatacggctccagcgctcgcacatacgagcaagagcacgattcgaacgctctgctgcctcaattcgccgccgtctccctcgtcgcatcgctggtcattcttgtcgtggcttacttgctggctgctaccggcaaacacaagcttgccaccgaagcgacgcgggcgtcgtctttgcta

SEQ ID NO: 73684 - DNA, 512 bp, Triticum aestivum
  Clone ID: PAT_TA_73684
attcggcacgaggctgcaactgatgaaattgatattcacagtatgaggaatagttttgttaatagctccaccagtcgaaatgaaccaaatgaacattgcacactggattttgatatcaagggttccatgcttgaggcactggaaaaatctgacagtgacctggagaatcaatacaatggcagcactcgtccttgtggctcactccctacagctggcacaagcggaagtatagatgattttatgtccttgcaaaccaattttggtagcctgacctctctggttcgttctgttgaagatggtccaatgagtagaattattcaagaccagtgtgatttgcagcttggatttggtgttcagaaaccacagatgtatcctaccttcgaggagcagctgaggatggcctcagctggagctccacagtttgggactatgaacaggcataatcatgtacctgtacccgaaccaacactgatgttaggttatgcgccgcacattggcagctgccctcctgt

SEQ ID NO: 73685 - DNA, 109 bp, Triticum aestivum
  Clone ID: PAT_TA_73685
cggcacgagggcatccttcttgtttatcccttgtgcaaaaagggacggattatgttgaaaggaaggttatagaggtttggcaataaaatgcacctagctaattgatagt

SEQ ID NO: 73686 - DNA, 554 bp, Triticum aestivum
  Clone ID: PAT_TA_73686
gagggagagagagactagtctcgagtttttttttttttttttttttttttgaaacaataatggaagcattctttccgatacaatgtggcctaatggttcatggcaggacaaaaatcaggaattgaatttgcaactcaacacaaaacacacaatctagtgctgactagtgatgttcctcttcctctctctctccccccctagtttcatcaacaatccttttttggaactgctcgatttatgaagtgtacagacagctggaagctctaggcgacaacaatactttatgccttgcaaagaatggctcctatctcacttggtgtacaggacatcctcccatgggtgacggtagagtggctgcttaagcctcttctggtcgaaggtgtgcccgatcaggccaattgaacgcgcaagcacaaagagcccattaagataaccaatttccacaatctcgtcgatctcctgtttggtgaacattccacttccagacagaagatccaagaaaagtgacccgatcgcaccatcgacgttcagaaccaaattgttggctttggaca

SEQ ID NO: 73687 - DNA, 473 bp, Triticum aestivum
  Clone ID: PAT_TA_73687
tcggcacgagggacgccgtcatcgacgccgaggccaggaggaggaaatggcttgaagattatccagaggcgactaacacagacgaggctgtcgtcttcgacacttcaattattccatggtgggcatggatgaagcgattccaccttcctgaagccgagaagctaaatggtcgcgctgccatggttggcttcttcatggcatactttgtggatagcttgacaggcgtgggccttgttgaccaaatgggcaacttcttctgtaaaacgctgctgtttgttgctgtcgctggcgtactgctaatcaggaaaaatgaggacattgaatcactgaagaagcttatcgacgagtctacgttctatgacaagcaatggctggcaacctggcaagatgattccactgggggaccaaagaattagttcagcattgggatacagatgcagaatcgttcttgtgatgtactttacctctttctt

SEQ ID NO: 73688 - DNA, 339 bp, Triticum aestivum
  Clone ID: PAT_TA_73688
ttcggacgagggcggtcgccgccgtcgcgcccaggatgccgccgtcggtgacgaggcctgagggcgtggccgccaaggttctcatcgttaattgagacacggatcggcggacgctgcctgagctcaacgttgacgcacacgacacgcgcgccttgatggggttcgctgtcgcaggcacagctacgcaccgccgcatcacacccctgcctgaactaacagccaaatcagtggcattctgttccgttttttgttcttgtttcccgatgcgtttgtggtctttgtagactgaccactttgtaatgaaaatccacagttcaattagaatggacttttagttgg

SEQ ID NO: 73689 - DNA, 504 bp, Triticum aestivum
  Clone ID: PAT_TA_73689
gccgcgccgcgggccgtcgcgccggcggcctccctccacctcggccccggggagatcgccgaggtctcgcgcaacaaggttttgattgcggcgacggtggcgagcgcgatcgggcagctgtccaagcccttcacttcaggcaagaatgggagcgccggcgccggccttgacctcaggaccatattccgctctggagggatgccatctacccactccgcggtgaaaacatctgattactgaccccagtcccttaccaaaaccttctccttttcagtttctgcgttaccaactttggagatacctcttccacatgtttgggctgttgtgctaagttgtgatgtgaataacctagtcacagggaaaaatatttgtcttgtgtggtgaactgttatcattagtttgcacaatgaatgattgaggatggctgtgtaactagaatggattgatcatcgaggagttctgcaatgtaacgtaccccaaatggctataaaattgaattgaaac

SEQ ID NO: 73690 - DNA, 626 bp, Triticum aestivum
  Clone ID: PAT_TA_73690
attcggacgaggctgtcctgcatggaggtgtcccctgtcccgtgtccgagtctccgagacgagttgaccacgccagaaaggagagcctggctgtggtgttcgtttcgttccacgatgaatcgatcgccggactttaattcctgcaggttctgatcgatggaacgaaagatgagagcagctacaggaacatttctacgtcacgacctgtgaattgtgagggtggactgtggagcaaggcgatgatgtccgtcaacgccatcatctgttcgctagcacgaggcttcgatgatcggccgtgctatcatgtgctcgtgcgtgtttgagccaggttgtaacactacgttgtaaactggagcattttggcagctttgcttccaacagctgatcgtcatgtgtcatatgtgtacaaatttgcttccaatataatggagcacgctagggacaatagtaacattcgtcatgtgtacaaatttgctctacatgcgattattcctggacagtgggattgcccatttttttatttgttaaggccttgtttagtttcgaaaaattttgggaaatcgatactgtagcactttcgtttgtatttgacaaatattattcaatcaaaaaaaaaaaaaaaaaaa

SEQ ID NO: 73691 - DNA, 504 bp, Triticum aestivum
  Clone ID: PAT_TA_73691
ccctatctggaggcaatggtgctattccttttaaccacctaagggatgccacttacagagagagggatttgggaccacatcaagaggcctagacgatcatttcccgaaccggcataaagatccgatccttgggcattttgctcaggcacatcaagtctcacagggacctcgggaaagagtactatctgaagctgatattctgagccctcaatttggaaagaaacttggaaatgtttttgacttgcgggaaaggctatccccttctgaacattttactcgacatgccttggtggatcatgtggatctaaatccttcactagacctgacatctggctctctacaccctggactatcgcgtggtaaataactattgaatgtaaaaagcagggtggcattttttgagttttttggctgctatgaccattcaatgactgcaactgtatcatagtatcacacagattgacaatttctttagaagctaatggttggcaatggatgggatct

SEQ ID NO: 73692 - DNA, 609 bp, Triticum aestivum
  Clone ID: PAT_TA_73692
cggcacgaggacaactttaaggttcgtgctcgcgagaagggtttccagattcgtgattttgagtatagtcccgaagcacaagaaggtagaaagcaggagatggagaagttactgcaagaccaggaagctatgaggacctcgcttctgcaatggtgctatgccagctacagcgaggtattcagttcctggatgcacttctgtgctgtgcgtatctttgtagagagcattcttagatatggtctgccaccatcattcctgtctgccgttcttgctccatctacaaagggcgagaagaaagtaaggagcatcttagaggagctttgtggcaatgtccatagtgtttattggaaagccgaagatgatgtggctgttgctggtctgggaggtgaatcagaggtccatccttacgtctcattcaccgtaaactttgtctgagtctagtctgtggcttgccaatattttggagcaactattacctcgagtaatcgaaacaatcgaatggctctgtatattattagtgatacgccaattctttctttatctgtcacttttatcttatcatgtaatttctattggatagataagcccatcaataatgtagcttttgag

SEQ ID NO: 73693 - DNA, 393 bp, Triticum aestivum
  Clone ID: PAT_TA_73693
tggttttgtcaagttttcttcagaaaaccaagctgctgcagcattgcagaagctgaacggtcaggtgcttgatggaaggaacattcgggtgcactacgcaaacagtacttggggatctgctgccactgatggctgatgctctagaattttattttacatacatgtgtaatgtgcttatccattacgtacgtactatcatagtcttaggatccagtgagcaccattccatacagcttgtgctgtgctgtccacttcacgaataggcagtgtgctgatggaagtctcagtttaccattccctgtgttgtccttgacttgtgcttgaaaatactgttcgctgatttattgtgagcaaaaaacactgctggttggcaacaaaaaaaaaaaaaaaaaa

SEQ ID NO: 73694 - DNA, 484 bp, Triticum aestivum
  Clone ID: PAT_TA_73694
gattcggacgagggctggtacaagatattcccgttcaccgttactccatcatgtagcatcagctgtgccaacctcaagtctgcctttctacttgatattatcattttggtggtcactacatgcatcactgtagcatcagtgcaagagcctcaatccttaggaagtgatgaagcagatcaccctagcacagaacaggaagctttcctctgggaactttttggatcattccggtactttacattaccggtttggatggttttgattgttactgccctcacatggattggatggtttccatttatcctctttgataccgattggatgggtcgagagatctatcgtggaagtccagatgatccaagtataactcagagctatcatgatggtgtgagaatgggttcttttggtctgatgctgaactcggtccttcttggattcacttctattgtactagagaagttatgtcggaagtggggagctggac

SEQ ID NO: 73695 - DNA, 499 bp, Triticum aestivum
  Clone ID: PAT_TA_73695
gattcggacgaggggcttgtcatgacaatgtaatgtggtcgattacatgtgggataatggtttgtggtgggtccaataagctcaagatttcgggagatgggctagcattattcccaagctgagtcatggatatcaatgtcgcaggttctgtaacaggattataatcgtcgaacatcacagtctttagttttttttaaggctactttctagggtttgcgtcgtttagctatgttatatctggcatagtgtagcctgagtgcaatcatctgcaaggccgaaagacattcctagagtggtattggttttgaggttccttaggaatggtctgcgttacagattgaccggagctgtaaacctttaacggtttgagtatattgctcggccttgcttttcaactccagggtgatcagaggaagaacgtctctaatttccttgtccaggccggcattgtgaataacgaacacctcaagattcatgggttctgagcgaccgtcgggtc

SEQ ID NO: 73696 - DNA, 501 bp, Triticum aestivum
  Clone ID: PAT_TA_73696
tcggcacgaggggtagacgctatcgcgtacctccgaacttccctggccgtttccatccctcggatgccattgagtttggttcagataaaaaggccgtgttccgtgtgaaggtgctgagcacgctcccatatgaatctgcaagaggagggccgcaaatcctgcaggcagcatgaacgagagacttcagtcagccatggctgctgtcatcactcatcagctactgtacagcatccagtaaaacacagtgaattttgcactaaaatgcaagttccacttccagacaggattttgaatagctttctctgacggattgaaattgcagcttctccatacagaaactgaggtgtacaatataaaaaaaaagaaactgaggtgtacaatagccaatacggacaggcaattttagctgttgcctgctgtatatacattgttgtgccattacagcaacaaggtggaatgtaattacggcatgaacacaatttaccaaatggaaaaaaatgt

SEQ ID NO: 73697 - DNA, 282 bp, Triticum aestivum
  Clone ID: PAT_TA_73697
agccacggttcgaggccatgaagtcggccatcgccaccgcgtgatgaacaaacacactgctgccttcaattctgctccttgtcccttcgtgtcctgcattatgctttgagcttgaagccttgatgaggctgcaatgaacagtgtccatgtgcttatatgtagtttggcacggtggttatgcgtgtatcgtggaacggcgtaatgtattttggttgtctcggatctatatgtatgtacgtatatattgagtactgtatgtaaagtgtgtgtagcatctgatcc

SEQ ID NO: 73698 - DNA, 589 bp, Triticum aestivum
  unsure (1)..(589): unsure at all n locations
  Clone ID: PAT_TA_73698
gagggtcgagctcagttgtcaggataagtcaacaactcaacatgatacgcgattcttaagtgggctactgtagggattaatcagaagctgtgccatagcagaagacagacctgtggtggatttaggacacttccagttacctcaccaacaaagtgccaattgaaaatgtgcgtcctggatctagagcagcaaacttctgtccaatagatggttgaaaaacaacacagattcctgtggatctctatcttgtaggctgcaatgttcaaaggggacatgattgttcctcaccaaaatcttgggagatgtcactttttgaaaaagcttaccataggattgctgcggactttggagggagaatcttatcgaggaccgtcttttatacttgtatctaatcatgatcagcattcgggatgacaaaaccttggaatcagccaaattggcatatccaaccccagaatagtgagtttggattcttgcagcanagtggtagggcctgatgttaatttgtggtgaatagcaatttgagcaatagtgccagtgttgaacaatggcatatcccctggtgtacagcagggaatatgcatggttg

SEQ ID NO: 73699 - DNA, 582 bp, Triticum aestivum
  Clone ID: PAT_TA_73699
tctcgcatctcgcaacagcctctccctcggcgtccctgtctcatcccccatcgtccctgtctcatcccccaccgtcgcacctcccctcttctgccgccacagcacctccgccctccccggttcccccaactgcgacgacaccacagaggccggatctggttggaggaggccagccggagagcagtcgctggacatggcactcgatggatctggcttgcatcaaggtccgtggcagcgtccggcgagcgtgtgcggaggaagattcatggagctccccttccccgtctcagcacaagccgcgtcgcctcgtctcctccatgccacacacgctgcgctcacccccaccttcccttctcttctccagcgacccggatcccacatctgcggcaccagcgagctcccccgatgagtcctctgcctcccggagctcagcacgcaggtgggtctggttgtgcgtgtgcccgctggcgtcgtgcaggcagatccatggagcggctactggctcaagtttggattctgtagatctaccattttggtttaaggtttcaggtctaactatcaatggttcaggagagaaatatc

SEQ ID NO: 73700 - DNA, 478 bp, Triticum aestivum
  Clone ID: PAT_TA_73700
atccttgctctatcaaacccaacatcacagtctgaatgtactgctgaacaagcatatacatggagtcaggggcgtgccatatttgggagtggaagcccgtttgatccagtgaaatataatgacaaactatttgtgcctgcccaggcaaacaatgcatacattttcccggggtttggactaggggtggtgatctcaggagcagtccgggtgtcagatgatatggtccttgctgctgctgaaggactagctgaacaggtaacaccggaacatattgagaaaggcctgatctacccgcccttttccatcatcaggaagatttcagctaacatagctgcccgtgtcgcggcaaaagcttatgatctcggaatggctagccagctccctcggccaaaagacctggtgaagtatgctgagagttgcatgtacagccccgtctaccgaacgtacaggtgatgtgaagagcgaacagtgacattgg

SEQ ID NO: 73701 - DNA, 524 bp, Triticum aestivum
  Clone ID: PAT_TA_73701
cacgaggctaggcagcccagccatctcagctctcggcgacggcgaggcggcgctcgctgggggtgcggccgcggcggctgagcttttgccagatccggaccaccgcccccagttccggcgccgcggcggcggcggaggcggaggcggaggtgtgggagtcgttggcgattcggccccgggggtgggtgggagagggcgccgctctgatcggtgctccgactccgagtggttctaagctaggaaggatgatcatgttacgttttgctcaagattttgcttcacactgataagatctcagcatttggatgattaacgcatattgaattctttctcaataaacatgggagctaattgctgtatagctgcaaaagagaggcctcagccatgtgttactccaattgaagtgtcagcattcaggaacgtaagacactctccatcatggagcttccggtgggataaccgcacacacatagaagacataatggaaatgcccgcattgttttccaaccatagtagtggaagca

SEQ ID NO: 73702 - DNA, 577 bp, Triticum aestivum
  Clone ID: PAT_TA_73702
gattcggacgagggagagagagagactagtctcgagttttttttttttttttttcaacaataccgcaaccatccaaaattcattccataataacatattaacatactactcataattactggctcgactcaaagacaacacgcaagcaacgaatattgcatgtatgtatgtataaaaaataatatgtgattctcagggcgaaaattttggcatctgcccggaaattaaaagttaggaagcctcaataaaacctctccaccatgtacgtacatgacacaacaacccaactcatgatcagttcatctcttgggcgcacgcacacgcaccaaaaaccttgacacgcacaccgcccaatctccctgtatgcatgggcctggctgcactacaacctctcttcagttcagactgatgaatctattattgccaccgacaccgatgcgcaagcaaaagccgcgacgctatctctacactctcatccgacgatcctccgcaaattaaacgcgcgcaaccttacacgcatttccggatgtagccttcggacttgtcgtcttcgtcgctgctgctgccgctgctgaca

SEQ ID NO: 73703 - DNA, 492 bp, Triticum aestivum
  Clone ID: PAT_TA_73703
ttcggcacgaggcagtgttgtgcttcagtgagactcagcgattttatgtgcttgtagccatggtttgttaaaatagaagcttcgtcagagtcctcatatttaatcgctcactgttggcattttaaaaatcaaaacaacggaaccacgattagggacatgcgaaaattgaggtgtcaggctaattcaagcgatcaagactacaaatgatgaacccatcttcaaatcaaacaactttagatcaagactgcaggcaatgaatcgatgggtgaatctacaaaatcacttacaacaattatatgggacttcaatatgggttcacagatggtgattttttaaggctctgttaagggctcgaaatcatccctgcactttgtaaattacagcgaccttgtagggtaggccgtaaactaccaatgccactgccatataacggcacctttgtactttataactattctgcaaatatatatcagtgaaggtaccttaacgatg

SEQ ID NO: 73704 - DNA, 614 bp, Triticum aestivum
  unsure (1)..(614): unsure at all n locations
  Clone ID: PAT_TA_73704
ttggaattttgttgctgaatgtttacctaaatatattcaaaaggtgcaaataagttctaaaaatgaattagaattactgatcgcaccagaaggagttttaccagtatttcattttttaaaaaatcaaacaaactgccagtttgttaacttatcagatatatgcgctgtagatgttcctcaacgttcaaatagatttgagatcgtctacaatctgttatcacttcgattcaatactcgcatacgtgttaagacatatactgatgaattaacaccaattgactccattacatctatttatgaagcagcaaattggtacgaaagagagatttgggatatgtttggagtgtttttcactaatcacccagatttaagaagaattcttactgattatggatttgaaggtcatccattccgtanagattttccattatctggatatgtagaagttaggtatgatgatgaaaaaaggagagttgtggtagagccattagaaatgtcacaggaatttagacgttttgagttatctactccgtgggaacaatttccaaattttaaaaaagctaccactgctgaagaagtgccatcagcagaaaaagaaaaaaaataactttact

SEQ ID NO: 73705 - DNA, 568 bp, Triticum aestivum
  Clone ID: PAT_TA_73705
gctgaggaaggttcagaggctatggatgcggctgctgcccctgctgtccaggcattggcaagatacacacgaagggaggcaacttgtctatcattgactgacaaagattctatgttctctgggaacttcaaattcacaaccctgctgccggcaactcccagttccagcccaaagaagcctgtgcgatgaactgccgtggtacatccacattccatatgaagatttgaaaacagcaggatcagtggatatctgtcattctctcagcaatacaaataacaggcttcttccagcagtagtttattctggggttctcacgattcaaacccttttgatggatatatacttctttctagataggaagtttattttattaatcttacgagaatctgctctagtaggccacccacatgaatggagcctttttgtctctttttctatggtaatctttttcctttggctgatttggactctggtcatcgtgccagtgcctagtgggaggtgatagagaaagtaaccatacaaatgcattgtctaaatatgtacttttgtttgaagccatagctggatg

SEQ ID NO: 73706 - DNA, 570 bp, Triticum aestivum
  Clone ID: PAT_TA_73706
gattcggcacgaggccccgcctcgccgccgtcatggacgccgtcaacgagcgcaagctccctcccgagctccgcgggcgcggaaacgcggtaaggtctgaaactgacattgtaaatgtcgttgaacaaagaatatggcattcaatggaggaagggcacttcgaaaatctaccagggaagggcaaacccttaaacctcacttcaaatcctcatgccgatcctgctgaggacaccctttacaggatactttcaaggaatggttgtgcacctgaatgggttgagctgaataaggaaatccgtggtatgatcataggctggaggttggcattaaggaaggcatgggcaaaccgctctgaaggtgatgattctaactggaatgatgactgcagggttctacaggagcaaattcgccagataaatgataaggttttccggtacaacctgatagtaccctttgggcggcagatgtttggtctgaactgggacaaggaggtggacaagttgaagtaagaagggtcaaggaggtggacggatcagtgaagaacatagcatggagtacttttgttgtatc

SEQ ID NO: 73707 - DNA, 614 bp, Triticum aestivum
  Clone ID: PAT_TA_73707
gaggcgttgccgtccacttgtctcacgtcacggcctgtcgccatctccttcctggttgctccatccctgcctcctcggcgccgccggcgacgactccatagagccactcggccacaggaaccggcgaccatgtaccgagtcgcctccggcctcggcgccctcaagaggcatggggcagatgctcaaatgatgaatgttgcaatcaggtgtgccagcacaagtgttgcacaagggtcatctggtggcttctggacctggttgactggtgcacgctcaaatgaaatacctcctccagattttgcacttccgggagtgactattcctcctccgctacctgatcatgtggaggctggcaagacaatagtcacaacacttcccaatggtgttaaaatagcctctgagacatctgcaggatcatcttgttctgttggagtttatgttgattgtggttctgtatatgaagcacctgaaacaacaggcgccagtcaactggtgaagacaatggccttcgcaaccactgccaacaggagcgaattgcgggttgtgcgtgaaattgacgcaataggtggcactgccaaagcatctgctagccgtgagatgatgagctacactta

SEQ ID NO: 73708 - DNA, 648 bp, Triticum aestivum
  Clone ID: PAT_TA_73708
ttcggacgaggggcgacaagtcgaccccgacaggtggcgacctcgtgctgtacaggcgtattgcagaagtaaaggagaaggaacggagaaggactttggaggagatactctatgctctggttgttcagaagtttgttgaagctgatgtttctttggttccagcactctcacactccatcgattcttctggaagagttgatcagtggacagaaactgtggaagagaagcttcaacgtttacactcgcccgaggcctatgaaatgatcgagaatcatctctctctcattctggggcagcgtcaaggtgatgccactattgcagccataagtaagctccgagttggccaggtctatgctgcatctgtgatgtatggttatttcctgaagagagttgatcagaggtttcagcttgagaagacaatgaagagcctcccttggggatcggaagaggaagatagtgctttgaatcaagttatgacgaccgactcgatgccttcagctcgggtttctagctctcatccagagatgggctcatggactgcacccgacttcaacgcaggagggcctagccaatctatcaagccttcccgccttaggtcgtatgtcatgtcatttgattcagatacgcttcagaggtatgcaacagtca

SEQ ID NO: 73709 - DNA, 525 bp, Triticum aestivum
  Clone ID: PAT_TA_73709
ttttttttttttttttttttttttttttttttttgatttgcaggattcatttggtcctaaagaccgatttcaaccgtgcaactatatgtttacatgtatcaaatcactggggggagtgggctaaaatcagatccacccatacatccctaacgcaacgaaactctacagacaaattataactctgagagtacaacaccttcgcacagggtcattacttggatttctccattatccttcgggcctcttcgacagggtcttccgatgggtcgcccattgcttcatccaacctaaagctggaggcctcctttgggttcatagcccggaagccgagatatatgagggccatcattgccagaacaaataatgcagtggacacaacggatttaacaaggaaaagggccactgccatagcggcaaaggtaacacctatcctagcaattggtcgtggaactgaacctgggacaagattacttcctgcctccacagcatcgttaccaaccctccatgctgtttgaacagctctgg

SEQ ID NO: 73710 - DNA, 628 bp, Triticum aestivum
  Clone ID: PAT_TA_73710
gattcggcacgagggcaacacacaagtcatcaatcaacctttaaaataaactcccatcttcagtcagcacgatataatgctgtgtgccactgatcaggtgtgagcagtgaatcaagcgatccaaaatcttctgctagtggtatatatatagtaggtcaccatacatagcagctagtatatatatagctagctaggtacacatatgtttagctatagcttgttacatatatagctgtatacgtacatgatgcatgcatacatacaaaataatgtaggcgaaagatatatctgtacatgccaccagtatattgacaaaggttttctcagtatgtgtagacatgatctgaaaggagatagaaacatataggtagggttttggattttattaggttggctagtagtagtacgtatatatagtagtcgagattgatatgtgaaaaggaaccagctagcatcatgtatttatctcggtttgtagtatttggctgcttgcctgcaccacccaatgcgtttattagcgttgtggtgcgaagataaaagttttttttaatctcctccctgcttataggagcttattaatctgtacatgtacatagagtgtttgtatgcacacacgtgtatgatgatg

SEQ ID NO: 73711 - DNA, 451 bp, Triticum aestivum
  Clone ID: PAT_TA_73711
ttcggcacgagggcccatcggcgtcagccgctacgagtacgaccagctcagggctccggttgggagggtctacttcactggtgagcacaccagcgagcgctacaacggttatgtccatggagcataccttgcaggtatcgactctgcaaacatcctcatcaaccacatcttcaagaacgaggagtacaaggtccgtggcaagtacgagcccgacgaccaaattgcaaaggctaaatgaacgacgacgaggcgtgcccatgccagatgccttacgccaagcggtcagctcgtctcgagagaacaataaattaaaactgccgagatttcgagcgcaattcagcaggctgccctgcaccgtgtctgctgctcatgccctgtgtttctgtgtgtgtttcggcaggtcgtgtgatgtcctgtggaataaatgtagaggccctcgaggcttgaggcc

SEQ ID NO: 73712 - DNA, 667 bp, Triticum aestivum
  Clone ID: PAT_TA_73712
gctgcgcggctcaggcatctccctcgccctcgacgtcggcaacgacaaggtcggcgagctcgcctccgactccgccgccgccgcgtcctgggtccgggacaacgtgcaggcctactacccggacgtggacatcaggtacgtcgtggtcgggaacgaggtccccggcgccgcgtcggtgctccaggccatgcagaacgtgcacgccgcgctcgcgtccgccggcctcgccggcaacgtccgggtgtccacggcggtgaagatggacgcgatcgagaattcctcgccgccgtccagcggcgtgttcaaggaccccgccgcgatgtcgcccatcgtgcagttcctcgccggcaacggcgcgccgctgctcgccaacgtgtacccttacttcgcgtacgagtacagcgacggcatcgacctgaactacgcgctgttccagccgagctccacgacggtgacggaccccgctaacgggctggtgtacacgaacctcttcgacgccatggtggatgccgtccgcgccgcgctggacaaggccggcggaggcggcggcgtcaacgtcgtggtgtcggagagcgggtggccgtccgccgacgggaagggtgccaccgtggacaacgcgcggacctataaccagaacctgatcaaccatgccggcaagggcacgccg

SEQ ID NO: 73713 - DNA, 539 bp, Triticum aestivum
  Clone ID: PAT_TA_73713
tcggcacgaggctcagttgcttctcttctacaccaacatgcttttcatctgtttcgacctgtgtgtatataacaacagttcagctcaagcccagaggagaggaacgtggttgatagcttcaacagctcactggccacattgtttacatcagtgaacaagctcgacgctgaatcctccaagtcggcgttcgtgtcgtctgcgacggcgttggagaaatggattgcattagccggactgggtggtcagctcaaaggctactgatgtgacggaagcgttgtatgtatcatgtatggatccggcatttgtgaatctcctaaagagggtaccgtaaccgaggactgaattcagataagcgtgctagaataacacagcagcatcctcatcgatcaagaaactgggatcattttttgcgactgtgttattacagtaaatcagtaataggaaatgaagctgtattgttttttgttgtccggtgttacttttgaaattccaaacagctgatgggaagtttttatccaaaacttgctgcatgccgtgtg

SEQ ID NO: 73714 - DNA, 355 bp, Triticum aestivum
  Clone ID: PAT_TA_73714
cctgtttagttccccatccaaaaatttttcatccatctcatcgaatctttggacacatgcatggaatattaaatgtagataaaaaaatgaactgattacgcagtttagttgagaatcgctagacgaatcttttaagcctagttactccatgattagccttaagtgctacagtaacccacatatgctaatgacagattaattatgcttaataaatttgtcttgcagtttcctgacgagctatgtaatttgtttttttattagattctaaaaacccctcccgacatctttccgacatatccgatgtgacacgcagaaaattttcgatcccaatctaaacaggccctgaatacagtga

SEQ ID NO: 73715 - DNA, 564 bp, Triticum aestivum
  unsure (1)..(564): unsure at all n locations
  Clone ID: PAT_TA_73715
gggctgcggcgacgacgactaccagaagtggcgctggcagcccgacggctgcgacctccccagatttgatgctaagttgcttctggagaagctaaggaacaaaagactgatgtttgtgggggattctctaaatcggaaccagtgggaatccatggtgtgcctggtccagtcagaggctccatgggacaaaaagtctcttgtcaagaatggttctcttaatgtgttccatcttcaggagtacaatgcaacagttgagttctattgggctcctttcctagtggagtcaaactcagatgacccagacattcatagcatcagtgaccgcatgatcaagccaacatcgatcgcgaagcatgcagcgaactggggaaggggtggactacctgatcttcaatacttacatttggtggatgaacacaccacagatgaaaactttgcatggtggatccttttcaaggaaacatgttaagtatgatgaaatagaacgtgtcgaggcatanccggaaggtcctcaagacatggtctagatgggtagaggcgcacatagatcccaagagaacaacg

SEQ ID NO: 73716 - DNA, 588 bp, Triticum aestivum
  unsure (1)..(588): unsure at all n locations
  Clone ID: PAT_TA_73716
tcggcacgaggtttccccattccgtttcccctaaactatctcctcgcgaatccatcagcgagtcgccgaagcggaggaagaagcagcagcttgcggcggcggcggcgaggcggagatgtcgtaccttctgccgcatctgcactcggggtgggcggtggaccaggccatcctcgcggaggaggagcgcctcgtcatcatccgcttcggccacgactgggacgagacgtgcatgcagatggatgaggtgctagcggcagtagctgagaccataaagaactttgcggtcatctacctggtcgacatcaccgaggttccagacttcaacaccatgtacgagctgtatgatccgtcgacggtgatgttcttcttccgcaacaagcacatcatgattgatctggggacaggaaacaacaacaagatcaactgggccttgaaggacaagcaggagttcatcgacattgtggagaccgtctacagaggtgctcgcaaagggcgtggntttggtgattgctcccaaggactactccactaaataccgttactaagctatattttgccccacgctgccgtcgagtggcccttagtaca

SEQ ID NO: 73717 - DNA, 617 bp, Triticum aestivum
  unsure (1)..(617): unsure at all n locations
  Clone ID: PAT_TA_73717
tctcctcgcgccgtgtctctctctacctcttttgatccggcaatggccacccccgcccctgccaccgccggcgagctcctacgcgtggaacccctcgagctacgctttccccttcgagttgaataagcagatctcgtgctccatgcagctgtcgaatcacaccaacgactacttcgccttcaaggtgaaaactacaagtccaaagaagtattcagtgcggcccaacactggggttgtcttgccacggtctacctgtgatgttgttgttacgatgcaagcacagcggctagctccgccagacatgcagtgcaaagataagttcctagtccaaagcatcgttgccccttctggtataactgtgaaggatgtcacaggggatatgtttacgaaggagtctgggaataagatggaggaggtcaagttgcgagtgacttatgttgctcctccacagccaccctctccagttccagaggaatctgaagaaggttctccatctaggacttctgaatcagaanatggagatggacctgctggaggattcaccagagcactgagggagcgcatcgagcctcaagacaatctacagaggctggagctttgatttccaagttgactga

SEQ ID NO: 73718 - DNA, 350 bp, Triticum aestivum
  unsure (1)..(350): unsure at all n locations
  Clone ID: PAT_TA_73718
attcggcacgaggggttgacaactaagtttaggcatgattctttttgggctccacatttcatagagttaaaaagtgtggcaatattcctttaggcatggcaaagtgtggcaaccaatttgctagccacactttttgtggcttgccacactttttgtggcttgccacacttgcttaaagttagttgtggtaaactatggctagcaaccaaacatcccctagagcatactctgcgtagtgtcgtagtcagtgatgcaagtcctgcattccaaattgtaaattattccatgaatcttgaagtaagtttgaccgaanaaaaaaaaaaaaaaaaaaaaaaaaaaaccaaaaaaaa

SEQ ID NO: 73719 - DNA, 589 bp, Triticum aestivum
  Clone ID: PAT_TA_73719
gattcggacgagggccagaagctttggaggctggatcaagctgtatccaagctggcacacccagtgtagctgacaaggtctttgggacgctggaacccatcacaaaacttccagatggtggtgtcacaaatcttccagatggtggtgtcataaatcttccagatggtggtgatgattgttttgatattggtgagatgctgagtatgatggaagctgatccacataatgaaggtggagctgacgttggcatggggcagccctggtgtcttgatgggctggattcgagtgtcctggagagcatgctccagtcagagccagagccattcctgatgtccgaagaacaggagatgtttcttgctggcttcgaaagcccatcaagtttcttcgagggtctggagcggctaaaatgattttttgatgtttggccgttgatcctcatttcacttcatggctgagcttgtgaagaagtggaaggcaaacactgccagaactgataagaggcttgctctagctattctaggctttattcctctgtaatagttctcttaggcatgaaaactcggtttgcttcacatttgagagaccacat

SEQ ID NO: 73720 - DNA, 457 bp, Triticum aestivum
  Clone ID: PAT_TA_73720
cgaggcataatctcacgtgacatcgctaagtttgtagtccgaggccaccaggaactgactcttcagctattcaaacttgaagacgtggcaatggggatttggatccaacagtacaagaacagtgggcagcaagtaaacattgtgactgatgaccggttctacaatgaaggatgtgacgctgactacgtccttgcgcactaccagacccctaggcttatgatgtgtctgtgggagaagctgaagacggaatatcaagctatatgttgtgaatagcatccaaatcgcaagtagggggcgagaggaatggataggttagcctacgttttgaacagaacattggctaagattttgacgctgggtggaaaattgttgggaatgcgcaaaaaagctgtaacattgggttatcacttttgtgttgtgggtccatgttcttggttttttggtggaaaatgttaat

SEQ ID NO: 73721 - DNA, 578 bp, Triticum aestivum
  Clone ID: PAT_TA_73721
ttcggcacgagggcaagaccaaacatagagagtgttaatggtaccgtgagccataatatcgctggaggtggcattgtaagtgggagtgggagtggcaatgatgtgtatcagaatcgattcccccaacgagaagctgcattgaacaaattcagactgaagcggaaagatcggaactttggtaaaaaggttcgctaccaaagcaggaagaggcttgctgagcagcggcctcgggtccgtggacagtttgtgcgacaatctgggcaagaagatcaagcagcacaaggttcagaaagatgacacggaccttctaatacgtacaacatggcatcttcatcgacagatctgacaattaggtggttcttcccattgcgcatcttcattgacagatctgagaattaagtggttcttcccatcactgatagtaacccattgattcccaacgttagagtactcaataaataagactagttgtcaatttctgtggtcgactccagattatcaccctagtgctatggagtcaaacatgtaatatttatgtatgttcgagcttggcggtttgcaatcttcattttccttgc

SEQ ID NO: 73722 - DNA, 573 bp, Triticum aestivum
  Clone ID: PAT_TA_73722
attcggcacgaggattatcttcctcttttttccaatacatttccatctctctctctctctctctctccatttctgtacactacactttttcactcagttcccgtgcctagacctataaggtcatttgttttgggatggagagagtaggtaaaaatattcggtcttagcaaccatgaatttgatcagtctgatagattttctttcttgaataatgctgaccgagcttaagataaatgtatggcaataaacacctgccttatcgcacataaaaataattatattctcccagtctccctaccttttctcctcctctttctggtccagtacataccagtactactgatcaatcaaacttgggcgattagcaacatataactcttccatatatgaaatgaataaggatgtcagcacaccttatataagaatcatccagcactcaaatgttttcttacaggttttctgctctgacgactgtggtctaattgagttagaattaataatgctagatgtagggggggcatgcaagcacgtgtgatgtgatatatatgactgaacaggagaggactctcgcac

SEQ ID NO: 73723 - DNA, 543 bp, Triticum aestivum
  unsure (1)..(543): unsure at all n locations
  Clone ID: PAT_TA_73723
tcggcacgaggccctactagagaaccgacccggtccgggctcgtgggcgacgcgagatcgtccatcaaaaaggccggatcacactgatcacaagcctcaaaacttttccaaaccaagttagctgcggagtgggtgctctaaagctaacgctctctgcagtctggactctggttcgcggtggccgcagctgcagcgtcccctccctttttttgccaccgagcatcacctgtgccgccggcgcgtaactgcaccgcggtcaccgcttaagaggcagaggaggaggaggacggcagcggcgttggggggtctagtctcgtcgtgcgggtggccatgggcgtgcacgccaagtcgatgagctggtacatgagcccgccgggngtcgccggcggcgccggggagcgccgccaccgaggcgcagcacgcgctgagcnagcagccccgggggcagcagcgacgccagcttcgacaccaacatggtcatcatcctggccgcgctgctgttcgcgctcctcttcgcgctgggcctcaactcgctcgcgcgct

SEQ ID NO: 73724 - DNA, 582 bp, Triticum aestivum
  Clone ID: PAT_TA_73724
cttcgtccttggaaaatagcagctatgtatatgaaccttcttctgttgttattggtgttataagttatttagaagagcagagaaattcactaattgatctccagagagacatggtgttaagataccttgcgaaatagatgcccagtttgctgggatggttgaagcctgggcttcggggttgacctggagggagataatgatggactctgcaatggacgatggagatttagcccgtctactcaggcgctcaatagatttactagctcagattccaaaacttccagacattgatccagttctccaaaagaatgcacaaattgcttgcagcgtcatggaccgagtaccgattagtgagcttgccggttgaaagcccaaaacctgtaagtactactaacagagggtttgcccggctgcttattttacattgttatagggtagggaattctttgttgaccatgaaaaatagttaccagttgtcacaatgaaatccaagagcagttcatctcccactggctaaacatgcttttcaagaagatcaacaactacagtgattgattcaaggaaccagaattcagaatgatg

SEQ ID NO: 73725 - DNA, 508 bp, Triticum aestivum
  Clone ID: PAT_TA_73725
cggcacgaggcatagttctttcctgcaatgccacagcggaccatgccattatttggattgagagggaggcccagaaggctttggatctgatgctggaggaggaggacacgatggcagtgccatccgagcagcagatggagcggaacgaaaccctgcagaaggagcacgtggaggagcacagggccgctctgcgccgggctgtcacgctgtcagtgccagacgcgcggggaccatcgccgtatggtacgtttgacgaagtcgagcagcatcaccaccagccggagaggagcgagagcttcccgccggcagggcccaggcagcgcatgagctggaacgacctgatcgagcgggtgttcgacaaagacgaggacggccatatcgtgctgcgcagctcagttcttctctgaagagcgcagcctcccggcctcacttgggccgttgtaaattcctttggtcttgcaattgtgctgccggctgcctctctcccagcagaagcccccattttctt

SEQ ID NO: 73726 - DNA, 315 bp, Triticum aestivum
  Clone ID: PAT_TA_73726
cggcacgaggcaactaagatggtcatcctaactgaagaacgattcatggtttacgcatctggtctgaatgtctatgggcttcggaaagactgttgtacaatgatgttagactgttaccacaccccttactgtacacgatggtatcaatgatttgcccagttttatggcatcacagtattgtaaagaccaaatgtcattagccgttaggttctattaacatctgtgctgcccggggtgcgtagcaatgtattttttcactatccccgctgcaaattgtaagaagaattctaggctgctaggcaacccttcagcaaa

SEQ ID NO: 73727 - DNA, 647 bp, Triticum aestivum
  Clone ID: PAT_TA_73727
tcggcacgaggcatcggtccatccagccccagcccctagcggcgcacccaagcgagcggcggcagaccacgcgagcgcaagcgcgactgcggcactgcgcactcgaacagcagccagcaagtagcaactcggtggatccaccattccaccctgcgtccaggactccaggtctccagtctccagagtccaggcatcgacgtccaccctgcagcatagcagcagtgattctgcggtccgcgtgcagccgtccacgcgcagccttggagattctgccgtcctcgcacagctgttgcaggtgggcctcggatcctcgccgctggagctcacaggtaacatggatatgcctggatctgaatctcccatgagttcggatggagaagaaaggttgaagtggaggcctatcttgctcaaataactgaagatgagcaagatctaaagacatcagttgaagctatagctcatgttccgcccaaatcaactttccttcgcaatgttggcatggagtccaaatagatgaagaaagatgctaaagctgctgcgatgaacaagcgtgtgcaagaactgatgttctggatgtagctgatgttctaaagacatttgacattcttgatgtagcctttgttctacagacatttgagattttggat

SEQ ID NO: 73728 - DNA, 467 bp, Triticum aestivum
  Clone ID: PAT_TA_73728
actggccatggtgtggactggtgccctactgaattcaagtgtgacatcaactaccagcacaccctctgttgtccctggtggtgacctggctaaggttcagcgtgcaatgtgcatgatcaacaacaacactggctgtgctgaggttttctcgcgcatcgaccacaagttcgacttgatgtatgctaagcgtgcgtttgtgcactgatacgttggtgagggaatggaagaaggtgaattctcagaagcccgtgaggacttggctgcccttgagaaggactatgaggaagtcggcgccgagggtgcagacgacgagaacgacgatggagaagactattagtagctggttaataagtagttctctggttaatgattggtttgtcagtatactccggttccgttgcattgcatattcctgttatgtgtgtttactttttgtactgtgctaaactgttgttagcccctcgttg

SEQ ID NO: 73729 - DNA, 626 bp, Triticum aestivum
  unsure (1)..(626): unsure at all n locations
  Clone ID: PAT_TA_73729
ccggaatggatacttcaaggggaccactgcacttagttcgcagcatcagtttggttgcagtttcccaagatcattcgttgcatctcacatgccaaacagatctgttgacgagacctgcttctggcgaagggaatcaaggcagcagtggcctttcgagttacttggaaggtttcactccagtgaagtccattgggtcaatgccagcatcacactcatatctcctagttccttcaccaagtatgagatacctctctcctgcaacattacagctcccgacatgcctcacatcagagtcaccaccgcttgcccatctattgcacagcaaagggactgcaattcccttagcaatgggctatgtcgtctcgaaagccgtcccacctgtaaggagggactctgcacagctcaccaaggatgaacaaccctctgttctcttagttagcatcattgatcactatggcggcagcattgccactgttcaagaaaaaatgagccgnaggcggtggtggcagcaacatgagcaaacaggcaaggaacttcactcagggaacaacaactcgtgactgtgaggtagagatgcataatgtgctggaagctgtggccgcggagcttcactccctttcttggtg

SEQ ID NO: 73730 - DNA, 540 bp, Triticum aestivum
  Clone ID: PAT_TA_73730
tcggacgagggttgtgaagcagcttctaggccttcaaatcaacgcagagaaatattattttggaataaggaaaagtcttgttgagtttgatgaagtcctggaggtccaaagaaagcatgtgtacaaccttaggcaggtgatattatctggtgactctgaaagctgcagtgaacaaattttccagtacatgcaagcagtagctgatgaaattgttttgttaaatattgatccccaaaagccacccaaggcatggaatctggtaaagcttttggatgaatttgtcagactaggcggaaaactactgagtgaatcattcgaggacatccaagaggaaaacctacaatcagcacttgaggaaatgcaaggttgggacccagtgaaagctgatagttttgctcttccaaacatgccggtgccgcctgattcacttagaggaattcgaaagaaaacatcttctataatgcggtggtttgccatttgtgttgatgatacgtcaaagaaagggagatatacaaacactgtcaatctgctccggaaata

SEQ ID NO: 73731 - DNA, 488 bp, Triticum aestivum
  Clone ID: PAT_TA_73731
tcggcacgaggcttcccagttcgtatgagacctcaagagagtttctacattgggcctattgatgatggcgatatgcataatgatgtaaaccaatggccttctgaagagcgcttgccatcttggaaggagacaatgaagctatacattgcagctattctggatactggcacaaggatactctctctaattgctttgggtttggatatggatgctgagttctttcataaaattggtgcattgaactgcccggcaacatttcttcggttattgcattacccaggtgaagtaaatgagtctgatagtggaaactatggtgcatcacctcactcggactatggtgtgataacccttttagagacagatggcactcctggcctgcagatatgcatggagaaggataggaatccccatctatgggaacatgttcatccacattgatggggcccttattattaatattggtgatttgctagagaggtggacaaatt

SEQ ID NO: 73732 - DNA, 182 bp, Triticum aestivum
  Clone ID: PAT_TA_73732
cggcacgaggttttgtagctgcctaggccttgtggtatgtgctgctgtgggggttcattagtatcaagaggaagacgctgctggcgctggagtgtttttctctttattagtactttgtttaaaactatgtatgaccgaatgatggtatttatttgtgtcatccttgactcttattctgctgc

SEQ ID NO: 73733 - DNA, 548 bp, Triticum aestivum
  Clone ID: PAT_TA_73733
cggcacgaggcatccatccggcctcgccgatccccatcacctgcgacggcgagcagcgtcgccggcgtccggctgcctccgccgcatactcggctcggtcgtcttctcgaccttcactctccggaggtctcctcgctagccccgccgcgccgatttccatccatccctcccgcgaggtgggtgccgccgtcctgccgcttccgcctccgctccggttggctcctgaagttgattaggtggtgccatgggttcaaaggattctcaagtcgaagctactttacaagatgggaacaaagaagctgaagaggatgattgggaggcgattgcagatcgtggtgaaaacgatgagacgctaacgctagcgcgttctctcgagcagcaagcaaaggtttctcctagtagttcttctgagaaaattagcactccatcttcagggcccagaggaggggaaaggggttcgtttctttacgacaagagtgttctatacagtgatcagtgtggtctagaaaatgatatggatgaacaagagtctaatgatcagagtggat

SEQ ID NO: 73734 - DNA, 599 bp, Triticum aestivum
  Clone ID: PAT_TA_73734
cggatcggttcttaaatcttgataaagctgaaggtattcctcaatgtgtagcatggtgttgcagcaaatgggcagctggatcatccgcacgggagcaagtagcatagcagcagcctgcggccaccaacagcgacgtatacgcggcctcataggaagctagcagcagtctgcggccactaacagcgacgtatacgcatgtgggctagcgaggttcggcccccggataaccgcggatcgtcttggcacgactcgtgatcctcgtttctggctgacggagcggagggtcgacattaggtgcgctccgctccaccccatttgcagtttgatgcaagagtgcacgtggtgcgactggcgggggcagagaaagtaacatgcacctgtgggctctatgagcatgtaggtttgttgtgcaggcatagcttgaaggtgctggtgcatttggacagaacagagataccgcccggtaacatcatgtacaggtggaccaagcatgcagggccagagtacagtccgtgcacaagggagttgatgatggatcaggtatcggcgagagttgatggcacgaagagtcacgttaagagggcactagagtttgcaca

SEQ ID NO: 73735 - DNA, 350 bp, Triticum aestivum
  Clone ID: PAT_TA_73735
cgaggcagcctcatcgtctagttctgaggactctctgtgtcagcgcctaggcaatgcaactctgtactctgcgtagtactgcatgacatagcccagaagagaagggaataacagccggcggcgcaaatgccagcgaagggccgagagcggtaagaacacaccagtggtgcttctatagtttgcttctttcttacagctacagttgctagtcactagcagtgctaccagtaagatagctgctacttacagcctccgtaaccgcgactaagttttgcagccttgtacattgtaatactcctatactatagaccagcactctccaaagttagatgtatatatacgtatatata

SEQ ID NO: 73736 - DNA, 522 bp, Triticum aestivum
  Clone ID: PAT_TA_73736
gaattcggcacgaggatttttccaaactatgtaaatgtaactctctctcttttttggttggggaactctccatgccatcttctacaaacattggcattttagcagcaaagtccatatggtgtatcatataagaatgaaacaagacttcaaaaacagtttttagatcaaattcaaataataataagaatctcaataatcagcagatattagaactacaatagatccaagaaaagttgttcttttagaaaaatggcaatgaactaggaaagtatctccaacagtttggcaaatgacttctcatccataatttttttagcaaaatgaggaaaaatcctctccaacagtttggcatcctaattcttcatctcttctaacttggaatatctctctgtctagtgcgcaaatatgcgtgcaggctccggcttggcatcggtctttttcctcatgcttagcggggctcttgggtttttgaaaacataatttgccaaattgttggagatgagacctttttttttctcctaa

SEQ ID NO: 73737 - DNA, 481 bp, Triticum aestivum
  Clone ID: PAT_TA_73737
cgcaccaccaccacgaccacggccaccggcaccacaactgcgatgactaccgccgtgtcccacctcccccggccgacgagggctacggccagccgccaccgaccgacccgtacggcctggcgtcccgtcgaccccaacccgtacggccgtcctccgtgcccaggccgcgaactgagtcgggggtggaggacggcaacgtcttccacgtcgggcacgagcccggagacgggtaggcctgactacggcggcggccttgatgtggctgacgtgggtggcggccccgagtacggccacgaggtgcgcccgcaccaccacggcggatccgagtacggccacgagacacgcccgcaccacggggtcgggggcgggggcgccgcgccggtgaggcatgagacttacaggatctactgcaaggccggggatgaccagtacagcctctccgcccacgacggcaaggtctgcctcgtgcgcactgagcgta

SEQ ID NO: 73738 - DNA, 450 bp, Triticum aestivum
  unsure (1)..(450): unsure at all n locations
  Clone ID: PAT_TA_73738
agttgtacttccacctcagtaacacagaagcacattttaggaaactgttttcagataaagatcttcagatcaccaaggctgctacatgatctctacatgatcttgcagcctgaggctcatattccattaatttttttgtcatgtttttgtcaactgaaggaaagagtgatgaaccttcctgaatagtcatcgggcatgtgatctagtcttctagagtgctgttggtgtgagttgtgtgtggtgnntttggggggatctcttgctcttcccctgtgtttcaaaccttaatgaaatgatatgcaattctcctgtgtggctgcgtgtttgagaaaaaaagaaagaaaggaacacttgtatggataaaatctatctatttcatctgtaaagttagctctccgtattccccaggtaaaacatatatgatccaacatgtcacagtttactcttcag

SEQ ID NO: 73739 - DNA, 466 bp, Triticum aestivum
  unsure (1)..(466): unsure at all n locations
  Clone ID: PAT_TA_73739
tcgcggtgatctgcaatttgtgtgccggagacggtattagctctgcttcttcctactaattatgtgctgttagttagtacaagaagaggttgctcttcagccacaactccctcttttgtttcttcaggtnngaaacctgaaaacatcacactgtttctttcaggtgttgctgacatatttgggagacgatttgggcatgtgaagctccctcacaacncctgaaaaatcatatgcaggaagcattgccatgttcttggcaggtttcatcgcatcagtgctgtaagtaaacagtctatctggtactttttctatccaaaacactatttctgaaacctgatactctgcatacctgaacctgaaactgctatgcatgtgttgtgatatgtgtttatggaaccagttttttttttttttttttgatgaaaattatggaaccaggttcatgtgctacttcaacattttttgg

SEQ ID NO: 73740 - DNA, 531 bp, Triticum aestivum
  Clone ID: PAT_TA_73740
gaggccgcaggggctgtacgagcacagggacatcgaccagaagaagctccggaagctgatcctcgaggccaagctcgcgccgtgctacatgggcgccgacgacgccgccgccgccgccgacctcgaggagtgccccatctgcttcctgtactacccaagtcttaaccgatcaaagtgttgctcaaaagggatatgcaccgagtgctttctccaaatgaaaccaactcacactgctcagcctacacaatgtccattctgcaaaactcccagttatgctgtggagtatcgtggtgtaaagacaaaggaggaaaggagcatagaacaatttgaagagcagaaagtcatagaagcacaaatgaggatgcgccagcaagcacttcaagatgaagaagataagatgaaaagaaaacagaacaggtgctcttctagcagaacaatcacaccgaccaaagaagtggagtatagagatatttgcagcacatccttttcagtgccgtcataccgatgtgctgagcaagaaactgaatgctg

SEQ ID NO: 73741 - DNA, 526 bp, Triticum aestivum
  Clone ID: PAT_TA_73741
attcggacgaggaggggttctgaagtcggttgctggaggattacccttgctggcgcagtgttcttcatgatccatctcagtgccgcactgctgcagaagaagcaaggaaagaagctttgcgacagttataccatctctttcagaaaaatcagttcggagcaactcaagggccaagaacatggacaaagaaaatgtccatgatgtgtatcctgggggatggctgaaggtttaacaagatgatggatgtgggtcgcgcacgctgcctggaagacagagcacagtctacttacagcggcttaacagaatctggataatttttgtcgagtcaccagttaaagttaaagtcagtaccctgcattcttcatgtacagaacgatatagccatatcatatcatataatataggtgataaattacagcaaataatcgaacaaattttgtacaattgtatagaggttaattgagatctttcaacgtgaaattatacgttggtgcgggcaggtttattttaaaaaaaaaaaaaaaaa

SEQ ID NO: 73742 - DNA, 526 bp, Triticum aestivum
  Clone ID: PAT_TA_73742
cggcagatccatgttgattgtcatgcgaagcttttgaaggaaaccacaaacacttgtgatcttggccttcttaggaggcttattgttcctccccaatcagtgaaagaagttggtcaaggttcaggaattagcggaatgctcaactcaatcaaggatgggtttgccaattcaacagctgggaatcgtaggaggccacgcaacaagaaacgcgggaataaccatcctggtggcaaggcaaattccattcccgcaaaaggctcagtccttgattcagtgcttgaaggatttgctagattgaagggcctggatggaaagtatgcactggcaaagcctttatctcaaaattctctaaagcaaacatatcgatctggtattcctaatgaacgagtgagaaagtatgaacttgttgatttgccacaagattcaagaccactgctggtattcatcaacggcaagagtggaggcagaaatggaccttctcttagaagaaggctgaacatgttgttgaatcctatacaggtaatca

SEQ ID NO: 73743 - DNA, 491 bp, Triticum aestivum
  Clone ID: PAT_TA_73743
attcggcacgagggcggcgcgggccggccgccgggcgaggtgcgcgtagctgctgccatcgatcgtcgacgggtccatccaccatgggcggcggcaacggccagaagtccaagatggcccgcgagcgcaacttggagaagaacaaggggtccaaggggagccagcttgagaccaacaagaaggccatgagcatccagtgcaaagtatgcatgcaaacattcatgtgtaccacgactgaagtgaagtgccgggagcatgccgaggctaagcatccaaagacagatgtgtaccagtgcttcccccatctgaagaagtgaaaagcctctgaactagcaaccagtgccgtggtcatggagttgaggaaatgtgtctgttagcaatgcggtttggtcacagtcagtacaggtcaggagctttgcctgtgaggagggtgttaattccgtgttgtctaccgccaatcatgcgtcctgtcctatgttaacctatacata

SEQ ID NO: 73744 - DNA, 549 bp, Triticum aestivum
  Clone ID: PAT_TA_73744
gattcggacgaggcgatattccccattctccgtgttgtgcttgtttgtagccggcactcagctcacacacggaaccgaaccgaaccgaaccatgtcgtcggcggcgggaggagacggggagacggtgcgggcgtcgcacatcctcatcaagcaccagggttcccgccgcaaggcctcctggaaggaccccgacggccgcatcatctccgccaccacgcgcgccgacgccgccgcgcgcctcctcgacctccgcaaccagatcctctccggccaggccaacttcgccgacctcgccgcgcgccactccgactgctcctccgcgcgacgcggcggggacctaggtacctttgggaggaagcagatgcagaaaccatttgaggacgctacatatgccctcaaggttggtgagctcagcgagatcgtggacacggacagtggggttcacgtcatcctgcggactgcctgaggagagaaccatgctgtcagctgagtctcaggctttcagttagcgcttatggctttctattaggacctgtatttttattcctg

SEQ ID NO: 73745 - DNA, 595 bp, Triticum aestivum
  Clone ID: PAT_TA_73745
attcggacgaggcggcctccccttcttctcctgatctgttcatcgatctgttcgttgggggagagcacgcgcgaccgccctgccttcttctccgcttgatcgaaggcgctgccgctgcctgctgaggtgatccgtaacccaaagccagacctcctcgtcatgacccgaagccccaaggcaaaggtaaacatcaggagcataggctcaggcagccagcgcaagctagggcggtatgtctatcttcctcacagcaacatccactgctacgaggggctgtactttgtcgttggatgatccaacagtcctaggcaattgcatgcctttgattgtttggttattggaacaggaatgggaaagggatcagacatcagaccagcaagagtactttgtaatatcaaggctagcagtgtttcttcctccaaaagcaaactccaacttgtccaggtcaaatatgtcagccaatatcctctggctatctgagttgttgctataaacaaatttcactttgtcgtacaacattggctcgatgaagtgttttactatctgcagaaagagcaagcatttcataaaaaaaaaaaaaaaaaaaaaaaaaaaa

SEQ ID NO: 73746 - DNA, 453 bp, Triticum aestivum
  Clone ID: PAT_TA_73746
gattcggacgaggctggctttgtggctacaagaaatttcagtcacttctctcaaccaggagattgttagagctcttgcaagaggtacacaacattgagatgaaggaccactcttcatatttgaatcacaatcatgtttctttcgtgctatcaggatatctatgtggtcatttttgttactttgtcataaactcatgctccattataatctagagaatatatgtgttttgtctggaattttactgtgcggtcttcacttaacccgtggtgccatccaaggatccattgacatttgttatgaacaattttcctatgtaatcttaatcctgaactaaccactatatgtatccatcttttatatgatcttgatgcattgcttcagtctattgctgtcggtttatcatcagtagctaataattaagtaaatgtctttttgaactgtgtatgattctgt

SEQ ID NO: 73747 - DNA, 516 bp, Triticum aestivum
  Clone ID: PAT_TA_73747
gattcggacgagggagagagagagagactagtctcgagttttttttttttttttttgagcaggccacagttgctgtcttcgtttctcaataacaataatgctgatgtgcctctccaaacagttgcagcaactcaataaaaaaaatggaagacaaaaagcaggcagagaaacactatagtatattccttgtcttaaccacccccctgttctccaattaattaactctatctaaaacaactcctctctgctgctgctgctgctgatgatgatagaacacaacaaaattcattggaagggagtactagtatactaaaataaaaattaagcccatttggcgagcatggacatgaggccggcgccgacgagcatggagacgttgatggcgagctgcagcttccccctgctctgcaccttggggttcatgaagtcctcggcgaggaggtcgacgagcgccatgtacaccaggatccccgccgccaccgagttgaggatcccctccacgatcagcgccgtcgg

SEQ ID NO: 73748 - DNA, 605 bp, Triticum aestivum
  Clone ID: PAT_TA_73748
gtgaggctctgattttttttcctcacacgcaggagaaatatttgtgtatccaattagcctgcagatgcataaagtttgctttcagtaggtcgatttatgaatttgtgatgagccaatgaaatttatgtataagatagatgacaaaagctcttttttaatagtaggtcaacccaaatagcttgtgcccttattacatgttagttttgttttacgattttggtcaagggtgccagccttcagttaatgacttatctgtttatcttcaatcaaaacgatcagactcctaagtggtattaggacgtagttagcagcaaatgcaggagcatgcacttgagattgcaatgcacaacttatttgtattcagatccaactacagtgtgaccgctgcttattagatagcttgtttagtgagaaagtttgtagatttccctttcacttatttgactacaacttctctgaaaactcagtcaggtctgcacatagctaaattcttatttttggcttgtcagttactatttatacatttgcacatgtaggtttcaatgattggttgcataccttactttgggcaagcattatgcatctgcagagctatactatatttt

SEQ ID NO: 73749 - DNA, 467 bp, Triticum aestivum
  Clone ID: PAT_TA_73749
caaaggacatcagggagacagcagataccaccagagctcaaacacagtagtcatcaggatcaggaggaggtgctcgatggactgaagggaaaacatcggtccatcgatccacccaccgcacactctgtcgtcgggcaacaatcatgggactggggttcttggggaggatgctgcgggggcgtcaccgccgtgtggactgctgccggcgggtaagcaatcgggaggtgatccagaggctaagcagcggcaaaagcggggggcaggggaggggaagatgaacaagggaggcgagcagggagcggcagcagggggcaaggacaaggagaggaggaagaggcgagatgatagcaaggctccaccgatcgtggtgcatcagttccccttccactcgcgccccggcttgctctgaattcctcgattgaattatttctcttcatgttccttttttttgtaattctgtaattact

SEQ ID NO: 73750 - DNA, 507 bp, Triticum aestivum
  Clone ID: PAT_TA_73750
cggcacgagggttgagttagatgctgccaattccaggttgcaggatgccctgtcagagatgtgggagcttgaggcagcctctcgtgctgcgatggagaatggaatggaagaaggccttggcgattccacagatgagccgctgatcgacttccctcaggaattacggatggaagtggaccgacaaccggctcaacctgctatccacacaccggcagtggctggtcggagacgagaagatcagatggtgcctagcatgacttcctcattcattagagctgaaaccgaactcactgcagattttggcaacaccagtgaggacagtaggccagaagtcccgtcaaacattcatttgcaggctcgggcggagagggaagaaacagttgacggtggcactggcaatactgtcaggatgaatggcaaccatcagcagcagaatcttcagaacaacatgcaccgtgtgctaggtattgctccatcagtttcagaggcatcgagcagctggacggg

SEQ ID NO: 73751 - DNA, 509 bp, Triticum aestivum
  Clone ID: PAT_TA_73751
taaagatgatcatggccacgaaccgacctgatgttctggaccctgcgctcctgcgtcctggacgtttagacaggaagattgaaattccgctacccaacgagcaatcaagaatggaagttctaaaaatccatgcagctggtatcgccaaacatggggaaattgattatgaagcagttgtgaaactagctgaaggtttcaatggggctgatcttcggaacgtgtgcactgaagctggtatggctgcaattcgtgcagagagagattatgtagtccacgaagacttcatgaaggctgtgcggaagctaaatgatgcaaaaaagctggaatcgagtgcacattacagtgcagattttggcaaggagtaatgtatgatgctgatgcaatggacaactgcatatggcgtgtatcatcagggagctcagtcagatgcgatgcaaaagggagaaagaaaccagctatttatgttcaggctccaggcagctcctctttttctgatattcacaatttta

SEQ ID NO: 73752 - DNA, 539 bp, Triticum aestivum
  Clone ID: PAT_TA_73752
gtccacttcgagatggagccgctcggcggcaaccccgaacggcgcgccgccgtcgcccggccggcgaagagcctcctcgccatccccgtcggcataaagcagaaggccgtcgtcgacaagctcgtctccaagttccccggtgacaggttcacggtgatgttgttccactatgacggcgagatggacgggtggagggaactcgggtggtcggaccgggcgattcacgtggcggcgaaggaccagacgaaatggtggttcgggaagaggttcttacacccggacatggtggccgagtatgagtacatcttcctctgggacgaggacatcgaggtggacggcttcgaccccatccgctacctcagcatcgtccgccgcgaacgcctcgagatctcccagcccgcgctcgaccaccgctcccagatccaccaccgcctcacactccgcgcccgcaaaggccaagttcacaggagattctacaagacgaggggaggggggagatgcgacgacaacatgacggggccgccatgcacggggtgggt

SEQ ID NO: 73753 - DNA, 412 bp, Triticum aestivum
  Clone ID: PAT_TA_73753
cggcacgaggctcatcctcattttcgcagaagcgcttgccctgtatggtctcattgtgggcatcatcctctcatcccgtgccggccaatctcgtgcagattaggcactttgcggtaccataccgctgttattccactggctatattcttgagaaaacctgaaacttacttgggagctctagtttaatgtattaaaagatcgatttgtagcttaaggaaggtggcacttccagtcctttttgtttcttttgtggtggttcatgcaaagttttttgggttaggctggatttgctgctcctgagcaaacggatttaatctcattcgtggtgaataaaaaacacggcattgtagcaaaataaaatcattacaatatattatgttcatcccttcactctaaaaaaaaaaaaaaaaaa

SEQ ID NO: 73754 - DNA, 516 bp, Triticum aestivum
  Clone ID: PAT_TA_73754
gattcggacgagggagactagtctgagttttttttttttttttttatatatataaaacatctgtggaaaatttcttgcaccgagggcaacgttcgtgcacattgctcattgagcagctgattcaatgaaggaagagtagaacaaaatgatgaaatgctctatatgagagcttttatgccagcttgttgcatctcacgcaaccgccagactgggtaataggattcttcttctggcacctcgtcactgtccatgagttgcatagcccacgaatagaagacgggttggatggtatcctgtcctccttctgtgacttgtccttctcgatctcggacacagtatatctgctgagtttggaagcgtaagataattatgggtgaagatccaaacatttttgtttccaatacatcagcttctgaaatgtgcaggattttgtgatcaaaaaatattccctgtgatgcataagcttctctctctcctttgcagcgctcaatcacttccttggtgcaatattttttt

SEQ ID NO: 73755 - DNA, 589 bp, Triticum aestivum
  Clone ID: PAT_TA_73755
aatagaaattcaccattaatagaacaattaattttttttcatgatcatacaatttttattattattataattataacaacaattacttatataataatttttattataaaaaataaatttattaatattaaaatttctgaaaatcaaataattgaatttatttgaactacaactccacctattattcttatttttattgctataccttctttacatctattatacttaatagatgaaattaaatgtccaattctaacaattaaaatttttggacatcaatgattttgatcatatgaatattcagatttttcaaatattgaatttgaatcatatataataaatgaattaaacaaagaaaatttccgattaattgaagtagataataaaactattattccatttaaatttaatattcgacttttaatttcatcagatgatgttattcactcatgaacaatcccaagattagctattaaaattgatgcgatcccaggacgaataaatcaaattaatctttttataaatcgaccaggaatatactttgggcaatgttcagaaatttgtggaattaatcatagatttataccta

SEQ ID NO: 73756 - DNA, 539 bp, Triticum aestivum
  Clone ID: PAT_TA_73756
gaggctggggcacaaggggtccccatgaaccaagttactccatcacagggcagcgacgaggcaaagccatcagatgctacagtggcagatgcagctgccgcgacttcagaaggcactgcagctcccccagctgcagaaggtacagcagctcccagcagtgaggaacctaacgcagcagcacctggcaatgaggaaggcacagcacatccagtcaacgaggaagccacagcagctggagttccagatgcagcaggcagccctgatgtgcctgctccggctgctcctgctcctgctcctgctactgtagctgtagctgataccagtagctcggatgcacctgctgttactcccagtgaagttaccgtctccgccccctcaaccgaggcacctgagttgacggataagccatcttcaacagaggcatcgttgccacctccacccactgtttctggtgtataaaatatttctgattcttttagcgtgtgccaatttttttgtatgctggtgcgtccgttccactgtaattttccccgaatact

SEQ ID NO: 73757 - DNA, 513 bp, Triticum aestivum
  Clone ID: PAT_TA_73757
attcggacgaggttctgccccggtcctcggcgagaagaagtccgacgacaagaaaagctttgcctgcaacttataggttttagaggtaagaacagctaggggttaaaatcatttccagtagtagaatgcattcatgtggcacaaattgttggtatgctgaagatttcactcatggcgcggtgtcgaatctgtacttgcagtttggggttcaagctggagcagatgatggttattggggttctaacttggtggtcactgcgatatttgtgccagagacctgctcggcgaggatagagagctgctcaccagcacctgagatcttgtgctcatagcgcagttgtactcgagagccgctaggggtctcgctcactgagtcagctggttagtgtagtggcgtagtgcatgtgtacataggtctgctgtgctcatgctgatattttagcgatgacaaaaatgagacctgcaaactggcaagaatattcagatgtattccttgcttggacaaagatcaat

SEQ ID NO: 73758 - DNA, 465 bp, Triticum aestivum
  Clone ID: PAT_TA_73758
ttcggacgagcaccggcccaacttcgcccgccccttccagtgcgcggccgtttccgccccgtcggcggcggccgcctcgccgtcggcctcggccgtcccggcggagcggctggagccgcgggtggtgcagcgctgcaacgggagggcgggtactgggtgcctgacaagctcaccaagctgcccatggagcagatcgacgccgacaagctcaccaagcaggacgtcgacgtgcggctcaagtggctcggcctcttccaccgccgcaagcagtagtgtatacccctgctctgtcaaggttctgaggcattatcttgttgaggactcatgttgagatcaatcacaaacatcattgcggcggtggagcacttgctcagcaacagcaacagaggcgggggcgggcgcggagaggaagaccctgggcttggaggagaggttgagcagggccaacgcggcgatgaagaccct

SEQ ID NO: 73759 - DNA, 489 bp, Triticum aestivum
  unsure (1)..(489): unsure at all n locations
  Clone ID: PAT_TA_73759
gattcggacgagggagagcccactcacctctcggcttggtggggggtgcctnggctttaccaatacggcattagtccggccagccggagcgggagacgacgtcaggtggcactccctcgcgggtgttgccggccggccaccacggcccagctgagccatgccaccaaccacgccgcagcacggcggcgatgacggcgagcggttcgcggaggtggtggtggtccggcacggggagacgtcgtggaacgccccccgcatcgttcaggtcctatccgccgatcctagtatagatatatcctcagttctgcattcagatgtggaagctcaagcatcttttattctggaccgtttctccttagtgcgattcccgtatgaactatgaacagccgtaattatgtggtcattttctctctaataactgacacaacacacgttgtaatcaatcttgcaacacggacaaatgaatccagaactaaatgagaccggcaa

SEQ ID NO: 73760 - DNA, 555 bp, Triticum aestivum
  Clone ID: PAT_TA_73760
gaggccgtggccgcacgcgcacggggctcgccgctcctccgcgccctctccggcacgagggcgcggccgccgctggcccgatccatccacgaggggcccgacaccatcgacgagctcctcgaccgccacctctccaagaaggggcccaccccctccgccatcctcgacgacgacgcggcggaggccctggcgcggcggaggctgacgagctcgcggcgggaggcgctggggctgtaccgggacatcctgcgcgcgacgcgcctgttcgagtggcccgacgagcgcggcgtgccgtggcgcgacacgctgcgcgccaacgcgcgccgcgagttcgaggaggcccgcggcgagcgcgacccggaggtggtcgcgcggctcctcatcggcggccgcgatgccgtcgaccaggccctcgagcgcgtcgccgacgcctcccgccgcatggtccaggccgaggaggccaagcgccgcggggggcccgtagatccccacacccccaccccgactcgatgcgccccatgcttcctcttcttcttcagctgctgctgcttatat

SEQ ID NO: 73761 - DNA, 542 bp, Triticum aestivum
  Clone ID: PAT_TA_73761
gagcagcgctctcctcccctatttaattcgtgggggcaggggacccttgctccatccaagtcactcactcgcttcctttttactagacgcgctagctctcaagctttcgtcccgatacatgcagtagtggccgcaggagaagcccccgtgcgttgtgtcctcgctcatcgccaggcagagggcacctgaaaacagttgcgtatcagctgctcaccgatcattctcgcggttctggcagtacttgcgccaatctcactgggtaattcaccgaccctccgacgaagccagcagcttgtgcttgaagagagtagggatcgatggggatcatcaactgggtgcagaatcgtctgaacaccaagcaggagaagaaacgatccgccgccgccgccgccgcgggcgcgagctcggttcgcaatgccccggtccgggagaatagttgccgcggccaggccgacgacgaactccccggcgactggagcatgctctccatcggaaccatcggaaccctcggcaacgagcccacgccggcgccggcgccagat

SEQ ID NO: 73762 - DNA, 668 bp, Triticum aestivum
  Clone ID: PAT_TA_73762
gagcgattttgaaggagacatgtcactgtagatgggatgggagagggcgagtgcaatgaggctattgcctcttctcttcgtaatctagaggacttaatttctctaactgttcatggtggaagcgtcttacagcagggaccggtgtgttctcttccgcgtagcatccaggaactcttcatgacccagtcctcacatctacggcgcgttccaaaatgggtgagctccctcgtaaacctgcagcagctgcaccttcaagtggaagagttcgagcaggaagacctgtgcatccttggaagcttacctggtctgcttattctggaactaacaatggaaaatatagatagtaggcttacaatcacccgtgaagctggcttccgatgcttgaggaagttctcatttggagtagttagatggatgatgtttgaagcgggatccatgcctaggctagaaacacttgaactcagaatttggtcaggagaagagtccgacgtggaccataccgattctcacactgccagtgttggtgattttgatttcggaataggaaaccttccctgcctcgttactctcaaatatgcaacacatggctgcgatgattgcaatgcggctgcaaaggcttctatggagagagcagctggcacatatcccaattgcccatctccactctt

SEQ ID NO: 73763 - DNA, 589 bp, Triticum aestivum
  Clone ID: PAT_TA_73763
gaggcggaagcggccgcgcgagaccgtggcgccgccggcacgcctcttctccctacaggcgccgcagggttctcccgggcacaaggtgatacacctggcgcagctgcaccggcggccggcggcgacgggcctgcggctcgacttcgacgagggaggctcggagcacgtggcgtgcacgtcgtcgacgtcgtcccttctccccggcgagctcgccgctcagtgcgggcggcacaacaacgagatcgaccggctgctccaggaacacgcggagagactccggcttgcgctggccgacacgaggcgtcggcagaaccgctcgctgctgggcgccgcagaggcgctggccgcgcggcgggtcagggaggtggaggcggagaccttcaaggcggcacggcgcggcgtcgagctggaggagcggctggccaggctgagggcggaggcggcgtcgtggcaagccaaggcaatgtccgaccagtccacggcggccgcgctgcacgcgcagttgcagcaggaagcggccacagcgcaggcgaggagtggcaaggccgccgaggaggccgagggagcggcggacgacgccgagtccggc

SEQ ID NO: 73764 - DNA, 417 bp, Triticum aestivum
  Clone ID: PAT_TA_73764
gaggtttactattgagggggtgttcccctcgcatcccgctgacgttatcttcaaatgcatcgttttcttgcagcaatgggcatcgctgggaagacaacaggactctgatctccaccgccaagctatctgtcgtctacacgccgtctactccgaggctcgagcttcgtcgcctgctcaactggatgccgcatagggatgggcaatccccccccttttggtcttagtaccttccgagcctgcgtgctcgctgcttttgggccgttctccgccttgtaacgaaactgtgcgctcttttagcggtctgtcctcttatctgtcgtgttagtttatgcagtttctgttcggtggttgtgctactctgcctaagtttgtgggctttattaatttaaagccggacgtctctgacgtctatgttct

SEQ ID NO: 73765 - DNA, 454 bp, Triticum aestivum
  Clone ID: PAT_TA_73765
cggccgaggagagagagagagagagagagagagagagagagagagagagagagagagagagagagagagagcttccccgtgtccatgtacatctcgcagcgccgggtgccgcggggcagcacgcggtggatgttcctccacgcgctcagcggcgtgtgcctcctcgtgtccgtcgtggcgggcgccggctccgtcgccgacgtcgcggtcgagttcaaggcccacaacccgctccgccgggggtgaccgggtctcttcggccggcgatgctccgctcactcaaccaagttggcgagcaacgttttactgcttcgatgtgctactactagtactaattaccgcgtactctgtgtcgtcataagcttgtcctcgtccggtgggcaggtgctgaaccggactgtagcaccgggagccggcgggccgaggaatattcgtgtggctatcctactggcat

SEQ ID NO: 73766 - DNA, 627 bp, Triticum aestivum
  Clone ID: PAT_TA_73766
attcggccgagcgtttttctctgcctctcgcgcacgaactccccgctccccgcatccaaaagccaagacgcaccggggaaagcagccgctcgccgaggcgagtcgggccgtcgcgatggtggatgtggagcaccggatggcgggcatggccccggcggcgcacgcggccggcctgcgccgcctgtccacgcgcgccgcggccggcccttcctcggcgtcggcgtccccgcgccacgggctctactccttccagggcgtggcgtcgtccgtgctctcgcacctccgggcctccggggtggccgtcctcccggggctttcggagatggagctcgcccgcgccgaggccgagatggggttcaccttcccgcccgacctccgcgccgtgctggccctcgggctgccgtcgggccccggcttcccggactggcgctcccgcgcggggctccgcgccgcgttcgacctgcccgtcgcggccgcgtcgctccagatcgcgaggggcgcgctgtggccgcggtgctgggggaagaggccggccgactccgaccgcgcgaggcggctcgctcgctccgccatacggcgcgcgccgctgctggtgccgctcttcgaccgctgctacctgccctgcag

SEQ ID NO: 73767 - DNA, 413 bp, Triticum aestivum
  Clone ID: PAT_TA_73767
tcggcacgagccccccttttcctcgccgctcccgctcccaccctttccaggtgcgcaagcgtttccactagcagcagctgctgctgcgcttcttcatgcatgcactgctcatggctccgcactcccacagtagctgccgcctaacatcaacccagcagtgagtgaggagctaccgcaggattcctgctcaattcccatctgcggcgagcgagggccggagccatgcagcaaccggccgacatgccgcccttctccccggccggctggcgtgggcccgccggggcgccctcgcccatcagcagccgcccgcccgcgccggctccggcgccagcacagcaacaccagcaccagcagcagatggacgagcagcacgggggggccgcggtgagcgggtctggctcggggagcgtgga

SEQ ID NO: 73768 - DNA, 369 bp, Triticum aestivum
  Clone ID: PAT_TA_73768
gcctttgcaacatcgcgatcccctttgctcgatcccacttccctcaggcagccaccacccaaaccctaaagtaacactgcaaaagccatggccggcgccgaccccatctggatgatgctcgaccgcttcgtcttccgcagggatcccgccgagtcctccatcgaagaccgcagctattccttctcggccagccacatcgccgggtccgcccccttcaccgttgctttccgcgtcctcagccccccggagatctcccgcctctacctgaagtggccgcctctgctagatccaatgaatggctcttcgtgcgatctcgtggcggcgcgcgacaacctcctcctgatcagcctcacctccagccccgggact

SEQ ID NO: 73769 - DNA, 558 bp, Triticum aestivum
  Clone ID: PAT_TA_73769
gagcgctggcccgccctgcttcgcctccgaatccaagtctagggtcagtggcccagcttctgcaaatgcttcaaggcagcagcatttccaaccagaagaccttatatgaagtcctatctgtgcctgaagatgctacatatgacgaaatacgtacagcatacaagtgtgctgctttaaatacacatcctgacaaagcacagccgactcttgagccatttgtgcctaccggcgagcaacatgattttttcggtgtgcaaaaggcatgggaaaccctacgctaccctaaatgtcgggcagagtatgataaacagctgcaatcatccagacagagccttgatgtcatcgcaaccgatatcgaaatcgaggatatgattgttgagagctctgatgatggtgtggagctattgtacgcctgtagatgcggcgattatttttcgatcacatcttgcgagcttggtgaaaatgggaattttggtgagtgaagatggggaaatagaagcgcaggcacctgattctttaccaacatctattgttctgggatgtggctcgtgttctctt

SEQ ID NO: 73770 - DNA, 486 bp, Triticum aestivum
  Clone ID: PAT_TA_73770
tactgcattttggccatgtggtgtgcctgatgctccagcatgccagttgcatttcagtacataagcacctagcaggtctgaaagccttaggaaatcatttgcatattgtcaagctactgggaaatgagtaatagcctcatcttccaggatagtagtgtggactcctcattggttgtaaagtgaagcactttgacactttcaatcatgagtaaatcagaagcatgtgtgtaccagcttgctagctatagctttggcgcggaaagccagtgtactcctttccttctgtcgatcgaccgatctacctaccttgtgatgcacgttttggttccgttcccgacactttgcgtgatcatttcatccatttggtgtgatccaaaagatgatctaaaagtaatcagtttctaattaattgcctgcggcgatcatgggttcatggcgccaatctgatttgcgtgtctgcactgcacgcagagttcaagtacccgc

SEQ ID NO: 73771 - DNA, 470 bp, Triticum aestivum
  Clone ID: PAT_TA_73771
attcggcacgagggacgtgggcggcggggcggcgtcgtacaccgtcagcatcacgcagccggccggggtgacggtcattgtggaccccagcacggtgagctttgacggtaagagtccagacgaggagaagcacttcaaggtgacgtttcaagtctatgaccccgtcaaggctgccaactacgtgttcggcggcatcgagtggtcggacgggaagcatcacgtgtggagccccatcgtggccaccaccaagtgcggctagtgtttggagtcgatcggtacccggaataaattgagggatcacatatttaacacatgcacatcacatgtttgtatcattgtatgctactcaggttgtgtgattgacaaaacagagtgcagtagaaatatggcacaaacaaccatgtgtttcgctaatacaaagataaatgcttctgagagtcatgctctgaattaaaaaaaaaaaaaaaaaa

SEQ ID NO: 73772 - DNA, 643 bp, Triticum aestivum
  Clone ID: PAT_TA_73772
tcggcacgagctcgatcgacacatctcgggccgtccggcgcgtggtgttcgtccatggattcctcgcgatcgatcgcattgcgctgaccggggtttctttcctgacgatctgcagaagcagaagactgcgctggcgaaccggctggggctgcggccgcggcaggtggaggtgtggttccagaaccgccgcgcgcggaccaagctgaagcagacggaggtggactgcgagtacatgaagcgctggtgcgagcagctcgccgagcagaacaagcggctcgagaaggaggtggccgagctccgcgcgctcaagaccgcgcccgccgcgcacgcccagcaggccgccacgctcaccatgtgcccctcctgccgccgcgtcgccgccaccgccgccggaccggccgccacgcagcaccagcaccagcaccagcagccgcagcagtgcagccccaagcccaacgcccaccccgccggcaacgtccttcccagccactgccagttcttcccctccaccaccaccgccgccgcccccgaccgatccggcaggcagcagggcgcgtggaacggcgccgcgcagccgctggtcaccagagagctcttctgagacgacgagatctcgccgccggggcccaatccaggcgataaa

SEQ ID NO: 73773 - DNA, 698 bp, Triticum aestivum
  Clone ID: PAT_TA_73773
ttcggcacgaggagtgaagcagatgatctgctgctgcaacaagatggacgccaccactcccaagtactcaaaggcgcgttacgaagaaattgtgaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaatgagcccaagaggccctcagacaagcccctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggta

SEQ ID NO: 73774 - DNA, 657 bp, Triticum aestivum
  Clone ID: PAT_TA_73774
ccatttcttgtcatatagcaagacatccaaataagcatctaaagtaggtcatttgtagtgtgccatcctgcattcaactcttaagcttgaagccttaatgcagttcagatcattgcttgagtcagccaatagaacataccagcaagcccttgagcacattttcggtgtccatgttatgtccacctcctgttgaattgatggtgactgcgcttcaaactgcagggatgggaggatcaaaatctttgggggtgataatatcgaaggcatcctcatatcgccgtagagcatgccatacaagtatcttcaggtttggcacttcatacaaaaagagtagcccgatttgttaactgtaggatggaccaaactgtaggactttggtcgttggtcttggcacatggagcagcagcacaatgcagaactgctccgctcaaaaaacagagcagctagccaaccaaactgagatacaatgtagacaggcaggcagcaagtactccaactagttagcagacatattttttcccttccaatccccttcctgctattgtgattaccaccaacaaagaattttatctggcctcctcctcctccgcgggaaagaatacaatggatcttttttgggtaggcgaaatttatgtctgtacatgcttgatatgaaag

SEQ ID NO: 73775 - DNA, 611 bp, Triticum aestivum
  Clone ID: PAT_TA_73775
agagcagcagcaagcacccaagtgagaagtacgagaagctgcttgagctagccagccatggagctcctgccttccatagccgtcttcctactcctctcctgctccctcgccgcagccatggtgccggccggcacgatcgagcgcgtgtccaagcagcagatcctggtaggcatcccgccgggcgggcatgccggcccgcccgttctgttcctcacgtctccgtccggcaagtacgcggcttacttcgtgcgcacccacaccgcgccgggcgccggcgggctcggcgctgacttttgctacgtcgaggtgatggccggtggcggcaaagcggccgagggcggtgaaggaggcggcgctgccgggggcgcgagcgcatgggagtcggagtgccggccggtgagcacggtgaacacgtgcaccctgctcttctcgtggcacgggctggaggtgttcgacggcagcgaggaggtgtggcacggcgagaccaacaccgacgggaccaacttcctgcagacgctcgagctcgtggacgacggcgacatgcgcgtccgcgacaaggacggtgagctcgcgtggcgggccagcgacgagccgcgccacgcgcagcactg

SEQ ID NO: 73776 - DNA, 646 bp, Triticum aestivum
  Clone ID: PAT_TA_73776
attcggacgaggagaaattgatcggcgttttgccgacctgtgcatacacatttcacattttccttcttcttagttgagctagctggagttcagtttatagtggaaaattcgattttattttgttttcgtttctgtttctgcaaaaaaaaatggcatgtcggcccacggccacttgtcagcctaccctgaagcctcgcctcgacgggtcgcactctccggtctccgcctccgctgcgtcaaaacatcaaacggcttgcgcgcgcaacccaccagtccagtgatccaccgcaaccgacgccgccgccgtcgcccgaatgtccgtcgctgccggcgtcgccctcgccgtggccgacgccgtgtgggcgcagatcaaggccgcgggacacgccaccgacgagcacctgtccatcctcgaccacctgttcggcaagaacatgctgcgcgcctgcaagatcctcgacgagggcggcgtccgccgcgtcaccggcgcgcccagcggccgctcgctcttcctggtgatgggggagtccaagaggaaggaggagtacatctgcttcccggagcacctctgcacctgctactccttcttctatgacatcgtcggccgcggtgagcagctctgctgtaagcaccagttggcagcgcg

SEQ ID NO: 73777 - DNA, 697 bp, Triticum aestivum
  Clone ID: PAT_TA_73777
cggacgagccaatctccccgctcgccgccggcgactcccgctccggcaaggaatcctcacaaattcctccggcaccggcccgagcacagcgcgggttcaccatggtgaagaacttccgcaagcgaagcctcgagtcggacgccgccgacaactccgacgacgaggacacccgccgcgttgctctggaggagatcaggtacatgcagaagctccgggagaggaagctgccggcggcgtccgtagccaccggcgccgccgcctccgccaccaccgacgggtccaccgctcggggccgaggtggaagcggggcaggggcagcgggcgaggaggacctcgtgcttcaggacacctttgcgcaggagaccgctgttaccatcgaagaccccaatatgttgaggtatgtggagaacgagctgttgaagaagaggggcaagacgatcgaggtcaacgacaaggacgataaggacgaggtggatgagctctatgttgtgccggaccacctgaaggcgaggaagaagaacatggaggagagctcaacccagtggaccaccggcatcgctgaagttcagctgcccatcgagtataaattgagaaatattgaagaaaccgaggcagccaaaaaattgctgcaggagagaaggcttgctggtaaaacaaaatcagatgcaaacattccatcaagttacagtgctgatta

SEQ ID NO: 73778 - DNA, 446 bp, Triticum aestivum
  Clone ID: PAT_TA_73778
tctagtacttaagccagtactccattctttccgaatcattgaagttttaggtttgtcctaagtcaaatttgtttaaatttggccaagtctatagaaaaatatgctgagatatacaacatcaaatatatataatatgaaacatatttcataaattatctaatgaaactaatatgatgttctatatttttctatggacttgaacaaaagtaaacatgtttgacttaggacagagctagaacttttaattaatgtgaaacggagggagtatacaaggtttgtaggatgtgcctgtaaattctcttatccacattagctattctgatgtgatgactttatatatgaattacacacatgtaataatagcgttattctattctggaagctttgctttgctgcttcggcgagcatgaataagtgtgtggtcagtaaacggggacctactgtca

SEQ ID NO: 73779 - DNA, 444 bp, Triticum aestivum
  Clone ID: PAT_TA_73779
cggcacgagcacgaccaggaggtcttcgaggcgatcaagggcgagttcgtcggcggcgagctgcagataaagctggtgttcctcgacacggcgctcttcgacggcttctgcgagtaccacggcgagatggacagggtgtgcacgatgcacgccaactgctgcctccgtctcgcgaccaagttgcacgacctcaggaacgtggtcgccgactggaagaggtactccagcctgacgccgccggagaagatgagcagcaagctcaggtggacgtaccccgccaagtgtgcggcgacgatgaaaataccagcataattaatggctttttactagtttgtgtagtgaccttacgaacttttatgcagtgattttggtttcgacacttttagaagatatttctatggaaggatagatgttggtatttggactcgcaatgggcctgaatct

SEQ ID NO: 73780 - DNA, 603 bp, Triticum aestivum
  Clone ID: PAT_TA_73780
cggcacgagctgaagcagctctcatcgccatcgatccttcccgatctgctccgatggccgacgccggcgccgccaagcccgagccggagaagaagtcctcctccgcccccatcgagccggcggtggaggcgcaggcgaagcagatcgaggcgctctcgctctccgtgccggacgacgacggcggcggccccgagggcccgcccctgctcgacgactccgacgactcccaaatccaggccgtgacctcgggcggcacggtgtacgagtcggccacgaccttcgaggacgtgaagctcacccccgagctgctcaaggggctgcacgacgagatggggttcagccgccccagcaagatccaggccatcacgctccccatgatcctcacgccgccccacagggacctcgtcgcgcaggcgcacaacggctccggcaagaccacctgcttcgtcctcggcatgctcagccgcgtcgaccccaaccgcaaggtcccccaggccatctgcatctgccccaccagggagctcgcgcagcagaataaatctgtgctcatgaggatgggcaagtttaccggcatcacctgtgcctgtgcaatcccgtcgtctc

SEQ ID NO: 73781 - DNA, 419 bp, Triticum aestivum
  Clone ID: PAT_TA_73781
gattcggcacgagctcctttggaccttatgcttcggccaagcctgttacttactatgcactgtgccccgatattgatatgcttacttctgcagccactgattttttcatgcagcttggaacaatttatgaagtttgcaaactgggtactcattcgccacaacacagtggggggcaaatagaacaatctcctggaaaataccagccttcaggacttgttctcgttgagtgccctgatcaattgaagtctagtggcagccactcagtttctatcagttcagtaactgaatactttcaggctctttcaaaaagttggagtgtgaaaagttttttatcatctctggcaaggataatcaaggagataaagcttaatttgaacatttcaacaaatcagaaagagagcagtaacataccttgcact

SEQ ID NO: 73782 - DNA, 440 bp, Triticum aestivum
  Clone ID: PAT_TA_73782
cggcacgaggaacggccaccatgcatgcattggcagagtgtgcacattcaggggatacgcagagaagcatgctgaaactgtggagaaaacatcatgttgaatggagacaccaatatggtaaccatctttcatcttctttgatctcaggtcaccagtttggcgaattctttggtagttgcgactcccgtccaaggtcaagatttttttgctggatgctttgcatgggatcatgccgctgaaatctatccttgcaaatagacacattggtactgaaggtcactgcccaatctgtaacttgggcgctgaggatgttaaacacttgctttttgagtgtacgcctgcagtggaattatggaaattgcatgttgataccatcatctttgatgtgatgcacctaatgttactcttccaaaaaaaaaaaaaaaaaaaaaaaaaaaaaa

SEQ ID NO: 73783 - DNA, 622 bp, Triticum aestivum
  Clone ID: PAT_TA_73783
gaggctgcgtcgccggttcagtcgtctccgaccgcactcccccgtctgcgccgtcgagccgggcctgctcacctccttcttgatggtcgcgcgccgagagagccctctgctggcagtgacgcagccgtgtctggtgccgtacaagggacgccggcgcaggatgctatcgccgtccgttcctaacgccgctgagttgaggcatgatgtacatctggtggtcgtcaagtcaaggaacctcctcttcttgctacggcagtcctcctcccgctgctctgctctgctcaatagctagcgtccatggctaaaacaaagggcgactagtgatgcggcacagcaagcagtagcaggcacccgaagcagcagcagcagggggagggggtctctcgaacgtcgctactgtcactgattgatgatggatgatctctctccctctcttgcaagcgtctataaatgctggtagaaatagaaatggtagctctagtcccatgttgttgtagtctcatgtagttccttttctcggaccgccctttgttgcttcatttctatgttaattcagtctttgtcgaatgtatctactatctattatcgtggctgtgtaatgaatccttttgtgttgaatgaa

SEQ ID NO: 73784 - DNA, 706 bp, Triticum aestivum
  Clone ID: PAT_TA_73784
gagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatgaggaagct

SEQ ID NO: 73785 - DNA, 549 bp, Triticum aestivum
  Clone ID: PAT_TA_73785
cggcacgagctcctctagccgaccgcgcaatgcagaactttttggggtggctcgcgcacggcggcgccgtccagctcccgcgggccagccatccggtcgtccacccggctccgccgcctcccgtcccggatgcgccggcgcagccgcagccgcagggacagggcccgcccccggctccggctccagctccggctccggccccggccccggcggcagagggagagatacaggaggtggccccggctgcggcggcagagggacaggggcaggccccggccccggctccggctgcggcggcggaggtggaggacgcgaacgcgaacgcgccgccgcccggggtggtgatggtggacctgatgggggcgccggggacgcgctgggggctcggcacccgcctcgcgcaggccttcctcgcggccgccgccatcggcttcatggcctccaccgacgacttcagcgaggtcaccgccttccgcctcctcgtaacagcagaggccttgcaatgcctgtggagcctcgctctggccgccgttgacgtctacgcacttc

SEQ ID NO: 73786 - DNA, 706 bp, Triticum aestivum
  Clone ID: PAT_TA_73786
gagctcgtgccgcgctcgtgtcaggaagtacccccatgtgctctgttttcctgtcttgcaacccacacaaagccgggcgaaaagggctggattctgcgtgctgatcgagggatttttgttggggcagtagaaatagtagtagtaatgtgtttcatcgttagcagtagcactgtcagtatatttttagttatcccgttagactgaacctgatgatagtggagtgtgcgtgcactgtagctggttgctggtcagtagatctgaaaggggtcaaactgtggaggactagctgtactgcctttgcttgcacgtgaaagaaaggtcatctgcattattggcatatccttcgcccacaatcgcaccctcacagtttgcaacccagaagcgtccaacagcttgatttcggcccatccgttcacaaaccatgggcctgcaaaatgagctgggggcactgtacaattcggcgcacacggtggggttcgcgcactgcgggacgttcacgggccggatccagacggcggcagtggacccgacgatggaccccgggtacgcgtcgcaactgctggcggcgtgccccggcgggggtggacccgaacgtggcgctggagatcgacccggtgacgccgcacgccttcgacaaccagtacttcatcaacctgcagaaggggatgggcctgctcacctccgaccaggtcctctacgccgacct

SEQ ID NO: 73787 - DNA, 734 bp, Triticum aestivum
  Clone ID: PAT_TA_73787
gagcgaattgttatgcgctgatggttgctgcatgatagatcttaggatgggtgtgtatggctaccccattgaaattcaatcccttttcttcatggcactaaggtgtgctcttctaatgcttaaacatgacgctgaagggaaagatttgtggagcggattgcaactcgtcttcatgctttaagttatcacatgcggagttatttttggctagatttccagcagctaaatgatatttatcgttacaagacggaagaatattctcatacagctgtcaacaaatttaatgttattccagattctattccggactggctatttgatttcatgccttgcgagggtggtttttttgttggtaatgtcagtcctgcaaggatccttcgcatcttggtatgatagccttggaagaggacaaggcaatgaagccagttttgagaaggtccgcctcatggacaaactgatatatcgacaagagctttaggggagcaacgtctggattgaaaacacgaattattcgggtagcatttctctgctcatcccttgttttgactttcccaacggaaagttttattttcttctggattcctcggctgtacaatatctcggctcatttattgagttggaaaagaagcaattgtggaaatgagtattctcttttcttttcttttcaatccatcgttgtaagaagatactattgattcttgcttggtcattccgtagtaacgggatccttgact

SEQ ID NO: 73788 - DNA, 450 bp, Triticum aestivum
  unsure (1)..(450): unsure at all n locations
  Clone ID: PAT_TA_73788
cggcacgaggcaaagccgagggtacctgctgcagtagcaatagcacatcatgcacttgtgactgcaacaccatagctcaagaacgttgcagcagcctcaccgacaactacacagattgccaagcttgcactaacagcatattcaatcagtgcaataccacctgtaacgatgactgcaacaacaactgcaagaagaaagggtgtcatgcataggaatagcatgactaatgatggttgtgcttgtacctacgtttgtgtttgatcttttttatataaacgtgcgccatgacttggttttatggggtggcaccggagatatgggttgtggcgcatcacctccagtgttttagttggggatttgcattttgtttatttatactgaataataatattgaacggaagaaatttcaccaagttanaaaaaaaaaaaaaaaaaaaaaaaaaaaaaaaa

SEQ ID NO: 73789 - DNA, 734 bp, Triticum aestivum
  Clone ID: PAT_TA_73789
gaggtgttgtggaagttttgttaaggggattgaggaagacagcttctgattgaacgacttcctattttttttgaagtgctgctgggctagaacaatcagatggattcagttgggccttttagttaactacactacctattgaaacagactttctctctcaaaaaaaaactattgaaacaaaccgggccgaccaaagttggcataccaaatgtatatatatgatgccatctctgtttgggagcagctaaattcttcaccagcaatatagaaatcttttgtttcccccataattttgttgaactggtcactgcacgaccaacttcttttgcacctcataattttgttcaacatcataatatgtgttttacctggccggcttcataattttgtttcttatatatgcaggttcatggttctgaagttaattcctttcagcttcaaactgaaataattcctctctgttcccgcaccatggagacgggcactaaactttcaaaaacaatatgaagttaaccctttctgtacatccgatgaccctattgttctggtaaatgttttcattattgcctaattgtgcaagtgattgacactttctggttgtgctaaatttcagtcctataaattttctttgagtatgttaaaaagatggagccatatctcactgggatttgtgcagtaaactgtttttcttttccattcttgcaaatgaggcacatgatagatcacatctatgt

SEQ ID NO: 73790 - DNA, 583 bp, Triticum aestivum
  Clone ID: PAT_TA_73790
cggcacgaggaatgttgaaaatgttctttcaagaacgaagggagtatgccataagccagtgtattcgtagtacgtcttcttcgtctgaggtctaagaggtaatctgtatttcactagcaggaagaatgaaagccaaccggtgaagtgcatcagctcgcccgctgacgctcccgcggccccagccggggagccctccgctgcgtaagcaccggagcctagcacctccgactgagacagtcggtgagctcggccggcggacagagatgagatgggtctagagcaattctttggaatgatcgatccgtccgtcgggagatgatgaaccggagccggagccggagccggagccgtctctttcactcgcttgaataacgcgtacgtgctgatctatgtgtcccgccgcccgctcgatccaaagctttctcttctttttatcatgccactgtttttaggggaccattaattccctaattgttcgatgagatcaattttctctttcttttgccaatgtcgtgtaatcagttggctctcaacataagcaagatttgttctcatcgatcttcaaaaaaaaaaaaaaaaaaaa

SEQ ID NO: 73791 - DNA, 569 bp, Triticum aestivum
  Clone ID: PAT_TA_73791
attcggacgaggtcgccgcttctgctcgccgccgacctatggatcccacggcgccgcagcgcggcaccaagcgccccctgcccgcgaccgccgccggggacgaagacgatgaccgctccgccctcggggaccgcaaggtgcggttccccaaggggaagaaggccaagtaccgcgaccctgctgccgctggcagcagcggggaggggggcgccgccgcggaggacatcgacgagctgatgaaccccgagctcgcggcggtgaagcgagcgcgacggcgccaccgcagggaaggggacgacgcgcagggcaccgccaacgtcaagggcttcgaaatgcgctacaaggacgacgccaactttatcgatgatggtattgagatagaaccttttaacttggagcaagagagggaagaaggatactttgatgaaaatgggaattttgtggagtttgcaagaggcaacgatatgaaggatgcctggttggataatgttgaagtagacaccaaatttgctggaaaggttcaaaagaaaaaagactaagaagaggagttccaggacctttcttctgat

SEQ ID NO: 73792 - DNA, 570 bp, Triticum aestivum
  Clone ID: PAT_TA_73792
cggcacgagcatccctgtcatgtaccagagggttccatgcgtgaagaagggtggggtgcggttcaagattgctggtcacgattattttaacctagttaacgtgttcaacgtcgcagctgacggctcgatcaaatccatggatgtcaagagctctgactcagacacatgggcgccaatgactcgtaactggggcgcgaactggcaatctctagctaatcttaccgggaagatgctctcattcagattgaccagcacggatgggcggacgcttgtgtttaacaatattgtgccggctggatggacatttgggcaaacatttgcgagcaaattacagttttaattgaacactctcgacagaacaatctagtaatggttgttttttttctaaatttatttatttctggtgtggtgcttaaaaatactctatattaatttaagcactacttgtatggatacatccattggttggtcaccacacgtaacattgtaactccaacatccttgtatgtagtatgtgtttaacttgttgtactcatagttgtgcttatattaatttggctggtgcatata

SEQ ID NO: 73793 - DNA, 686 bp, Triticum aestivum
  Clone ID: PAT_TA_73793
ttcggcacgagcaggcagagatggccgggaagggattcaaagccggtgctgaggtataccatgcttttatccgcgcttatgagaaggatgaggaccacgagatggttgagaggttgaggaaggaaatggcagcgattggcattgaggatggaagtgacctggattgtatacaatgatgcgtttttcaagcctcgtatgttgctgttcagcacactggtttgttaagatctgtggtacatgtaggcaaagagttaattggccagctcccttcattatttgatttgagttccgccctaagagagttggcaagtgctgcattcatgctcaaggaagatccctgagacaatgcaaggtacccgttcctgaatcctgagcgcatcacctaactgatctctcatgatcaggactttgacagaactggatatgacaagtgtgagagtgagtgttatatacatgcatcggaaagctggcaattgcaaaggacgaactcaccaagagcggaagaagcaagacagtagtgagaggcagtatgttcatcaccgtggtcagtgttctgtcggtcagcaaaaccacgcagcaggccagagaagccaggcgctttggtgtgatgtgtgtaaagctatcctggcactctttacctttaaaacgaatttgcttctgtcattcaaatgattccatggaaattt

SEQ ID NO: 73794 - DNA, 596 bp, Triticum aestivum
  Clone ID: PAT_TA_73794
attcggcacgagaaaatccgtgctgcgaaggaaaaggaaaaagagcttaaagaaagactaaagaatgagatggataaatcaatgtttctgagaaaaggagaagaaattaagagtctcatttctcaaattaaggagttaaatgaagacaaggaggcagcagtagatgatgagaagctcggagatctacttaggacaaagcctgtcaggaaagacaaaggggttgcatactggaagtttgatggttattacaagaagacctcaataatgcgccaagagtttgacacaacagggaacaatgacaagtggtttgtgttcactgaggaagaagaaaaagtaattggagatcatttggccccaaggtcccaacttcagtgcaagagtcatacccaggcatgatgacctactgatcttgaacttttgtttcagtggtttgaagggtgaggtggtggtatgctagcgtcctggcgttgcgtgtgatccaagttgcgggctgacaactttttgcggtagggaaattacgcaatggcagaagaagcaacaactacctgaagatgcagtcacaacattcgaatcctagggttatgttttgtccagat

SEQ ID NO: 73795 - DNA, 644 bp, Triticum aestivum
  Clone ID: PAT_TA_73795
cggcacgagattgacggctagctcagatgaactcacaccaatgactattgaaccactgatagctgttccagtgggagttgatattatggagaatggattgcccgaatatggcacacaatattctgatgacaccacacaaaattcaatgcataaagttgcgaagcttgagaatcaaagttctccccagaacaataaccatcataccgaattggtcctggtgagacccacacccaaatttcgtggtggcaaagctaaacgtggtctgcgcaagcaattgaatgttgcagatatttgtgaccggttagcatcagctgcggcacgccaggagatattgttctgtgaggaagtgaagaagcaggcgactgccgaaatcgatgccctgtacgacgagataaggccagcgattgaagaacatgagagggacagccaagacaatgtatcaacaagccttgcagagcagtggatcgaggccagctgctgcaagtacaaagctgagtttgatctatctgctgcgattatcaagaacttggcttcgacgcctctgagagcaaaagaagatgtgaaccctagagaacaaaatggagtgttatacctgcaaaacggtccatgattcagctagaaggcacgggttcgcaagcaatctt

SEQ ID NO: 73796 - DNA, 178 bp, Triticum aestivum
  Clone ID: PAT_TA_73796
gcacgaggcggcgagttaattcacgagcgcggcgaaggcctggtgaaggatctcgcagcagttcgacggggcgagggcggcgcgcacgtgccgtagaaggaggagatggtagccggtgacggggagggggctggaagctggtggttcagcgcgaggcggcgacgaccccccccccccc

SEQ ID NO: 73797 - DNA, 464 bp, Triticum aestivum
  Clone ID: PAT_TA_73797
cacgagccatcgtgatgaggcggctgatgttctcgagcgtgagcaagggggatggcagactgtctcgaaggggcgctgctcgccgcctcctgcagcttttggtcgcccttccatcaatgtgcggcgttcccctccgacgtggctgagagacaggtgtttccggtgtctccgtcgaggtcatcgcgcatactcctgcagggatccaatccgatgcactgactgccttcgatctggacatatcgctcgcttctgtcgtgctaagaagcctgtccaccaagcttcgccgctccaatgtcatgctccatcggctgcttccaccggtgatgtctccatgatagatgtgcagatcccgtctatctcggctgagcatgtcgggttggtggaggagaccaagatgcttcgcactgagcttcacgactgccttgcgcgtgccggcagtgttttggggagggcggaggctgctc

SEQ ID NO: 73798 - DNA, 350 bp, Triticum aestivum
  unsure (1)..(350): unsure at all n locations
  Clone ID: PAT_TA_73798
attcggcacgaggtgagtcgtgacatccatccatggctgttgtagaagaagattagttaaatccaggagaaaaacaaagttcggagtaagctcgtgaatcctcttgtgtagaagaaattagttagatccaagagcaaaaaggagagggaaaagaacgaacaaagttcagagttgctcttggcatctgaagatcagatgtttgcatgacgacccaagttgtcaagagagcattttcatcaccactttgtggggttttggggtgagagaggctcgaactctcgacctcaggatcactcacgtttagctatgagacttacgcgctagccaactgcgccaccaccccnaaaaaa

SEQ ID NO: 73799 - DNA, 546 bp, Triticum aestivum
  unsure (1)..(546): unsure at all n locations
  Clone ID: PAT_TA_73799
attcggcacgaggcggcgtggattcgagcctggagatggcggggacgcctcccatgcggcggcgcgcgacgcccgcgggggcctcgccgaggaacgcgaggcgggcgaggcggaggctggagaaggaggccgagccggaggaggaagccattaggaaggcgcgcaggaggaggtcctccagggtggcctccaaggtcgcggccgcggtggctgtggaaaggcggtggcggcggcngccnccnccccanggaaggaggacgacatgagtttggccttggttcctgctcctgccgatgccactcatgtcacagaaactgacgctctggagcagtccggatgggaaagtctctgggaaagggtcgtcgagctagtggtgtggaaggacgtggcgaaatcagcactctggttcgggctgggatccatgttcttcttatctttctccttttcaagagagatcactttcagcccaatttctgtattttgtcagctgggcgttatcattttgggtctagccttctttaaggattctgtgccacagaggcagcc

SEQ ID NO: 73800 - DNA, 409 bp, Triticum aestivum
  Clone ID: PAT_TA_73800
attcggcacgaggtgcactccgtcctcttctccatggcgacgccccggcgtagcaccactccggcgctggtcgggactggagacggcggcgcaaccacgccggctggagccacctcggccgtgctggcgtgccgcggctttgcgtgcgtgcgccgccgccgccgccgccgcgtgctggccgccgtcgccgcgagcgtgcgtgcagccacgcccggcttgctggccggctggcttgcgtgcgcagccgcagccgccgccgtcgccacgtgctggcgtgccgcggccttgcgtgcgtgcgcagcagccgtcgcagccgcgtgctggcaggctggccgccgtcgccacgagcgtgctggccggctggcttgcgtgcgtgcgcagccaccgccgccgccgcgtgctggcgtgt

SEQ ID NO: 73801 - DNA, 347 bp, Triticum aestivum
  Clone ID: PAT_TA_73801
aagtctcattcagatgcaagctgtcaggaggagccatgttcaggtatacgttgtcagccacatgaagtattatggtttagttctggacccgttctaaggttattcagagatgtggttttccctcaagtttctggttgtgaggtgatttccatggaagtgtattttagttgtctatcgggtgcacaactgccgtcttggcgtccactggatcgtgcaacatccgatgctaaacagtccaacccagcaggtcgcagccaagcagtggtacatgaatcatcttgccttcaaactagtcgtacacatgtaggttatcttacctgtttggggctagcaacattacatatgga

SEQ ID NO: 73802 - DNA, 737 bp, Triticum aestivum
  Clone ID: PAT_TA_73802
cacgagcagctcatcccgtcttcacgctccctaccctacgacgccagaggaggcgacatgtcatggctgcagtacgcggcgacccggaggcagcgcgccgccacggcctgcctcttcctcaccggcgccgcgctcatcgccgcggccgcgcgcctctcctacgccaacatcgagccccagcgcgccaaggccgcccagcgccgcaaggtcctcgaggacttcatcgcccgcaagcgcgcagccgtggccggacccggagccggagcagactcccacccccagccagatctccccaaaacctagccatacatcggtggcgccacggcaccacccggatcgcgcgcttcgagctttttcgaatcacaagaggcgttcgtccactatcggagcaaaggggatcggtttatttgtgtgcttctttgcacattggaatttctttagcaaaggggacgactgagatgagatggccaccggtgttatctcctctgtatgaattgtggtgctaatttgcttagctgtaatttttcaactgattccttgtcgcagtttagtaatgctgccgagtgctgtatcatgacttagttattttttcctagctaaatggcagtgatacattcatactattaccagggtgctgtgccttgttcagttgccaatcgcatatcttgcatacatttctgaagattttttaaagactagatctgcaactctaaaaaaaaaaaaaaaaaaaaaaaaaa

SEQ ID NO: 73803 - DNA, 247 bp, Triticum aestivum
  Clone ID: PAT_TA_73803
tcggcacgaggcaagacagcagcattctgaagaagcaaagcatccgatccaacctcctccctgcgtcccatggatgagtaagtcttctgtacctggcgcactctcggattcacctcctcgaatccgaacaagatgttcttgcattggttgcaccgaccaagaactccattttttttggaagggaagcgcctgaagatgctgttttccttttgcttctgattgccccagatctgacgagcgcggcaac

SEQ ID NO: 73804 - DNA, 150 bp, Triticum aestivum
  Clone ID: PAT_TA_73804
gagaaactcttttgcccacttttaatgtattctactgtattctaagatgtaataggtttgtaatggaaaaccttgtgaaacacctggctgaactagtcatgaattatttgatttatatagctcacgtcaaaaaaaaaaaaaaaaaaaaaa

SEQ ID NO: 73805 - DNA, 255 bp, Triticum aestivum
  Clone ID: PAT_TA_73805
cggcacgagggacttcgaggaggggccgtacatgaccccggggtcgccgtcgggggtgctggtgccgcccatggacgaggacgccacgtcgccgctgccggggtggacgatcatgtcccactccaaggtggtcaagtacatcgacgcggggcacttccgggtgccgcacggctcccgcgccgtggagctggtggccggcgtggaggtggcgctggtccaggaggtggccaccgtgcccggcaggtcctacaggct

SEQ ID NO: 73806 - DNA, 463 bp, Triticum aestivum
  Clone ID: PAT_TA_73806
cggcacgagccgcaatccaccaccatcaaatctctctgcccctttccagctcttcttcaaaagcgccgtcgtcagcaatggaggcctcaggcgctgcagcgaaggggaagaagggcgcggccgggcgcaaggccggcggccccaggaagaagtcggtgacgcggtccgtcaaggccgggctccagttccccgtcggccgcatcgggcgctacctcaagaagggccgctacgcccagcgcgtcggcaccggcgcccccgtatacctcgccgccgtcctcgagtacctcgccgccgagcttctggagctcgccgggaacgccgccaaggacaacaagaagagccgcatcatcccgcgccacctgctgctcgccgtccggaacgacgaggagctcggaaagctgctggccggcgtcaccatcgcgcacggcggcgtgatccccaagatcaacccggtgctgctccc

SEQ ID NO: 73807 - DNA, 753 bp, Triticum aestivum
  Clone ID: PAT_TA_73807
cggcacgagagactccctcctcctcaatgtctgcccaacccactttatagaggttcctccatcaaaaaccatatctaatattggtggtttgcatcgtatgctgggtctgcctgatcatatcctcgtagccgcggctggtgagtctaccgagtgtttaccatcaagtgacgccaccaataaatttggtgcatcttttgaaacacctgcgggtcgtaaactggtcaaaccatcagactatatggagttgatttcctgcttgcaacctaatttgtgggcaagcttggcagatgaggttccagcctgggttaatgagaaacggaacaaaacatctgttgagcgaacactacgctggcttgacgcatgtattgctttggatgcggcttctgggagaaactctttaggtgtagttgttggggggtctagtatagaacaacgaaaactgtgtgccactgaagtatcgaagaggaatgtatcaggcttttggattggagggtttggccttggagagagtgtggaagaacgttgcagtttactcaatgcagtaacagattgtttgccattggggaaacctcgtattgtctctaggcttgggcttccagaggaggtcttggagggtgtagtcgatggctgtacctgcttcacgtgccagaatcacacccgtgcttacctcaatcatctgatcaatgtccacgagatgctggctcagattctactggagatacataacacgcatcactatctccggttcttccg

SEQ ID NO: 73808 - DNA, 639 bp, Triticum aestivum
  Clone ID: PAT_TA_73808
attcggcacgagccgaagcccgcaccacccctgctcgatccccacatcctacacgacgccgccggcggttggagggcggcggccacgggcacggccgggcggccttggcgcgtgcaagagggcgcgtggccgggcggaggccgggccgcagggctcgacgcagcggccgggatcggggcgcggcgcagcgcgggttggagggcggagaggccgtggccagggccgcagcgcggccgggcggacgagcgcggggcggggagtccgtggccaggggcacatcgcggccgggcggacgagcgcggggcgcggaggctgtgtcctggggcgcagcggcctggcggacgagtccgcgccgcgtcgcggttgggggccgtcctcgcgggcgccaaggccgaaggacgccgctgcgttcgcgccagacggcgtcgcctcgccatggaggttcgatccaacggcttggttgcaggctgggtggtccggaagacaactgcgctttccggttcatacgtcgggctggctaccggcaagcgacgacaaaggctgtcccttacaggggaaaaaggaattcatggccacagcgcgctgcaggaacgccggtcctgagggccgcaccgacgaactctcgagcgagcgatgctg

SEQ ID NO: 73809 - DNA, 586 bp, Triticum aestivum
  Clone ID: PAT_TA_73809
ggcacgagattttcttactttttctgccaaaaaaaaaatttttttacttttgcatcctctttctcctctttcgtatctgcttgtaccaccatggatctgcagagcagcgagctcgcttctttcaacatgaaaagaggtgaagacaccaaggaggcagaggagcccgtaatggtgataggggcagctgccgaacagacttcaactgtggcgcctccggatccatccgcaatgacatccgtctccatcttcctggatcagagtgaaataggtggaaacaacgatgccagactgttcctcagctactgtctatggcacaaggttgcataggcctctcacactctctcccagactgttcctctgacaaccggtgcatgccactcttttctcttcctttttctttctctatcgacccgtgcatgcaattctctctctcttaattttgtaaaaaaaactttgaacaacggcactctctctctttaaaacttgcatgcagcagactctctctttacctgagctctggcaaacccacttgactacagtactgcatgcaagcggcagcgagaggactggtgtcactagccttttc

SEQ ID NO: 73810 - DNA, 725 bp, Triticum aestivum
  Clone ID: PAT_TA_73810
cggcacgagcacctccagcccacctacccatctctcttctcacagcctgatccactctctcgccgtgcccacaggccaccggcggcggcgtgcccaaccacaacccgcctcctctcctcaagccgccggacgcctcctccctccccaacgccgccctccgccacctcccttccctgcgggcgcccggcaaagccaccgcccgctcccaaccttcttgcccctgggcgcatcgccgcctgcgcccagcctcctgaccctcgaccgcgtcgccacctgcggccagtctcctggcctccggccgccgcctgcgttcaccctcccggccacaggccacggtgcccgcgcccaacctcctggatctgagctgatgaggtcgaggagtgctggctgcccatgttcggatcccattgatatgcggccgcccatgtacaacaacgccacgcgccgatctgcaggatccgtcgattcctgccttcgctgaccacgtccagggccgcccgatgcgcagatccaagcccctcgggggcggccgccccagtgccaagccacgccccctagagagctcctcatcgtggattcccctccctggatctctctcattgtcccctgcctcgggcactactgccactctgatcccgcgggtgctgttccccctatcttcaccgtcgtggcgctcgagcacagtagagatagtggtggcgaccttctgccagctaccctcttgc

SEQ ID NO: 73811 - DNA, 742 bp, Triticum aestivum
  Clone ID: PAT_TA_73811
tcggcacgaggtcgcatcttactctgttattagctccagcaatggtttctgatgcacctgcatttaggaccaccgtcgtgctggccgccgtcttggcagtgctcgtcctagcaccgccatccttagcatgcgaggagggggctccggctccggctccggcactggctccggccccagctccggcacccgtgatgctgtgcggggattgcgagtcgcggtgtcaggcgaggtcgacgtgcgaagcctacgttgccgcggcaggatgcgggaatgagtgcgacaccagctatacgccggagtgcgagccctgcaaatccagggccatgcagtcgtgcacgaccggctgcaacagctactgcctcaccaactgccaaggcagccagtgcgacaactgcgccacatcatgcggcgggcactgcacccaagaagccgtgaacgcgtgccggagcagatgcacctactcctactaccaggtcaaatcatgcaaggaatgccagtccgatgccgccaggaggtgcatctacgcctgcaacacccaatgcaaggccaactgcgtcgtcagcggctgaataaccaaatgttgttggactcgaataatcagccggagaacgagagatcagtgtgtgtaaggggggcatgcatatggtcggtgcatctcggctggtgatctcttcttgagttggtggctagctaggcatagttgctaggaggctatcgtttctgtttttgtgctgagctaatg

SEQ ID NO: 73812 - DNA, 464 bp, Triticum aestivum
  Clone ID: PAT_TA_73812
gggctacagtaatacaacagtcaaatcgatagctagcagcaataacagtggttaccaacatataaatgaacttgtaacaaacttgcacacgacctgacaacacaatacacatatggatgaccacacagcgagtagatccaaataaaaatgtacgaccacgcaggaggttgcatatggatgaagtgatgacccattttttctcgtaccgaagcttctctatactgaagcttgtttccagaaatcatatcagtgggttattaaacacctgcaacaacatcaaaagagaaacactagaaaaagaggacgccactatacaggaactatagtggacagaccaacataaatcctcaagcaataatcgagagagttcacaatctccatggaagatgcctatgaattcaccatggaaggacctcccactcccctgcactatctccttccactccctgcacacacacacacgg

SEQ ID NO: 73813 - DNA, 505 bp, Triticum aestivum
  unsure (1)..(505): unsure at all n locations
  Clone ID: PAT_TA_73813
caacaattaaacactgttcagtcctcttctgtgttgatattttgtgtgcgagtatgcaattacagtgtaaagaaaatcaaaatctagtcatcctgggagtatgttttatgcacacatctaatctagctcccaaaacaatctaaacaaaggtgaaagcagacgccaaaaaatccagcatctacgccgatcaaaatggcctcttagagccccctngaagtccaccgtctcgatgcactccacgctgcccctgaagccgttgagcagcttgagcagctcgctggcccggtccttggtgacgccgccgcagcccacctggagcagcaggagcagcttctggaaggcgcccacacgcagcgcctcggcgcagcacgcgccggcgccggcgtccgcgccgcggcagaggcgccagagcgcggagacggcgaactccgtggccatgtcggacacgcggaacatcttcttgaccagcaccggcacgaccagcgcgtgcgcgcgcgcggactcg

SEQ ID NO: 73814 - DNA, 584 bp, Triticum aestivum
  Clone ID: PAT_TA_73814
tggcgttgcatttttacaaagttactgcttggacacgattttcaggactagcacaacaattaacatggacgtttccacgacgaataatgcctccatcgagtatatactgttcaggttcgtaaagagaggatttcctgaactatggttccgttggtagtagtacatactagccgcgccatccttcgaagtgaaaccttctgtttttgtgtgggcgactgataggccccggtgcgccggcccaaatttgggcaggttgcactggtaccgtacgatctgcaaaactggaaccgcacgatctcctacccttcctcctctgccttgttaaaaatcccgtcgcgccgccagggatgagcgacgcgcccgatctagaagctctgcccggcgtgtttcgcctgtcgccgcccttgccggccgccggcgccgccgttgccgtcgtcgtctcttttgtttctcgccggctccgtgaatgcagcagcttgtccctgtagctgcaggtccccgttacgacagtcacagctccggtggcggccgctgcatccccggcgcacggcggtcgccgggcgcaacacctcctccgacgagct

SEQ ID NO: 73815 - DNA, 607 bp, Triticum aestivum
  Clone ID: PAT_TA_73815
acaggcgattcaactttttttacaataagatgaagcgaaaagaaaagaacaagctgcacactgctagcctgcgagcactgccggactgtactgcagacggctcgccgtcgaattgcactgcaagtgtgctcgccgccaaactgcactgcaagcgcggctgccgtaggacaccactagccggtgcgttgaccagcgactccccaatctgccggtagagggagaaggagctcaacggcgagggagaagaagctctgctggcagctaccgaggagctcgatcctgatctggatcgaggtaggacagaggcaactgagcggatcagggcacaccggccctagagagtggtcgaaggggtggcgcaggagtgtggcgctccatcggccagtgccaccccgaactacaaggtgccgcccgaactgcaagagctcgccgcaccaaactgatgacctgcatgcaaacaccgaacctcacaatcggcaaagtggacgacatgcgtgtagagtgtgcaccgccggcgacatgctgcagtagtgagctagctgaacttcatggtggcaacaacggagctgcacggggggaggcgccaaaacaccaacgctggtttagg

SEQ ID NO: 73816 - DNA, 276 bp, Triticum aestivum
  Clone ID: PAT_TA_73816
aattaattgcacggtgtaagtattcatatataaattttgaactattggcggcatcgatcagttcagttcagttcagttcatatggtgtataaatgttcaactatttgaatccctccgaatttcactgcacgtttgcagagccctgggagcgagcgagagaaaggcatgcccagcttgtcgagctagctcctgcggcttctgaacgacggagcagggctggcgagctctcctcctcttcaccctccggagacggggactttggccgcctccgacgac

SEQ ID NO: 73817 - DNA, 519 bp, Triticum aestivum
  Clone ID: PAT_TA_73817
aaaatgtatgtactaataattttgaacagaaggacacgcataaactcctatcgcattaacaagtcttccagcacgcacgacagaagcccacaatgttagtatccgtaagagggacactgaaagcagtaccatttggttttccaaaaggtccatatgtcctcacatttgtgacaaaagtaagcgatgtcacaacagtatctccaccaaaagtaccgcttgttcctgaaacttccttcacgatctctaaaggggcaaaagtgatcgtgtcagtaagttcaccatcgccaccccatggaccaagagtttgcttctttccagcttgatgaatgtaggagaacacaattgagtcaattgcaacaccacttctaattgtcacactttctagatgttgaggtactgactctcggatatcaaattcttttcctccatgcccaccccatggtccaatcttggttacaaggaccggtttggggaaggtgaggcacgtagcgcggattctgagctcccagtcacggccag

SEQ ID NO: 73818 - DNA, 661 bp, Triticum aestivum
  Clone ID: PAT_TA_73818
gagaaatataattatacattacggttaacctatgcggttaaacaaaaggagcgaaatagactataattctaaaaggtctggtttaggatgcattcttgtagaatacaactctaaaatcctctcttgatgctttttagttgcttctctgatttgagcaccccgcgtttgagcctttctgctagcttctcaatgttgttaagaggttcgttcataagaggatccatgggttctttcccagacgatctgttgagcgctattacattgcatatatgatcagataatccatgcatgtatcttgtaagaacgaaccagcccatagcatttttcttgttcttatacctagccatcattagtttgttcttgatggacctggtctttggctttgttttctgcttgttatacttagctacacccagctcatgttttagagactgattttcctcatccagtctcttcatgttgctgtaattgtagtctcttactttgagtcttaaccatgcatttgatgtatccagtctcttccatggcagccgtgtcctctgacatagcatgattgatacactgcaccccagaaatagccatacgactgccatgatcttcaacatatgatgttgggcgtatggaaaaaaacagtgacgcatactctaccgccatcacatac

SEQ ID NO: 73819 - DNA, 332 bp, Triticum aestivum
  Clone ID: PAT_TA_73819
gtaacttactacaagtacagacggtacaatctctgcgaagaagcgaacacgccacatacaagcatcattaaagtcaggcatcgcaatctaaacttagatgcgcagccgcttgacccggcgcatgcatgcatgcatgcgcttcgaatcagtgttcgtctagaaggtcgtcgctttcgtcgccggaaagcggcccgggtcgagcacaccctcgcctccgagaacatcgttcctggcgggcagaagtaacccttctctggcgcgcagtgcgagtccttggggcagacgcagatcccttcaatggagcagcctttctcgacgatgttggggctccc

SEQ ID NO: 73820 - DNA, 596 bp, Triticum aestivum
  Clone ID: PAT_TA_73820
ggcaaatgaagtggcccatgatgttatactaaatcataacataggaaacagaaaatgtaatgtctagtccaacaccaagagttaaccgtatatacatacatgcatacatacatacatacatacatacattatacatacatacatacatacatacatacatacatatatatatattgataaattattttattactgcaactgccagcaaatatgggaagtgatttacacccacaagtaagagcaaaaagtaaatcacaaccattcttgcaggtaaaaggtactaaatgtgaaaaaatcttctggtcaaaaggcagaagataactcacagaagatttgcttgttgcagaagtcataggtcttagagtgttttgtctcaaagttctttcttcaatcttctgagcatcaattgatagctacaagcaaaagagtacgtgaacatgaatccagagagacaacatttatatcaatgagaacattataaacaccatgccatggttcctacctgaggtccagacgaagttctctgaggagcttgcataacagtctctgccatgcttaatgcagttccactgttcagtgctacttcaggcttttta

SEQ ID NO: 73821 - DNA, 719 bp, Triticum aestivum
  Clone ID: PAT_TA_73821
ctcctttactctcaatgcagatcttcgtaacaaagatacatgacacaaatgtcagtctgaatttgtgcacaccatacatcgatcacacaatgttacatagacaacaacactattttgcttatttatatgtccattccacacaattaagtacgatctcattaaatgtgctgcatatatctccaggcaccgatgcctcatcttcatgcctttgcgagggatacaaccaacatagctcgagaggttctggcccgctcctgtcgcaagctcccatccacatcgagactccagtgcagctctgccgccctcacaaattcatccataacctctccaaaatgctggactattatgggctcaaataaggctatcagattattcacaaacttgcttgggctgctcagagcaatgttcatttcggccgtagggtcatggacacgcatctccttgatcgaaaaggacccctcttctttgatgatctcccttacctcttcgatggaaggtccatggagcggcacatagaaggaatcaaattttgctttgtcgatcacaccctccgcgaccattacacttagaatctgagctaaaattcccgggaaaagagagaattcggaggcgattacatcagaacgcgtccctaccagggaaataacattcggcctcctgagacaactctttggctctcagctccaggaaaagcttgaaatctttcctgaattgttgtt

SEQ ID NO: 73822 - DNA, 105 bp, Triticum aestivum
  Clone ID: PAT_TA_73822
gagcgatcgagccgagcgccatggtcggaggaggctagggcggtcatggaagaagagctgtcgtccgtggccgagggggctcccgtgacggcccggcggcccgtc

SEQ ID NO: 73823 - DNA, 676 bp, Triticum aestivum
  Clone ID: PAT_TA_73823
cggcacgaggttgacttcttctcctcctcctcctcctctcacaagtcacaactcacaacccgtcaatctcatctcactgactcgcctgtccaatctccatggagaaggttgccgtggcagcggcgaagacggcgcacccgccgccgtcgccggggaagccgacgacgctgctggacgtgcacgaggtggagtggatcacgcgggagctggagcggctgctcgtcagggagaccgttggcgcgggcgcccgcgcggacgcgcgccgccgccggaagagggccgaggcgggggtttccagcagccccgaggcgcacgcgaagaagggaggcttcctggccgagctcctcgggaagcacgcggcctccatatgcggcgacggtgccgtggtcagcgggcgccggcgccgcggccggagcggcttccgggaggtcgataaggtctagattggagcgtcggtacggtgtacgtatggcaagtaggtatcgtcggcgtaagtctggtactgcaatttgtctgtcaatttctctgcgtagcgagtggggcttgtaggctggaattgccagcgaacatagtaggatttgattactactactcctgtaagaaaggttcgctcacttttatcctgcacttttcctgttattatccaacatgtaaatacgaacgtggaatttgtgtc

SEQ ID NO: 73824 - DNA, 588 bp, Triticum aestivum
  Clone ID: PAT_TA_73824
gccatttcccaccttttttgccccatgggtgcagcaaaaccactagttaattacttctaccctctcccttttttttgcatggtttgatcaaaaccactccatgttcctgggagagagtagagtgagaaaaaatgagacaagtctttttctagggctagttaccaaggggagtttgaattttacaaaaacccatttttcatttctcccctacaccaatattgcccttttcaccctgttttttttcgacgagaggccggaccgagttttttcaaacccaaacacctacctttgccggcctctcaaatcctaccatactgttcccagaaggcttcaaatatctgtggacaaaaatggcatcttttttttcagcaccgaggggggacttttgcaagcctttgattcagaagtgcagtagtagggtgtgcctgtttttcagggccagtgcaagctggttggttggcccagcagcttggatgaaccctttgcttttagtttctttatggtttttgttgtaacaggatcaagattgtagctcgatctgtactctcttgtttgcttgcatacaagtataaagaataaataaatatg

SEQ ID NO: 73825 - DNA, 367 bp, Triticum aestivum
  Clone ID: PAT_TA_73825
atcggcacgagggtttgcacttggccgcttctcagctcaccatcctctccgtcctcgcgctcctggccgtggccgcgaccgctcaggcgcccggagcggcccccgcggcagcgccccaggccccgcctcccccgccggcgaccccgcccccggcaatggcgccccctaccccggcgcctgtgtccccgccccctaccgcggcccctgcgcccgcgcccaccgtcgcccccacgccctccgccaccgcgccggcgcccgccgactccccgatgtcctcccctccggcgcccaccccggacatgtcgccctcgcccaccgccgagaccgccaccccgggcagcggggccgctggtctcagccccgcctt

SEQ ID NO: 73826 - DNA, 655 bp, Triticum aestivum
  Clone ID: PAT_TA_73826
cggcacgaggcgctcgtctcgccctctcccctgcaccactcatcgtcgccacctatggcgcccgatgtcgcccaattctggcaccatccgatggtgcccagcccacccacggcttcctctcgctatgctctttattatccaccgcatcgatttgatttaccccgtatcatgtggtcgccgacatcacttccactttctagggttttggtggtggggtggacctcatcgtctatctcctgctcgacctcgtggcggtggtgatagcacgtgtgagatgctcctccccgacaaggtcgtagctggatccccttctttccaccgcaggatccgctcctctcccacgaggccgctgccggatcccctcctctccgacagcaacgcctacaaatccgctcgtcctcgacaacagcaaccaacttcgaagtggccgatcctctccccatcgccgccgcccatgaggatccaggacgacgactaccacgacttcgctgacttgcggtccctcctcctcgacgcaattagagcttgacgtgggagattggggagcaggtgaagcattggtttggccgagttatgttctgttggcgtgctttttggttactgctacaccaagcaaatgtttccgattggtcagcgatgggagactcttccattg

SEQ ID NO: 73827 - DNA, 589 bp, Triticum aestivum
  Clone ID: PAT_TA_73827
cggcacgaggcttcctagaggagtccctggccctccccgcgcggaacgccggcctcttcgcgcccgtcgtcgcgctcaccttcgcgcacaccttcgtcttcctctccgtcgccgtcctccgcgtccaccctctcgccgctgccgtcctgctccgcctggacgcgcgggagaggaacgccgaccccggctacgccacggacgacgagatccgggagcgcggcaagatgctcgccctcctctacctcgcgtacttggccagcaagctcgccacgcaggtctcggccgtcctcgccgcctccgtcacgcactccggcgagcggtccaagtacaggacccgccgcgcccccttcttcgttgccgtggccttcgtggccactctagagctcgcgtccgcggctctgctggcgctcgcgtcttggtcctggtgggggcgcgccggccactcgggcggcgccggcgcgtcttcctcgtcggtctgcctcctcctcgctctcctcttgcacctctgcctcggcgcggtcctcccggtgagcatcgccgcgtcatcggcagtggcggcggcagaggaagactgcggcgtgggcgctct

SEQ ID NO: 73828 - DNA, 604 bp, Triticum aestivum
  unsure (1)..(604): unsure at all n locations
  Clone ID: PAT_TA_73828
gagggtttaacctcttgctgtccccctcagatcatccgcgtctgcctgcctgcctgcctcaaagtcgcacctatccattacccccggccggtagctatccgtccgtcgtcgtcgccggcccgtgcgcgcccttctgttctacccccatggccaccaccacgagctacgacaacgccgacgtccggcacagggccctaggcgtgcacgccgcgtcccgcaagatcggcaagccggcgccgtcgtcttcgcaggcgcagcagcagaaccggaagcccgtcatcatctacatggtgtcccccaaggtgatccacgtggaggcccacgagttcatgtcgctcgtgcagcggctcaccggccctgaggtcgccggggaggacgggcgggagagggcgtcgacctcgtcttcttccccgaggaccgcgacggacaggggccgggagggcggcccagcctgtgcgcgtcaaggcccgcgccctcaaccgcccngggccccgcggtgtccgtctcggtgacggccacgagacagcagcagcagaacgtgccgccgtcgtgggcggggccgtcgccgtcgccaacgacggggttcctgttccacgacctcagc

SEQ ID NO: 73829 - DNA, 697 bp, Triticum aestivum
  Clone ID: PAT_TA_73829
cggcacgaggggctgggagcatccatacctctgttcaccatccaagcaactcaagaacgtaagcacttccatcaaggagatcagtcgctgggcaagatcttcgccgggagtaaaggtgaactcaaacatccggctcttggagtctgtactttctttgatacaagtggtaacttcgacagcaccacacccagatcacatcgtcgacatgatacgggtccatgatgcgcttgctaacctgttgcttgtcctgcccaagaatatcttccctttactggtgcaaagttttgctcagattgtagatgaattaagcccgaaaggaggtgcatctttatcagcaaggttcgaaaagacactgcatgatttgcgaagaagcataaggagtggtcttcaggtactcaaagacatgatcttggactatacatctgacgtagtccctcaaggtggtggtatccatgagatcaccaaatacttgttaaaatacatcatgtcacttctggacaatggcacctctctcaagatcatacttgtcggtgatgaacaggatggcaaggttgcaatgcggacgctgcaagataatgttgctaccttgatctctcacttggaaattatgcttgagaaagaatctcatcgctatcaagatgcagggttaaaaacaatgttcatggtgaataacgtgaactttgtgctgcatcaagta

SEQ ID NO: 73830 - DNA, 564 bp, Triticum aestivum
  Clone ID: PAT_TA_73830
ctcgatgtgctgctccaactgttcacgaaaaaaccatttcaaaatcgaagtcttgagatctcttcaattgattttccaaccacctatggaaagattcgattcaacatctgggtgtcacttggagaacaacaacctgatgatcttccagaacagttttacagccaaccacattgtactattgtgatgcttcatgttactactcaaatgagctataaaaatattcctttatggcaccaaaataatgttaacgccgatccacacactccaacagtgcttgttgcaaataaactataccttgctgcacatataatagtcaaaatgaaacacatcacctaccaccgcaagagaaaccttcgtttctttgaagtttccagtattgcaaattacaattgggaaaaaccatttttggcccttcttcagactcttgtgaacgacaacgaacttgttttgacaagataacctggtgtctctcctcctgaaagagtgatgtctcttgaataaattaaaaactataataatatgtggaacttgcgaatgccccgcttcctgatgacgatgatctgt

SEQ ID NO: 73831 - DNA, 668 bp, Triticum aestivum
  unsure (1)..(668): unsure at all n locations
  Clone ID: PAT_TA_73831
cggcacgaggccgccacgcgcatacagactccacggccccgcactgttcctcgagctggagcgtgggctcgcgtagcctcgcccgttcatgagcggcggcgagtcggcggcctcgcgcgagggggattgtaggcaatgaggctgtacatcacggcggcggccgccgacgacgacgcgacgaagccgaaggcgccgcagcagctgcaggcggcgcggcgaggttaccgttccgttgtggtcacggggctcctggccggcgttctcctcttccgcgccgcgctcctcgccatcgagaccggcgcctccctctgcccttccgccaccggttgctcggactggagcgcggggctcgggcgctggctctacggcggcggcggcgacgcgacggaggaatttatgaaagagtggaagagaagccacagggtagctaccctgttggaccccgtggtggtggaagcggcaccagattccttggacgatctncatggtggagatggacaccattctggcgtcctatgatcggcttgacatggaggccgtggtggtcaagataatggccatgctgctaaagatggaccggaagctcaagtcgtcaagaatccgaactctgttcaaccggcacctggcctcgctcggcatccccaagagcatgcactgcctggcgctgc

SEQ ID NO: 73832 - DNA, 602 bp, Triticum aestivum
  Clone ID: PAT_TA_73832
cggcacgagggcaccgccccaggcgccctggcgcatcccatggccatggcgggatccccactgccggcgtgccccttcccaccagccgccctgatggccgcctcccccgtcctcttctgctccattgccaaacaccaccgcaggtacgaatgaggtcaatctgcggcgaggttcaggcaagttttccctgtaattccagcgagcagttcggctagcgcggccatgcggtttggccaggccatggcttcagttcatcggtgcgctgccgcgggtggggtcatcctctcctactccggccgagatccatggccactgagcccccttccttcgctcccacgtatgtgcaacagttgagcacccaccaaccccgatatgtgtgtcctccattgctctgtcctcgccgacatgctcgcacgaacagggagttagcttagttgtttattgccgtcctcttctgttattgccactgaacctccacgagtaggagttcagttaactccgtagttctatttttgtttaacttgtgccatgcagttcgctatgtaaaattgcagtgaattttttgtacttttatttctgctcatgttacagagatgttctaa

SEQ ID NO: 73833 - DNA, 661 bp, Triticum aestivum
  Clone ID: PAT_TA_73833
ttctccctcatcttcttcctccttttgtccgcctccatcgccgttgccgttgccgttgccgttgccgtcgatgaatccactgatgatatgttgatccggcaagtcgtcccggaggaggaggtccccgtcgatcagctgttgaacgcggagcaccacttcactctcttcaagagcaagttcggaaagaagtatgcgactgcagaggagcatgactaccgtctgtcagtctttaagtctaaccttcgccgtgccaagcgccaccaggcgctggatcccactgctgagcacggtgttaccaagttctccgatttgaccccaaaggagttccgtaacacctacctcggcttgaagaatcctctcaaatatccctccgatgcgaacaaggcgcctattctaccgacatccgatcttcctgaagactttgattggcgcgatcacggtgctgttactgccgttaaagatcagggttcatgtggatcgtgttggtcatttagtacaaccggagctttagaaggatctcactttcttcaaaccggagaattggtcgctctcagtgaacaacagcttgtggactgcgatcatgagtgtgatccagcagaaaagaattcctgtgatgcaggttgcaatggtggactaatgaccaatgcatacgagtacatac

SEQ ID NO: 73834 - DNA, 592 bp, Triticum aestivum
  unsure (1)..(592): unsure at all n locations
  Clone ID: PAT_TA_73834
cggcacgaggctcacctccatccccttcccacctcctctccatcttcctcgtctccggctccgcacctcctccccgtatcctcggccttcaccgccccctcctcttccccttcctcgtcggcgcccaatctcaggcggcagccgcagcggctgatggccggcccggccgcggctggcggcgggaagggggcagcaggaggagggattaaggttggcgggagcggggggcccgcgttcgtggggcaggtgttcaccatgctcgacccctccgggaacggcctcatggccgtcaccaaacgcttcgacctcccgcacttcatcgccgacaggactcctacatggtttaaaaggatattgtcaccattgaagaagagtgacaatgatccagtgtttaggttttttatggatctgaatgattcagtgtcgtatgttaagcggctaaatgtcccaagtggtatnggtgggggcttgtcgccttgatgtagcttatgaacatttcaaggaaaagcctcacatgttccagtttgttccaaacgagaagcaggtcaaagctgctaataagctcttaaagtcaatcccacaaaggggaaaa

SEQ ID NO: 73835 - DNA, 713 bp, Triticum aestivum
  Clone ID: PAT_TA_73835
cggcacgaggcgtcttcgtactcgcctctctccgcgcaaccgagccttcgccctcgtcctccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctctgccttgatcgtatcaggaagctttcagacaactgcactggtctgcagggattccttgtcttcaacgctgttggaggtggaactggctctggccttggttcgcttctcctggagcgtctctctgttgactatggaaagaagtccaagcttgggttcacagtttacccatctccccaggtctccacttctgttgttgagccatacaacagtgtcctgtccacccactcactccttgagcacaccgatgtctctat

SEQ ID NO: 73836 - DNA, 669 bp, Triticum aestivum
  Clone ID: PAT_TA_73836
gaggtctgctgctgtgccaaagccgcgggggcgccggcgttcccgccctttccatgggcgcacgcgccctcgccgcctgcgccgccgcgctgcgccatcacggagatcgacgagtcccgggaggtggagtcggaggacaacctctcccctcgctccgtcctcacgccctggaggaggccgacgcccgcctcggcgctgtctccgtctccgcctcttgtggtcgggggcaaacgggccttcgacccaagcagcgagaagacttctctcatgatctgcaatatccccaacggattcgtgaagcggaggttcatggcgattctggaccagcattgcgtccaggagaacgacaatcctggatggcgtgttgtgggcggcggcaagttcgtgagatcggagtatgacttcctctacatcccaatagacttcaggacgaagtacaacaaaggctatgcgttcgtcaacatgacgacggcgaccgcggcgcggcggctccacacgtttctccacggacatcgctgggccctggcgggctctcggaaggtgtgtgaggttgtgcacgcggacatccagggggtggatgctttgtcagcgcacttctcctgctccaagttcccgtgcggtaacaaggagttcctgccggtgcgcttcggcccgccacgggatggcctc

SEQ ID NO: 73837 - DNA, 688 bp, Triticum aestivum
  Clone ID: PAT_TA_73837
cggcacgaggcaccaatttataagatctcctgcccaaaaaattccaaaaccctttttttaatctttgccctaattttttttccattatccattgccatcttcctctgatctatgaacaaactctgtcacaatcaaatctacatgggcttttacagctaaggctgttctttgaaggtgacacagaaggaaggtccacatgaattaaggtggagggttcaaggtatgcacacctccatattctctcaatcccataaaaaaaaactaaacctttcttgtgtttgaggagacattagttgatctatcggcaatctttacccatacccatttcacccttttggagttccgtttaattttaatggtgtttagggtttcgtctttgttgggtactctttagtttcaagaatcttcgaggttgttggatgtgaaaaggaactggcgttgaaggtttcgtgttaatttggtgaaattttgatgaatattgtggatgatttatatgcaaagttcatgttatccgggaataattacatgaatatggtgaaaccctgttggaagccgtcggtggacggcgatgtccggaaaaccggcgatcaatccggaagaacagacggattgttgtggtacaaagatttagggtctcatgtaagcggcgaattttcgatggctgtgattcaagcaaacaatttgttag

SEQ ID NO: 73838 - DNA, 625 bp, Triticum aestivum
  Clone ID: PAT_TA_73838
cggcacgaggcagctacgcgcacgtcaccaggcaggagctgcgcgagatcgcccggggagtcctggccagcggcgcgaggttcctgtgggtgatgcggccgggcatcgtgagctccgacgacccggacccgctgcccgaggggttcgcggcggcgtccgccgggcgcgggctggtggtgccgtggtgctgccaggtggaggtgctctcccacgccgcggtgggtggattcctgacgcactgcgggtggaactccgtgctggagagcgtgtgggcgggagtgcccatgctgtgcttccctctgctcactgaccagatcaccaaccggcggctcgtcgtgcgggagtggcgcgtcggcgtgaccatcggggatcgtggcgcggtgtgcgccgacgaggtgaaggcgaggatcgagcgcgtgatgtctgggaaagagggggaggagctccgggaggcggtgaagaatgtgaggacgacgctcgaggcggccgcggcgcacggcgggtcgtcgcagcggagcttcgatgagttcgtcgacgagctaacgcggcgttgcggcggatgttaagctgcgccgactgatcggcctgaagcgccacccacccgccgttggagaacgaatgcagt

SEQ ID NO: 73839 - DNA, 751 bp, Triticum aestivum
  Clone ID: PAT_TA_73839
cggcacgaggtgcagattcatgttatagaacaggtttgtgtcccagggattacatcctcctcctccatcttcgcttgctgccacttaattatgcaagtttgcctccaatgtctgcaaatgtaagtttcaatgattgttagtgtgtttttctttggcattttcttgtaatagttattcagctcttgttttgcttacattgtcatcttgttgtgatgaaactgtcatctggtttgctcacttgaatgttcgtagatccatctcctgaatgtacctgcaagattcatcacaagtttaattttagacatctcatgaatgtccgtggtattttttgtttttgtcactttaccttgtatatattgtcggaatgaaggagcgcagtgaaataaaacgtttcttgcatcataattttgttagccttttaccctttttatgtatttttaaacatcttcccaatgttttagcaactatatctcacatttagtatgagttattcctgtgataactcagtagatcctcttcagtcactaccctcatcatgctcctgtcctgtcacaattggaaagtagaatgttagtgttaacataatcatgagtaacaaagcattttagtaatagatgcttgaatgcattctgtatgcttgaatgttaatgctagtattttgtaatgtctgcatgcttgaatgtattctgtagattgtgtttgtgcttatgctctctgctttctatgttctttctatgcctgaatgttttct

SEQ ID NO: 73840 - DNA, 604 bp, Triticum aestivum
  Clone ID: PAT_TA_73840
gccaggcgacacacgaccggcacgccaacgccaacagcctctcctgcgccgctccagatatccatctatccacacccacgcgcgccgggcatgaagttcgcgtgcttcggaggcgcggcggccgtcgctgacgaggcggtggctgcgaggactcaccggactcctcgccgccgagggaggttcttctttggtagcagcaagggcgagaagtcgccgtcgccgtcgacggggacgaagaggatcacgtcgccgggccgccgcgaaaaagacttaagtatatacgacatgatcgctgccggcgcggggaagtcgtcgtcctcgtccgtgacgtcctcgtcggcgctcagcaccgcggcgtcgctggactcggcctactcctcctcctcctcctcccgctcctgctcccggtcctcctcctcctcgtcgttgtgcttggaagtggtgccaacgccggcgaagaagcggccggaggagaggaggtcgcccgcggtcggcgtggcggcggtgctggtgtgcctcttgatgatgatgttctgcggccggctcgcggccacgctacttaccaccgcggtgctctgcttcttcccgcgaacatggccgcctg

SEQ ID NO: 73841 - DNA, 764 bp, Triticum aestivum
  Clone ID: PAT_TA_73841
attcggcacgagggctgcgtggattgattcaagcgctcagattctttatattttttagcgtcgacaagtaaataaaaaaccagcctaaccatggatgccatcaagaagaaaatgcaagcgatgaagcttgaaaaggacaacgcacaagataaagccgatacgtgcgagggtcaagccaaagatgccaatcttcgtgccgacaaagtcaatgaagaagtccgcgacttgggaaagaaattggtacaagttgagggtgacttggtgaatgctaagaatcaacttgagaccgccaaccaagacttggaagaaaaggaaaaaaccttaacagctacagaatctgaagtagccacattgaatcgtaaggttcaacagattgaagaagatttggaaaaatctgaagaacgttccggcagtgcttcgcaaaaattgttggaagccacccaatcggctgatgaaaacaatcgtatgtgcaaagtacttgaaaaccgttcacaacaggatgaagagcgtatggatcaactcaccaatcaattgaaagaagcccgtctcctcgctgaagatgctgacggtaaatccgatgaagtatctcgtaagttggccttcgttgaagatgaattggaagtagctgaagatcgtgtcaaatccggtgaagccaagatcatggaacttgaagaagaattgaaagtcgtaggaaactccctcaaatctctagaagtatcggaaagaaaggccaaccaaagagtagaagaattcaaacgtgaaat

SEQ ID NO: 73842 - DNA, 724 bp, Triticum aestivum
  Clone ID: PAT_TA_73842
ttcggcacgaggaaaatcaggaaaggggagaggaaaccaagcaggcgaatttagggctttctcctcggatttcctgcgatctcgccgccgattcgcccaatccaatgccgcgcgcgtccggctccgtggcccgcccggcggccgccgccaccagcgcgagcagcgatgccggccactctgagccatcatgcagcacacctgcctatcagaaggtgtttcgccctgttactcggtctatgacccgtatacctcctgcggttgctgctacacctgatgcgaagaaaagagtcgatagcacaagcagcaatagaagtactccagatgcttgctttagtattcagttagctgcagcacggcccactgcaacccgtgctcgaacccctcaggaagtgactaaatctgcttggagacctcttactcagcctgctgttctgagtgaagacctgaagcgagcaagtactcctgcaaccaaccctactgccaagcggtccagagttactaactcacaggctgctaaagattcagcttctaaagttaatcaaaatgttcgcagtggtaaaaagaacagaaacgaagaatgcgctagtcagggtgatcaatcagatggtgctgtcatcccatctccaccaaagaagctgcagagtggcaagggctcttctaatctagtttcaaaaaggaaaagcactatcagaagcaagggtgctaaattagctgctccgctgct

SEQ ID NO: 73843 - DNA, 649 bp, Triticum aestivum
  Clone ID: PAT_TA_73843
cggcacgagggtcgtacttaattaatttgtgcatgaagtattctagtttgcaaaaattaatgttgcttcttactgttatgtatatgcgtgtagtagttcaagcttgcatacactaactaagatcacaagaaagatagacatacttctattttgcaataaagatgttaaatatgaaatttttggaggatatgtgctaggattttatagttaagcagtgttttctgtttcatgctgatacctttttggctcccctagattgagcatatctaaaatgcaatctgtacaagatgaaccaatgaaaaaaaaaggaacttcaaactctagcttgtaccttaataaccttgcattgcttagatacactactagagtggtcgtcacctcctattcatttgttctgatttggcttgtacattaataaccctgaagtaatttttaagccatgcatagattaatttgtagttctcgtgcaagctgttaggtttcctagacatgcacaagccttgttcctaccgttgtcacccagtaaacatatatactggttcagtttatttcatttcattattttttcctattatagataatactactatgtttgtaaagtgggcagcaatttgcagcataaccattaaatcttatggcgctactcgtt

SEQ ID NO: 73844 - DNA, 721 bp, Triticum aestivum
  Clone ID: PAT_TA_73844
gtgccgtatgacttactatgccccaaagcttggtctatgatctaaccagttttctgagggttttattatagatgtgaggcctctataatgcactttgtttggaattctccagttgagagcatattgttgctacagagtacgttggcatctctagcttttggaggtttttgatgaacttctcgttgtgactcattatttgtgttttgatcttgttgtacccaatgatgaaactcatgcattgcaagtgccgtatgacattactaggcttcaaggcttggtctatgatctaatcagttttctgagggtttattgtgtgtttgtgagacatttgtaatgtactctgcttggaattgtctacttgagaaaatcatttgctgttacagagttgatttccatttctaatgcagatttggattttaaatcccaaccaattcctagcatgtttttgaaagaatatagcggaggcttctaaaaatagttctggttggtttatgctccaatgaggaaacttatgcattgcaagtgccatatgacattactagacctcaaggcttggtctatgatctatccagctttctgagggttttattttctagatgcaagacctctttactgcttttcgcatggaattttctacttgaaagcatcatctgtttctacacaattgttttccaccttgacatttttagttttaaatcttaactgcttcctaataattaaa

SEQ ID NO: 73845 - DNA, 507 bp, Triticum aestivum
  Clone ID: PAT_TA_73845
cggcacgaggcacacgtcaatgcggccgagctccacggcccagagcggcgccaccgccgcaactcagcccgcgccgcagttcttcgtggtgggcagctgcatctgggttccccagcagatgcaaccaatgttgctcccggaagcgcgaaccaagtatacgctcggacggcgacgctaccatcagggttgaagccacacttagaaaagcagtcgagtaggcagtcggaaggcccgaggagcggcgacacgggcggcgttaactcggacacggacaacccagctatgtcgtcgtcgtcgtcgcaaaccacatctgcagggcatccttagtgaataaccttgggagttgggatgatctacttacatagctcggagaaatacagagtctataaggtcacattttacagtaaggtacgccacattatttgttgatgcagagaagagagaatactgcttttatgccttgtgggcagcccaagcttaaggtgacccatatagcttgagttttgc

SEQ ID NO: 73846 - DNA, 717 bp, Triticum aestivum
  Clone ID: PAT_TA_73846
cggcacgagggtcgttccggccagggcactcctctcgagccatcgaggaaaggtctcgagcgtagcctcgccttcaagcgttgggctcgagggaggtgctttcgttgcctcgcgcgtggccatcaagtcaatgcatgtcgtgagcctttcagatgcattcgctgtcgtcgctctggacatcgggagaggttctgtcgtgcttcctctccggtcgcttgcaatcgctcttcggtcactcgtgctcctctccagcggagccgctcctcgtccgtccagccttgtccttcgctgaccaggagttgggctgaggttgtgggccacacgtcgtcgtgtgtgtcggtgccgccaaggtcccaatatgggtgttgcaaggattccaatgtcaacgcctctttggtctctgctttggagtcgcagcttgccctgctgcgcacggagctccttcaggaggttgagctgctccgtgctgagcttcgcgacgctctagccaagcttgaggttgcgtcagttgtgcctttgctacctgagctccaggttggttccattgttgaggatgcagaaggtttctttggagatttttctccttgtgctttgcatgtgacgccgcttgttcgtgggagcgcggttatcactgaggtcgtagctccggttctgcagattatgccagagttgcacgagctttgtggggaatcatctatagtgttaccattggagctg

SEQ ID NO: 73847 - DNA, 614 bp, Triticum aestivum
  Clone ID: PAT_TA_73847
attcggcacgagggaggctgtcaggacggagcccgcggctccggccagcgaagggaaggcagatggcgaggagtgggtcactgtattcggattctcgcttagagataccaacctcgttctccgagagttcgaaaaatgtggtgttatatgtgagacatcactctggcccaagagagggtaattggatccacatattataccagcactcttacgatgcaaggaaagcccttcaaaagaatggtatccaactatgcagtggcgtcataattggagtaaagcatattgatccagtgcaccggcagcagctggatgataggctcgctggaatcaaccaaggaggcttcatggtctcccttccttcgaaatcacttgtcctgaagagcaacacaggagcatcaaaccagttgggagccttgccgcgcccgtatgatccgaagtcttccacaaacgttatcagagacgcagggcgtcgtacaacaggcagtgtcgccgcgccagcgaaatctattgtaaccaatgtgatggacttgatattcggcatctagttcgccagcctgtggaccaatgatatacctccagcctagcatgtctcatctgttgtgtgatctgtcacg

SEQ ID NO: 73848 - DNA, 591 bp, Triticum aestivum
  Clone ID: PAT_TA_73848
cggcacgaggaagcgcgctatggttttggcctcccgtcagcgccgccgcaggtccgtctcctctccggtggccctagtgccatgggagcgcggtgaatctcggcaagggccagcgagagggctccgtttttagttttttcttgttagggtttttgtcctactcaggaagagagacggcggcggcttcctgaagatgaaataaaggtcttcccgcctagcccccgttccggcggtgcgtctagcgtcgatggtgggcgtgtgaaggtgtgtttccgacggatctatctttggtggatttgctcggatctcgtcatctggttggatcctgctgatttacgttattcttcatctgcggcggttgctgttctggtgggctggttctacggggcctttgcacgacgacttcccgactgtctactacaacaagttgtgcccggctccggcgatggaggggcgatgacggcggcgtgccttcggcttgcttcactgattgtagtcgttgctaggtggtctacggatttagatgtaatgtttattatttctggtattcggtgtactgttatgattgattgaagctgaatagatcgaaaa

SEQ ID NO: 73849 - DNA, 673 bp, Triticum aestivum
  Clone ID: PAT_TA_73849
cggcacgaggcaacaagcaagcatagctttgttccttgaagaagatgaaccgcatgaggaggatcgcggggatgggcaagagcaagaaggccccgtccgcggttcagaaggacaaggacgagagcatagttttcttccgggagctgtacaagcatgaggaagatacggatgtgaacctcctggagccgatctactccgtggagttcgacgccatccaaggtggtcatatgtccaagcctccctcggggaagagagatctcctcatgccgatcatcgagaagcacgactatgactggcccaagacccctccggttgcaccaatgtttccttccctcaagatggaagccagctcctccgaaacggtggttgcccctaaggtgacacacatcccgatcacgcaacctgtcaaaccttcagcttcaaggttcattggcaagactgaggcgaccaaaacatcagccaagactccggcaggttcttcgtcaagcaactctgccaagagccagccttgcacgaccgacaggagaccagcttcagcttacgctactctgcccaacaggcagcagaaaccagatgccaaagccaatactggcacaagcagcaactcaggcaaggaacactcgcacacgtactacgcaaatgcaagccaggacagcagcagcagcagtgcaag

SEQ ID NO: 73850 - DNA, 667 bp, Triticum aestivum
  Clone ID: PAT_TA_73850
atttcccactcttgcaatatcaacagtgcagcattgatctgcactgctgacctgcacttgacggttgctccacacagtgacaatttatacagaagaaactgccggtgtcaaatgcgagcgaagtgcgctaattgcgagcggatactccagttttactgtccgcacaaacaagtttgcacagtagcaccattatacttgctcgaaacaaaagttctgtcggtgaccgaggaaagcgaattaacgtggatcttgaagaatacagccgaagaacgagaagccttgtgcaactataaggcaaaagaagaacagcagcaagcagagcaagaagaagacgagcaagaagaagacgagcaagaagaagccagcagcgacagcagcagtgactccgattttctaaaggaggaagaggaagagaactttttagagaatgtacccagtcttgagttaccggacaatttcgcgacaaaagatacgaaggaggaacaaaaagaggaagagtattttttggagcagcaacacttgtcagataccgaaagcagtgatgatttttatccgaatccagactggaacattgaagaaaagccttcccggcagaacaagcggtcgcggcgagcgtaatggtgctatcctgtaaaatttttttaaaaataaaattttttgaatgaaa

SEQ ID NO: 73851 - DNA, 350 bp, Triticum aestivum
  Clone ID: PAT_TA_73851
cggcacgaggctcgtttctgtgacatctatttgatccctgtttctttggtgttcacctgcaacagcagtacgtggtctgttgtagcttgtacctctctttaggacaatcggatatcattctacagtactctgcaaggagaacctagatgtctactttatcatttggttagtagtgggtggatggattatcgagagaatgtaacttacatttgaaaaaatatagatgtatgattcgtatgattcatccctgctgaatggttttaaacccttataacggtcaggtctgatacattgtgtaatactactacaaattcccaaaaaaaaaaaaaaaaaaaaaaaaaaaaaaaaaa

SEQ ID NO: 73852 - DNA, 565 bp, Triticum aestivum
  Clone ID: PAT_TA_73852
cggcacgaggatggtctcagagggtgtgattggcaaagaaaagtttgattccttttatgggctattgtatgaaccttcaagcgaagagctgagggagatcatccaagaaggggcctccttttcaatcagggagatgcgggcgcatgaccctagaaccgatatgaacaatgctctcagcaccccaggcaggttcgcgggatttctgagagctttatttgagccggtattggtccaacattttggagatgccatggatgaatttgtgaggactgcggagcggcggtggatcctagagggaagcttgcaagaggagcgtgttagatgtccttatgctatgctggttgtatccctcacaaaggcatgattatcaggtccctaaaggtacatcacatttgatgatagtgaacagatgctttatttgaggccaattgtgtgcccactgattatgtaaactaaaacccatggcctgctttgaaggtaatcaacactctgatgtatagtatatgcacatgtttaagggaaccattttttttaaaaaaaaaaaaaaaaaaaaaaaaaaaaaaaa

SEQ ID NO: 73853 - DNA, 620 bp, Triticum aestivum
  Clone ID: PAT_TA_73853
cggcacgaggccagcttcccttgggaggctgagcaccagcagcctcctcccatggcgaccatcacctgccacctcccccctctcctccctggcccagcctccgggcaccatcgccacctcaagccctccccgccccccttcaatcggcacctccgcgccccgcctccgacccgtctcctccgcgccgcccgccgccgccatcccgacgccgtcgtcgtcgtcccagacgcgcgcccctgggtcggcgacctgtcaggagccgcctcctactgggacgggagggaggaagatggggacgaggaggaggacgcggacgacgacgaccgcagcctggacctcctggcccggttcctgcactcggtgttcaggaaggcctcccgccgcgcgcgccgcgccgccaggtccgtgctgccgccctccgtccccgctgagctggtccgtttcgctgcttgctttatcagcctgagtttatcatgcttgttcgggatcagcggcatggagatctccgccggatttgtgcgtgatctggtgtgttcccgtgtttatgcgcgtgcaggtgaagttctcggtcaatggcgtgctggttctcaccttcttgtggatcctcaaggggcttcttg

SEQ ID NO: 73854 - DNA, 726 bp, Triticum aestivum
  Clone ID: PAT_TA_73854
cggcacgaggctcaggtccagcctgatttgagcttcctggacactggacagccacaaggcatgccttggccgccattgagcagaatgccgctggtggccagtggcgacagagtgccgtctcagcggacaagggagtatcaagcgatacatcatcatcatcaagcgagcatgggagttcttcctgcaagcaagtatctcattatccttaccttcatctggaccacacttgcatttttaaatctctggagagtcaacgtcgaccccggcgctggtgcaggaggtgtccatgggcaatgtcctcagcgcaaagctcggctaggccccggccaggcaggcctctctccgcgtcgcctgcccaacaccgtaccctgcaccactgtcaacaaagtctgctcgtcggggacgaagggtatccatatttcatctcttcacctgcaatgtctccatagttacttgtcgccgctgctaaaaaacttatgttgttgcctgttggcctgctccttgctatctgaagtatatattttttgtctatcgctcattcgctatctgaagaattttatgaaggtaattttagtgtgtgtttagctttcagtttttgcttctacttcacagagtggaagatcataagaaaacattggatgatctttaacaattattcttagaagtaaacctgagcagtatttgatgatatattgtgagtcaccaaaaatgtataccgttttttct

SEQ ID NO: 73855 - DNA, 691 bp, Triticum aestivum
  Clone ID: PAT_TA_73855
gaggccttgacggcgtcggtgaagcagtcgacgcagattttgaagtcacactcacaggggaggatgtcctccccacggccgttgcgcatgatcttgctgtcgcacccctcgaccatgcagatggagcccttggggccagatcgaccaatgtcggagtcagggccctgcttgtccatgacatgggcacgggtgacgctgttgaagccgccggtgaagagcgagctggagacgtactgctcgtcggccttggtgccgtcctcctccatgggctggttgtcgggcgtcatggggatgtggacatggtagtcctggaagtcgacgctgctgatctctgagtcgaggtcgtcgcgcgagtagctgatgaagcgcccagactcagttcgccggccgaagaccacctgcggcgccgatgttggtgccgtgggtggcttgctggggccgtgcggcggcatgcggctggagccgctgttcttgaggattcccttggaccccatggcctcctctagggcccaagtcttgcagtgaaaactgagtcaacccccccaacacacggtggatagcttcgcgcaacaaacgtccaggctcgtggtcaaagcatcaaccaaatgcatcgtgctcgctactccgactcctcactgacatcatacaccctgcaatccaaccgccaaattccgatcatggacaaatatgt

SEQ ID NO: 73856 - DNA, 757 bp, Triticum aestivum
  Clone ID: PAT_TA_73856
cggcacgagggtaaatagtaaaatttcgtgaatttttattcatgattttccgctgcgtaaataattaatagtgctcttttacaaagaaaataaaagtttaaaaagaattaagtttttaagagcatgttaaagtgaatattttaatgaatatgattatgttatttgtatgaccaacgttgttaataacatgatcttgaatagaatattgtaaagtttccgctgcaaagtaaaaagttttatcctccaattaaattggagccaacgggaaaatttaattgaaagaaatgctcttagcaatgtttttcctctgtgggtgaaataagatgcagatagtattcgctatgacaaaagaaagatatttgttttaaatatggtattgttattttctgaccaacgttgatgataacagtgttataattctatgagtcttatgttcaaagtttaaatctctgataaattttgtatcaaggtgaccaattttcagagaatgaataaagatcaagaaatgctcttgaactagagaaatttatatttcttgttcccgctacaataaagttgatgatgatgattaattcttagcaaagttgtttaatacaaatactatcatcacattgtttatgagttatatgcattatttccatttccgcccaacggtgatatggaattaatgtaaaaggatgatgtttattctaattctgccacaaccgtgatttagaatataaaagaaagtttcaaaagtttaatgtgcatttctttt

SEQ ID NO: 73857 - DNA, 639 bp, Triticum aestivum
  Clone ID: PAT_TA_73857
cggcccgaggagctgctccacacctccccggccgtgacttctcgccgatccacatggatacggcctgcggcagcaagccgccgcagtcgaagaaggtgtgcatcatcggagccggcatggccgggctggccgcggcgcgcgagctgcgccgtgagggccacgacgtgacggtgctggagcagagcggcgacgtcggcgggcagtggctgtacgacccgaggaccgacgccgatgacgcgctcggcgtggcggcgccggtgaaggtgcacagcagcatctacgcctcgctccggctcatcagcccccggcagaccacgggcttcaccgacttccccttctgccccaagagcggccgcgacgaccgccgcttcccgggccaccgcgaggtgcacctgtacctcaaggacttctgcgacgcgttcgggctcatggaggccgtgaggctcaacaccagggtcctccatgccgccatgacgccggcgtgtaagtgggctgtgagatccatggacctcgggatcggggagtgcgatggtgccgacgggaaggagttggacgcgtacgtggacgaggtgttcgacgccgttgtcgtcgccagcggccactactcgcagccaagattgccaagcatcaaaggcatgg

SEQ ID NO: 73858 - DNA, 665 bp, Triticum aestivum
  Clone ID: PAT_TA_73858
ccgtccccgccattctcacgtctttctcctcctcctcctcctcccttttcaccacgtcaaggttcgtcaggcaatcaccggcagagaccttcctccgccggagcagcgcatggcgtcgccgcgcgctgggcaccgccagctcatgggcgcgtcgtcgtccccggcgccgtcgggcgacggcgaggcgactgcggggcgcgggtcgagccaggaggcgatgaagataatggtatccgtgctggtggtggtcatcttctgcacgctcttctactgcatctactgctggcgctggcggaagcgcaacgccgtgaggagatcgctgctccagagcctgcggccgatgtcgagctcggacctgccgctcatggacctcgcctccatccacgccgccaccgacaacttctccaaggccaacaagctcggcgagggcggcttcggccctgtctacagagtacgtggtttacttaatagttgtaatttagtagtctctctattagctagtccctagtgcactcaacatttgtgtagagagatcagcctctcccgccatttctgtggtgaaattgaaccgagctttgattggcatgtaaaccaaagggcgtgctgacgggcgggtcggagatcgcggtgaagcggctgtcggcgcggtcgcggcagggcgcggc

SEQ ID NO: 73859 - DNA, 719 bp, Triticum aestivum
  Clone ID: PAT_TA_73859
cggcacgaggccagtgcggaggctgagtaccgggctgtcgcgcacgccgttgccgaggcagtctggttgcgacaactccttggcgagctccaccaggctcccacgcgtgctaccgtggtctattgtgacaacgtgagcgcgatgtacatgtcaactaatcctgtgcaacaccagcgtacgaagcacgtggagattgacttgcacttcgtccgggagcgtgtgtcgctcggcgagttcgcgtcctccatgtcccgacgagctcccagtttgccgacgtcttcaccaaggggctaccgacgagcatcttcctcgacttccggtccaacctcaacattcgggagccccatgtttcggctgcggggggctgttggaagtctactacacgacctgatggacaacggccttgaccaggtccttcggatagttcaggaggtgcgtgcactacgtgcgcacgtccaccacgcatgcatgacatgctcggccacggccattgtacacgatctctccctcacccccttgtacctctccgcatgtataaataaccttgcgagatatgaatacatgtgtgcatagagttctgtaaaacaactgacggcgtccacgagcgcgagcagcccgtatccggcggcaagatgaaggccacccgtgaaccgtgcttcccctaaccacgtccaccttgtgtgagttcgctgctgagaagagcacaagaacctacagtt

SEQ ID NO: 73860 - DNA, 657 bp, Triticum aestivum
  unsure (1)..(657): unsure at all n locations
  Clone ID: PAT_TA_73860
gaggggggagcagccactgctgcttgtcgcggtcgtcctactgttgctcgcaccggcgcaagcaccatagtccggccgctgctcgagccatccgctgctgcgccggcagccatggaggctgcggcggcgagcgctctgaccaaggaggtggtgctgaagctggtggcgctgctgagcgagaagcacaagctgtccaaggggctcaaggacgacctccgcttcatccgcaccgagctcgacatgatctccaccgccagggacagccaccacatcatctcctcgcggcggccgcaggccgtcgtgtccatggatgagatgcgcgacctcgcgcacgacatcgaagattgcatcgaccggttcctcccctgcgtcgcatgcgagggggaggcggcggcggcgtcctcagtcctccgccgcgtgaagacggcggtcaccagcaccaccagatccccccggttcgcggcggagatccggaagctcagggtcaggctcagggacgcgcacgagcggagggccaactacgaacgtccaggccggcggcgggccctcctctgccngccgctgccgccggagtggcctctcctcccacggccaccgccgacggcgacctcgtgggcatcgacaagccgaggcaggagctcgtggagctcttgctgg

SEQ ID NO: 73861 - DNA, 597 bp, Triticum aestivum
  Clone ID: PAT_TA_73861
cggcacgagggtcgcctcctcctaaaccactctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattccccatgaaggaaggaatggaaaggaaggatgttatgacgaaaaatgtttcaatctacaaagctcaagcatctgctcttgaagctcatgcagcccccaattgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgtcca

SEQ ID NO: 73862 - DNA, 491 bp, Triticum aestivum
  unsure (1)..(491): unsure at all n locations
  Clone ID: PAT_TA_73862
ccgatgaattacggaccaggaggtaacccaatgagttacgaaccaagaggaaacccgaggagttatgtaccaagaggtagcccgcactcgtcttccggacgtggcaggggtgagaactactaccagagcccaggttcgagaggaagagggggaaggggtggcttccagaaccattctggatcgcaagatcagaggaacttctacaggaagtccatggttgatgatccttggcagggcttgcaacctatcgttggcagcatactacccatcgatggtgccaagtcctggcttccagagtcattgcgcaaaaaggagacacctaatcaaggcaggggtgggaatttctaccacagcccaggttcgagaggaagaggngggaaggggtggcttccagaaccattctggatcgcaagatcagaggaacttctacaggaagtccatggttgatgatccttggcagggcttgcagcctatcgttggcaacatactga

SEQ ID NO: 73863 - DNA, 691 bp, Triticum aestivum
  Clone ID: PAT_TA_73863
cggcacgaggcgtcgctttggccgcttcgatcgtgaaattgatattggaatccctgatgcaattggccgccttgaagtccttcgaatccataccaagaatatgaagcttgatgatgatgtcgacctcgaacaaattgcaaatgaatgccatggctatgttggagctgatttggcctccctctgctcagaagctgctcttcagcaaattcgtgagaagatggaactcatcgacttggaagaagacacaattgatgctgccgtactcaactctctcgcggtaaccatggaaaacttccgctttgcgatgagcaagaacaatccctcggctcttcgtgaaactgtcgtggaaactccaaatgtcacatggacagacattggtggtctcgaaaatgtcaaacgtgaacttcaagaattggtccaatatccagtcgagcatccagaaatgtatctcaaattcggcatgcaaccttctcgtggtgtcctcttctatggtcctcctggatgtggtaaaactctcttagccaaagctatcgctcgtgaatgccaagccaacttcatctctatcaaaggccctgaactcttgaccatgtggtttggtgaatctgaagcaaatgttcgtgatgtctttgacaaggctcgtgctgctgctccttgtgttctcttctttgatgaattggattctattgcaaag

SEQ ID NO: 73864 - DNA, 711 bp, Triticum aestivum
  Clone ID: PAT_TA_73864
tcggcacgaggcatcttcgctgctgggctcgctcttgttgagccgcacggtttcgtgcacaccccactttccagaacgtctattttccgtagaccgaacgaattccccggagctcaacagcccttctggtgggacgataccggtgtatggtgcggaaatgttcaacagaaccagcaatactccacttgcggacgttgcggtgatgctccaggaaacactcacgcccaacaaggcggccgatacgacaaaggcatcatcaccggaacatacactgctggacaagtcatcaacgctatcgttgaattcaccgccaatcaccgtggtggtttcatgttcgaactttgcccacaagtgtctgagaacaacaactgcttccaacgtctccgcatcaacagcgcagacagaggtgtccgcgacaacaactgggcctgctcaggtggcgatcaccagaacggccagatgcgagttgccattcaacttccagctggtgtccgatgcaccagatgcacactccgttggacatacagaacctcgtacccaccagcaccagatgcatgctggaatcccaacaacgctcagacattcagaaactgcgtcgacatcagaatcaactagatttcccaaccatgaagcttttgtgacgtctaacgacatgacctttgctatgaaaaatatattattttgaaaaaagaaaaaaaaaaaaaaaaaaaa

SEQ ID NO: 73865 - DNA, 547 bp, Triticum aestivum
  Clone ID: PAT_TA_73865
gcttcatcgcgctctccagatcgtgccgggcctcaagaagatggacaaggcgtcggtgctgggcgacgcgatcaagtacgtcaagacgctgcaggagcaggtgaagggcatggaggaggtggcccggcggcggccggtggagtcggcggtgctggtcaagaagtcgcagctcgccgccgacgaggacgacgggtcgtcctgcgacgagaacttcgagggcgccgacgccgggctgccggagatcgaggcccggatgtcggaccgcacggtgctcgtcaagatccactgcgagaaccgcaggggcgtcctcgtcgccgcgctctccgagctcgagagcatcgacctcgccatcatgaacaccaatgtgctccccttcaccacctcctccatcgacatcaccatcatggccacggccggcgaagacttctcgttgtctgtcaaggacatcgtcaggaagctacatcaagcgttcaagtcgtcgccatgaaggacttgctcctcaacaagtctaatttagatctttggcttctgtttccctccttttttt

SEQ ID NO: 73866 - DNA, 159 bp, Triticum aestivum
  Clone ID: PAT_TA_73866
cggcacgaggtttatgaacttggctttcaggctttcaccaccgttgagtttcatgtgaacaatctgttttgatatttttatataacaatatcatgcctcattttccatttgatttagttatttcaacttcaactttgagtgtattagttatgcactgat

SEQ ID NO: 73867 - DNA, 523 bp, Triticum aestivum
  Clone ID: PAT_TA_73867
cggcacgagggaaagccggggaggtggtgccggcgtacgtgtgggcgccggaggaggacgggccgtactaccctgggcgggtgtcccggtggtggctcagccagagcctcaagcacctggacgcctcgctgcgccggctcggcgccacccatctcttcttcaaccacctctacgacccgctgtcgctggtccgggaccaccgggtgaagcaagtgctgggggccgagggcatcaccgtgcagtccttcaactccgacctgctctacgagccatgggaggtcctcgacgaccacggctgccccttcaccatgttcacgcccttctggaacaagtgcctctgtatggtcgacccccccgcgcccatgctgccacccaagaggatcaattcaggtctctgcactgctttttttttcttcttcttcttcctcttttcgaggaagaggaacaataactactgacctatatatagaacaataacgacaggtgacttgtcgaggtgctgctcatcggaccatctcatctt

SEQ ID NO: 73868 - DNA, 595 bp, Triticum aestivum
  Clone ID: PAT_TA_73868
cggcacgaggggtctccgcgcgaagcaggccggccgggccggctgccgcggcgcctaagatacccttcattcactctgctgctgctacctctcgcactcgctcacccacctcctgcttctctcctctcgtcctcgcgccggcggcggcgggcctctgcagccggcgtgctagggttttccttcttgtccgtcctctacaaggtgtcgtctcactgactctgactcgtggcgcggatggcggtcggggacgcgctgcggcgcctctgcgaggacatcggctggtcctacgccgtcttctggaaggccatcggcgccgccgaccccgtgcatttggtgtgggaggacggctactgcggccacacgccatgccccgccggatctgaggcttctcaagctcgggccactgagctcgggtgttctgctgctgttgacagcatttgctcactcgttcggaaggacatggcccagcaggttcatgtcgtgggagaagggaccatcggccgtgttgcgttcactggcagtcatcaatggatcatccatggtactgcggatgatcacgggctctcatccgaggttgcttctgagatgcattatc

SEQ ID NO: 73869 - DNA, 739 bp, Triticum aestivum
  Clone ID: PAT_TA_73869
attcggcacgagggctgcttctactggatttcaggtgaaaaattgctggtgcttgacattcagaggatggagttctccatggccgtccacccaccctgtgccagagctccgagcgatgatgtggccatcgcagaggcaggccaaggcacgattcggatgtttgtgcctacacccaacacagctcgccgcagttttacggtttggcgaaacaatggtgggatttccacccagtggcagtggcagatggagaatgagacaatctcgctgccttctgggtccttgctcacgggtgcagtggggaggcacttgctcctatatcatgtcggaagctcgtcgatcaggcgaggctgttacacgcgcggcgtcgacacattccagtttgagagggtgtgtggttctgcttcattgcccaaaccgtctcatgcatattgcaactttccaccgtcgttattatcggcaccgacagtgtcaagtgccacaccccacgctgacgtccagggagaggggggcgctgtgcgggtgcctgaactacaagaagccgaccctggaggcatggaagtgcacgtcctcgcagcggccgcccagctctaaactccttgttcgtcgcgggtggtgtagctcgagagggcgtgcaaggaggcgaggggcctgcaggtaccagggtgtcgaggaggacgactgcggccaagggcaacaagtccttcagctggaggggctgcttcccttggttgtgatagct

SEQ ID NO: 73870 - DNA, 594 bp, Triticum aestivum
  Clone ID: PAT_TA_73870
tacatcgtcacattccgaaacaacatcaaccaaacaacacttgcatcgcatcaccgccatcatgcaaatcttcgtcaagaccttgaccggcaagaccatcacccttgaggttgagtcctccgacactatcgacaatgtcaagtccaagatccaagacaaggagggtatccctcctgaccagcagcgcctgatcttcgctggcaagcaactggaagacggccgaactctctccgactacaacatccagaaggagtctaccctccacctcgttctccgcctccgtggtggtatgcagatttttgtcaagaccctcaccggcaagaccatcacccttgaggttgagtcctccgacactatcgacaacgtcaagtccaagatccaagacaaggagggtatccctcctgaccagcagcgcctgatcttcgctggcaagcaactggaagacggtcgaactctctccgactacaacatccagaaggagtccacccttcatctcgtcctccgccttcgtggtggtatgcaaattttcgtcaagaccctcactggcaagaccatcaccctcgaggttgagtcctccgacactatcgacaacgt

SEQ ID NO: 73871 - DNA, 743 bp, Triticum aestivum
  unsure (1)..(743): unsure at all n locations
  Clone ID: PAT_TA_73871
cggcacgaggcagacatattcagtttgggcgtaataatcantggagatagtaataggagacaggaactatccagatactggaacaccttcagatgactttatggagcttgtaaggaaaacattctcgccgagtaaaacgaggtctttgttttacataaacggtgttgcgttttatcttttgcacactagcattctagatgtatgtttggattctacatctacagactcttggtaaatggagaaatatgtcgcgcgaatcaacaggggaagccatcctagagacagattgcgaacaaataaagagatgcctcgaggtaggtctagtctgtgtgaatcctgaccgctccaagaggcctccaatagcgaaggtcatcagtatgctccaaggattagaaagtatcacctgcagttttagcaacgaggcagcatcatcagcaggccagggtgttgagccacaggatcgacccaggaagagatcgcgcaccggcaggcattagattgactggcttctttgcgagtattacttggtgtcttgtttgattcgtgtatgtatgccgtgatttgcaattttcctcgtgcagttcaccaacaaatctttgggagacggtagcatgggttatcttcaacccatttggatgacgagctaataataggctaggtgtatagacatcatagcctgttgctatcttcgccggttgtggcatcttttattttccttttttgttaagctccgtttgtgagtc

SEQ ID NO: 73872 - DNA, 743 bp, Triticum aestivum
  unsure (1)..(743): unsure at all n locations
  Clone ID: PAT_TA_73872
ttcggcacgaggggtctgatgggactaccaaacataagtttccttgagctagaccaggttgcacttcatcatgttcccaaagggattgcaaattttcagcatctctacagcctcagaggagtttttgagagcgagactgggttcagattggatgaactgcgagacctccacaatgtccggcgtctgtgggttgataagcttgagaaagctacaccaaggggtgagcttgtgctgaagaacagtcgtaatcttagagaactgggactccaatgcaccagtactcgctacgatgctgatgagctcgagaggatccagcgagtctatgacacacttgttccatcaacaagcctagcatatctttttcttgtcggattcccgggctcagcgttcccagaatggttgcttaccgaaccagagcttaatatgccaaatttatgcctaatgcacctcaatgagtgcataccatgctcagtgctgccaccagcaggtcagatgccagagctgctagagcttaagattcaaggcgcagatgaagttgtctctattggcacagagctcttgngggaaaggtgtcgccagtgctgccgccttcttcccaaagcttgaacttctcctaatcattcgcatgcgcaatttggagaaatggtccctcaacacaagagatgtgtgcgatggcaaccatcaacagttctctctgatgccttgcctttcacggctgctgcttcttgattgtccaaaactga

SEQ ID NO: 73873 - DNA, 752 bp, Triticum aestivum
  Clone ID: PAT_TA_73873
cggcacgaggcgccaatcaatggtcgcaaatgaaaaactggaattagaacaacaattacaagctgtacaagcattagtacacgaagctgaaggtgctcaagcttctctcattggtgcagttgaagctgccgatcatgccttacaagcacgtgaattagtcaacaatccacatactaatgtatcattaggggatgcaacatccacattatcatcatttgttgtattaattcaaaagaaagctaatcttttggctgaacaaattgaagaaaagaaacgtggtggattaacacctgaacaaattgctgaaattcatgccaactttgcctacttcgacaaggataataatggttttctcaataaaaaagaattacgtacatgtttacaatccttgggtgaagaatcaacaccacaagctatgcaagctatattggataaatatgatactgctaaaaaaggaacaattaataaacatgaatttgaagtctttattcgtgaatcattgggtgatactggtacatcagaagaaattattaaatcattccaatatttatgttatgaagcacccactattacatgtcaacaaatgatcaatgttgtcaacaatcgtactttcaccgatcatcatgttgattatctcaaacaagaaatgaaacaaacgagtgcggatgcctataattattcacaatggacacaagaagcatttgcacgttaaatatatcattggttattgcattttcttgatcatcactatg

SEQ ID NO: 73874 - DNA, 703 bp, Triticum aestivum
  Clone ID: PAT_TA_73874
ggctatcgctgcttcagttcaaggatgcaatcagtctggatccacaccaggccttcatgtcctggaacaatagcatccacttctgtaattgggaaggtgtcttgtgcaggctgaagactctgccacatcgtgtcagttctctaaaccttacaagtcgaggtttggtaggacacatatctccttcacttgggaacctatcgttcctgcattctctagccctggtggaaaacacactcaccggggagattccaccctccctcggtcacctgcgtcgtctccaaaccctccgcttgagaaataacatgctacaaggaaggataccaagttttgtaaactgctcaaagctcagggtgctggatgtttcacacaaccatctagttggccaatttcctactgagttgcctcctgtccttcaggtgctgcgtgttgggactaataaccttactggcaccatcccagcttctcttgtcaatataacaacactaaccaccattagctgcctgaataatcaaatcaaaggaaatatcccaagtgagtttgcagatctgcccagcttgcagtacctgtatgcaggtggcaatcaactggcaggcagttttccacaagccatcttgaatctttctactctcattgaccttgaccttggtctcaacggtttaagtggaaatctgccaccaaatctctgtaccgctctccacaatct

SEQ ID NO: 73875 - DNA, 727 bp, Triticum aestivum
  Clone ID: PAT_TA_73875
cggcacgagggaaagatacggttgaaagagaactgttcttttcaataaaataactaaaaatattaaaagttaattattatttttcccattttagccattcacctcagaagaagcaactcgatatgaagaattatcgaaagcacagtttgctgatttctatcgtactgttgcagttccaaataaagcatcttcctttggacaaatgaacaatgagccttcttcatccagattaacaaattactccaccactccttcaacttctttgttccgacaaccctttggtgatcaagaggactcccaacactcatcagattgccaaagaagtgaagatggctacggtagtaatgacagtggatttggttcaaattcagatgatgaaagaaatggagaagaacagagcaacaccggagatctctattataacatccttgaggaaatcccagaacaagcacaatttgaaaatgttactcttgcttatcaaccctacacagcaactgacaacaatattcttccacatcaacaatcttcaagtgctccattgactaccttagttcccgctccagtagctgcccaagctgatgaaacatccccaatccttggacattacacagagaatggcccagaagcccttgaaaccaccttgcaattggatgaagaggaataccttaagtatgtcaccaatcaacaagttctccaagatatctctcaatcagctaccgaacaatct

SEQ ID NO: 73876 - DNA, 550 bp, Triticum aestivum
  Clone ID: PAT_TA_73876
agcatgtgcgcgtgcagtgcggttcgcctcgtccgtccagttccccaatacaaggctgcagttttccttttccccgatgatgaagacagtcagatttgttgcatcttgtgcatattgcaggattttgaaaaaagcaatgtgaaggtttcatcaagatctcgcgcaatccatctcacagcctagctctgcatcgacgcctaggcaatttctgtttctgtgacttgcgatgttggtggtaatttgatgaagcatcaagccggtaatttgatgaagcatcaagccacgcaggcgtcgatgttggtggacttgcgatgcagagcagtttctgtgatcgttgtcgtgtaacccattgctgctagcctgtggttcgttgtatgtgggtgtgcgcttcagcctccgtgggtgtgcgggtgggagaccaattactgctgctcagtttgttgtgtagagaagaaaactgaagtgcactacaatacagtttctttttgtaaaatgcagacattaccttttgcttttgtttttggactcacgtaaaaaaaaaaaaaaaaaa

SEQ ID NO: 73877 - DNA, 701 bp, Triticum aestivum
  Clone ID: PAT_TA_73877
cggcacgaggcgttactatcagcggtacacttacctctgacttcaagaagaaaagtaacatcaccacaggaagttcaaagcagcactctacaacttcacaacttcagctcattgaagtcaaattatatgctgaacgccgccccaccatctgggcctaaaatcttgcgaggatcaacaataatgcgtcgaggaggaacttctcgtggcggcatttccaaacgccctggtgctcgtggaatccgtgttgacaaagatggagatcttgatatggacgcccctgcccgcccaacagcacgaggagggagaggtggagcgcctggtgctcctggatctatgtcaactcgcggtgttggtcgaggatcaacacgagcatccggcagtggtgctcttcgtggtggtaccacaagagggcctcccagaggtcaaggcctcatcgaaattactgtccttggatggcaagagagcaagggccctaatagagattcattagttgattttctagaacgaaagtctgcggtcaagataaaaaaatctcgaattcaacaagatgctctgattatctcagtgccctttctccaagcgggagaaatgacaaagtgggacggttgtaactacgcaggttccacactctcaataactgccagcaacgcgccaaaaatcacctcgaagaaagacgaagagatgatcaccaatgcactcac

SEQ ID NO: 73878 - DNA, 532 bp, Triticum aestivum
  unsure (1)..(532): unsure at all n locations
  Clone ID: PAT_TA_73878
attcggcacgagggctgtgcttagcacgggcaattctgcgcaaaaatcaaattctcttgatggacgaggcgacagccaacgtcgatccaaaaacggacgctctgattcagcaaacgatcagagagaagttcgccgattgtaccgttatcaccgttgctcatcgtctgaacaccatcatcgattcggatcgtgttctagttatggatgctggtcgggcagccgaattcgacgaaccgcacattttgttgcagaaccagaccggtctattccatgggatggtcaaggcgctgggcgcgaacgaatttgaaaaattgtcactgattgccggcaaaaaattgacgtccgacgatggaaacaagaaggaaaattagtcggggccgtgtgtcgttgttgggaattgtacttaaggaagagcaaccgtgtgtaccttcaatttgttgtttttgccaagtgttgctgtatacgagaatttaataaattgtaatgtggagcaataannaaaaaaaaaaaaaaaaaaaaaaaaaaaaaaaaa

SEQ ID NO: 73879 - DNA, 678 bp, Triticum aestivum
  Clone ID: PAT_TA_73879
cggcacgagggtaaattgctgattaacggcatcaaaattttgattgctcaaaacaaaactgaagaagaaattgataaatttgctcgaaacacttgtgtaaacttacaaattgagcagccttatgtctgcgatagaatcattgaagaattcggaaatgaactctattttgcaattgaacgctcctatcttgaacctcatgaattttgtggagctttcgtcaaagattgtggagtctttgaaaatcctttagatcaaccttggcctttagtaatccctggaaataagcctgcagtcaagccatggcccactgtaactgcgggaaagccaaagatgagagtcttgcacttggcagatatccatatcgacagagaatatgctgttggaagtgaatcagcatgcgcaaatgatgaaggatttgtctatgctttttgttgcagagattatcctccaggaaaatccgctaattcttctcccaaaaacgattcaatcaaaactccagctccaaaatggggaattgcagcaaactgcgatattccttattggactttcgaggaatcaatgaagattatttctgagcgagaaaagtacgactatattatcgttactggggatttggagccgcatgctatctgggattacaccaaagaaacaacgactgcaaatatcgttaatattaca

SEQ ID NO: 73880 - DNA, 722 bp, Triticum aestivum
  Clone ID: PAT_TA_73880
gaggccggactagggctggctaatcgcattgaacatgtaatacaagtggaccgatcatggtcaaccatcttagaatttctcgtgttggaactggaccaaccaatgacgatcatgccaagtataaatgacaaggaggtaatcacggcaggctgctggtatctctggtggcttcaccgatgacacacccatcatgattcatttcctccttacttcaggtggcatacctcaatcctagcaataacgggaaactatatgaaatctttatcaaagaagccggaaccggtggaacacaagtaatagagatcagaggcaagatttataaagctaaatgtggatgctccattccatgcagatgaaggatcaggtgctactgttggtatcttatgagatgaaaaaggaagctttattgcagggctttctagattcgttcccttggtggctgacgttgccgcgattgaagcaatgccaatgcgagatgatttaaatttcacgaactccttgggtttcaacggggtagaagtagagccgtactcccgtcatcaactgttgccgaggacaagaccagtggtgggatgcagcggtggtttgtcttcgctgagtgcatagatatgactacttatataggaaaggtcatctttactcattgtttttgttaagcaagttcggttgctcatgagctaggaaagtttagtttttgtaataaatgtgaggatagttggact

SEQ ID NO: 73881 - DNA, 595 bp, Triticum aestivum
  Clone ID: PAT_TA_73881
tttttttttttttttttttaaacaaatttaatttatcaaaattccgtaacaaaaaaacaaatgaacaacacatcatgatttttactttctgcggcgattgccaccacctttgcgtgcttcttttggctttggaggaaggatgacaccatcatacttttgttggaaccacttgacagcttcgtcgcgaccaacacggtgagaagcaccaacatgagccttggttcgtctacgttttgcaacacggcggccagcacgatcaagaacaacatagaagtccattccatagataccaattgaaggatcatatttaataccaagatcgatatgttcctggattccaaatccgaagttgccagtatcagagaagttttcacggtacaattcgtattccttgaccttcaaaccacgatcaatgatttcttcagcctttgggccacgaactgtacaatggacagcgatcttttcattacgacgaataccgaaagagcggacggtatagcgagcttttgacaacactggagtttggccagtgagttgttcgaggaccttggcagcacgtgtaagtctatcaccagattcaccaacacagatattg

SEQ ID NO: 73882 - DNA, 667 bp, Triticum aestivum
  Clone ID: PAT_TA_73882
ttcggcacgagggccaacgctggagcaacaagatcgggcaggattcggtgctggagccccgccgtttcagcaggcgttccgggcttttctccgagaagctgtacgggcgcgcagggctgatgaggtcggtggaagtcgcgccggctgtgaaggacgcggtgctcaggtccttgaagagcagctatgggggactggacaaaggaagcacgccggcggcacaccgggtgggcctcggcggcaaggtcaacagctgggcatggtcggccatcggcgccggaagcggcaccagcagcaccacggagcatatcctcgcttgccacatcggcacgagactcttcgagatcaagtactcgcacacggcatgcccaacgtcggcggcggccgacatgacagccgcctgtcatttgtcctactactgcgcgtacctggtggcggccgcgccaaggctgctgccggacagcccggcgtggaccgacaagcggtacaaggaagtagtaaaggacgtgaaggcggcgctgggaaaggacgacgacggcgccagcgagtcgacgacgcaaaggtacgagcggctgctcaaggagctgagcgcgaccaccagggacgaggtgctgcagcgcggcgccgagcttgggagccgcctggtggaggcgtacgcggagaacgaggc

SEQ ID NO: 73883 - DNA, 315 bp, Triticum aestivum
  Clone ID: PAT_TA_73883
cggcacgaggtgaaacccgaacgctttgctgggtcccaagagcagccgagagtgtgtctatcgtctcaaaagctcatcagggaagggtttgagttcaagcacaacgatctaggtgagatcttcgacgatctcgtcaagtatggcaggaccacagggattcttccctactgatatgtatacatatcggttcgtcgatggatatgtaatcgcaacaaaacaatatcctcccaaataagcaacagctaaggtttatttattgcttcttccggtatttgttgacaaaaaaaaaaaaaaaaaaaaaaaaaaaaaaaaaat

SEQ ID NO: 73884 - DNA, 218 bp, Triticum aestivum
  Clone ID: PAT_TA_73884
cggcacgaggccgacgctcaagcccccagacgccgcagcgccgccactccacccgcagcggcaaccatggcggtcggcaagaacaagcgcatctccaaggggaggaagggtagcaaaaagaagaccactgacaactacatgctccgcatgttcaccattggcttcacgaagagacgcccaaaccaggtgaagcgcacttgctatgcccaagcaagtca

SEQ ID NO: 73885 - DNA, 682 bp, Triticum aestivum
  Clone ID: PAT_TA_73885
cggcacgaggattttatgttattattacagatgatttgcataaggaaaacgaacagagagtttttttttttaaatcttctgtatatcaccggaggacaaagcaaaaagagaatcgttgttcagaagattcaccggagtacggtttttagggtgtttggatccgtgggaatttttcctaaaaggatgtgaaactcttttgggattttccccaagaattcatgcagtctattatttttgaagatttttttctcaaacctcttcttgcaattcctttacttttggtggtgtataaaacactctttgatgacgtcttttttttgccacgccccttagtaccacttatataggtcctgatacagagatgtaacaatccaaagtacattttattagcctagctctgtcgctaagccttttgatcctagcacttaccattctttagtgtttgttagtccactcttcgccagtgctaaggtgatatgagggtatgtactaagattaaaaaacttagtgccgctactcagcttagtgttcaatgctatgctagattaatcttaattagtttatggtcatccgttttagttaaattcataaattgatagttttaaagtctagctcctatgattcatgccaaggtaaattgaaagagaatattaatgtattcatcttagcttctattgtgtcg

SEQ ID NO: 73886 - DNA, 588 bp, Triticum aestivum
  Clone ID: PAT_TA_73886
cggcacgaggtaatcgatgagcactgagtgctcttggttatagtttttttttgcaattgtttagctgagcacattttaaacttaacatgtgccttttacaggacaagcctcagcccccacctgagggtcgcctccctgatgctaccaagggtaccattctaaccctcacaacatttttctaactatagaaaaggcgtattcactatggaacaaatatttataattaatactgttgtgaaacaattgtaaatggaaatcatgctttgattgcttacttatttccaatatccgtttgctcactatagaaggcttcttccttaaactacgcagttgaaccatattctgtttcactcatatatgaagtattaattatgtagtacatgtatacaatttgcgcagtccagtctatgctagttttcccctttagcaattgtgacatggtgtgtatgtgcatgaaagtaccttttactttcactaatgatttccattccttaccgttcacccaggttctgaccacctaaggcaagtcttcggcaagcagatgggcttgagtgatcaggatattgttgccctctctggtggccacac

SEQ ID NO: 73887 - DNA, 708 bp, Triticum aestivum
  Clone ID: PAT_TA_73887
cggcacgagggtttgaggtgaaaaccgcatgagtcggtcgaccacggaagactgggacgaagaacgggatgttcgaccaaacgctctggttgtagtcctcggcgatgtagggcgcagcccacgaatgtgcaatcatgcgctatcccttacaaccgaacttaattacaatgttttccttctcggatacaatgacacgacgccacatccagcaatcgcactgaatcccaatataaggatcgtgcccgtcagaccaccaccggacttgccgcgttttgttccggatcctgtggccctcgttttcaagttgctatggacgaatttcttcctcttcacggctatgttatttcgggtacccttcctagtccatttgatcctattgcaaaatcctcctggactgccgactatgtttatttgttggatcatttcccatttgaagcgcgcaaactggatcattgactggcataactacacttacaagatgcttcagcataaatggaaccttgagatggatttgtccaagaaatcgcggacggcagcaaccgaagcacagcaggaagttgccaagaagcgccaaacccgcgaggaacgtgaggcggccttgcgcgagaaaaagcgagctgccagggccgaaaagaaaccggcatggaaccttcggaaattctttgtggagatggtctatcggtatgaaggattctttgggcgtcgctg

SEQ ID NO: 73888 - DNA, 679 bp, Triticum aestivum
  Clone ID: PAT_TA_73888
aatgggcgtcttcagccaactttccgagagctccaagcaaaacgctttcagccttcccggcttcaagaaggctgactgctcgtccggatctccatctggcaagaaggaagtcgagttcggcagcccgctcttctacacctactgcgccatcggtggagccgcctcgtgcggtattacccacacggctatcgtccccctcgatctggtcaaatgccgtatccaggtcaactccgagaagtacaagagcatcggtaccggcttccgtgtgaccgtagctgaagagggagtgcgtgccctcgcgaaaggatgggccccgaccttgatcggatattcccttcaaggactcggaaagttcggattctatgaggtcttcaagaacgtctacgctgacatgatcggcgaggagaacgcgtatctttaccgcacctcgctctacttggccgcctctgcctcagccgagttcttcgctgacatcctcctggcccccatggaggcgacgaaggtccgtatccagacctcgcccggtgccccaccaacactccgtggctgcgctccgatgatctaccgcgccgagggcctttccggcttctacaagggtctgcccccactctggatgcgtcaaatcccgtacaccatgatgaagttcgcctgcttcgaacgaaccgtcgagatgctctac

SEQ ID NO: 73889 - DNA, 690 bp, Triticum aestivum
  Clone ID: PAT_TA_73889
cggcacgaggtgctgggcgagttgtagagaatccatccatttccccagtcgttccacccccaatgccagcaacgacagccacgcgtatccaaccacaagatgcagagatcattacgcccgaattctcacaagcacgggcagacaccgcagcaaccctgcccgacagcccctgttgcgttctgtccgacgtgcttggcatcttcgatgcgaacgctaccatctcttcggggacggcggacgtgcattccgcattgcgtgtggtgcacactgccggtacacccaacctccctgcttcaaattcgtatgccctggtgatatccctctcactcgttttgcctccgttttctacgacgcccgctaatcttggttacgttgacaaggccgcttcttccacctactgcaaggttctttctacgcatctgttgatcattaagcaacccctctggcctacctagcgacagtgaaaaactctccccgcactgcgtgtgcgcacgcgagagtataaacatcacgacaagaacagccgtccacggatcttccgtcatccgacccacgttttcgtattcatcctgcttttctgtttgtgtgtgcgggccgtggatgacaaaaacaaacaaagccgtttctctcaatccctcctcggggcattcgtgctgaatctcgctgctccccactctctggtccatcgct

SEQ ID NO: 73890 - DNA, 642 bp, Triticum aestivum
  unsure (1)..(642): unsure at all n locations
  Clone ID: PAT_TA_73890
ttcggcacgagggtttgtggagtttggtttgatctggcatatcaccagccatgagtaactgcttcgcgaagccaacctctaggagcgagggcgagatcctccactcggccaacatcaggagcttcaccttcaaggagctcaggacagccactaggaatttccggcgggacagcatcctcggtgagggcggctttggagtggtgtacaaagggtgggtcgaggagagcaccttcgccccggccagcagcgacactggcatgcccgttgccgttaagaggctcagccagaaaggcatccagggccacagggaatggctggctgaagtgaattaccttggcagattgtcgcatcccaatctggtgaagctcctaggctactgcctcgaagacgtgcagcacctacttgtctacgagttcatgccacagggaagcttggagaaccatcttttcgggaggagcttaaatttccactcactgtcatggaatgtgaggatgaatgttgctcttggagcagctaaggggcttgcgttcctccacagcgacnaggccaacgtcatctaccgcgatttcaagacgtcaaatgttctccttgattcgagctacagcgcaaagttgtctgattttgggttggcgagggatgggc

SEQ ID NO: 73891 - DNA, 481 bp, Triticum aestivum
  Clone ID: PAT_TA_73891
cggcacgagggtggagccagccagtgtggcggattggggcgaggctacgtgcatggccaccgggagcagcaagtggtggcaagggccaatggacttcccgccgcagccgcagccgcagcagatgcagcagcatcagccgctccagcaccagcaccagccgctgcagctgccggcggtgaccatgccggcgccggctccagcggtggccgcctcaccggagagcaagcagcagcagcagcagggccagggccagggcgaggggcagatgggggcggcggcgggggccatcgtgccgctgcggaggccgcggggccggacgatggggaccaagaacaagcccaagccgccgataatcatcacgcgcgacagccccgacgcgctccactcacacatcctggaggtggccccgggcgcggacgcctgcggctgcgccgtccacaacacgcgccgcctcggccggggcgtctgcgtgctgggcgcg

SEQ ID NO: 73892 - DNA, 773 bp, Triticum aestivum
  Clone ID: PAT_TA_73892
attcggcacgaggctttagtctttcctccgttctatcttgcttgtcccttgcaagtttgagtgcagaacgagctgaagagagctagatagacaagggagaggacaagttcttggcttataattacagcaggtttagagcaagttttgagtttgaggagagatgggcaagcttgtgaggcaatgtgacatggaggtcatgaagatggccatgctcaagcacgaagagaccttcaggcaacaggttcacgagctacaccgcctgtaccgcatccagacacagctcatggggggcgacctgagcacgcgccggcagccgcggcggcgcggcaacaagcagccacgccgggcgctcaacctgcagctccccgccgacgagtacatagtcggagccgccgacgaggacgacgacggctgcggcaccggagcagagctggagctgacgctcgccgtgggagggaggaggaccggctccggcacttcccgcaagaacaacgttagcaagagaggacatgccaaacacgacggcgccggcggcttctcctcacccttcgcttccgactgctccggcggcacgagcctctcgtcgtcgccgccgtcgtcggccgagtactcggagagcgccttcggggtggcgctccacggcggttaccccgggggtggccgcgcctccgccgccatgccagagagccatgacgttcgacctcggcgtggcggaagcgatgaagcagcaccagtcgccctggcagctggtgcagtgccagtacctcagcctc

SEQ ID NO: 73893 - DNA, 543 bp, Triticum aestivum
  Clone ID: PAT_TA_73893
acatggcctcatttggatttccatccgtatccatacccattctcttcttgatcaccctgtccactgtcctcacatcttcttctcccggtccaagcaagagcaatgatagcgacactgatcttgctgcccttctggctttcaaagggcagctctccgaccctctcggcatccttgccagaaactggaccaccggcacgaatttctgccactagtttggtgtcgcatgcagtcggcgccggcagcgcgtcaccactctgagactgccgggctccctcctccatggaccaatcactcctcaccttggtaatctctctttcctctctgttctcaacctcaccaatacaagtctcacaggctccatccccgatgatttaggacagcttcgtcgtcttaaatacctatatctcggattcaatggcctattaggtagcatcccaaccaccataggaaacctcacaaggcttcatgctctttccctatctcataatcatctatctggttcaataccagtagaactgcagaacctgcagagtcttggctact

SEQ ID NO: 73894 - DNA, 758 bp, Triticum aestivum
  Clone ID: PAT_TA_73894
cggcacgaggtggtggtgttgatcatatggactccatggaatcatgcgtccctcctgggttcaggttccaccccaccgacgaggagctcgtcggctactacctccgcaagaaggtggcctcccagaagatcgacctcgacgtcatccgcgacattgatctctaccgcatcgagccatgggatctcacagagcactgtggcatcgggtacgaggagcagaacgagtggtacttcttcagcttcaaagaccgcaagtacccgacggggacgaggacgaacagggcgaccatggcagggttctggaaggcgacggggagggacaaggcggtgcacgagaggagcaggctcatcggcatgagaaagaccctcgtcttctacaagggcagggcgcccaacggacagaagacagactggatcatgcacgagtaccgcctcgagactgacgagaacgcgccaccgcaggaagaaggatgggtggtgtgcagggcgttcaagaagaggacggcgtacccgaaccggggcatgatggagagatggggctcaaactactcctacaacgaggtcaatgccatgtccggcgcgccgttcccggacccgaacatggcgtcgacgtacgcggcagcggcgcagatgggcaggggcgcgagcttcaaggaggaggcggagcagctggacggggccgccgccctgctgcgatacacctccagccacctagtcgagctgccgcagctcgagagccccgtcgctccgctcccgcgt

SEQ ID NO: 73895 - DNA, 601 bp, Triticum aestivum
  Clone ID: PAT_TA_73895
cggcacgagggctcatcagttccatggacagcgcagacaccaccgtcgccggcggccgcgtcctgctcctgccgttcccgggcatgcagggccacgccaaccccatgctccagctcggccgccgcctcgcctaccacggcctccgccccaccctcgtcctcacccgccacgtcctctccgccacccccaccacccagtgccccttccccgtggccgccatctccgacggcttcgacgccggcggcatcgcctcgtgcgccgacaccgccgagtacctgcgccgcatggaggccgccggctccgacacgctcgcgtcgctcctcctcgccgacgacgtacgggtgctcgtgtacgactcgcacctgccgtgggcgcggcgcgtggcgcgggaggccggcgtggccgccgccgccttcttcacgcagatgtgcgcggtggacgtggtctacggcgaggtctccgcggggcgggtgccgctgccgctcgcggacgggcgcgcgctccggggcaggctctccgtggagctcgggcccgacgacgtgccgccgttcgtcgccgcgccggcgtggtacccagcgttcacggaatcggcgctgtcgca

SEQ ID NO: 73896 - DNA, 194 bp, Triticum aestivum
  Clone ID: PAT_TA_73896
gaggttctgtttatcctgtcctctctcgaagatgcgttcaactcattcgaactcctcgtcgtcttttctctgagaagaaagttgatgcaactgctactaccaatgagtcttcctctgaaggtgctgtctatgaaaagcctcgctatgctactcgttcaagctatgaaagtacaattaaatcttcaagaattttg

SEQ ID NO: 73897 - DNA, 797 bp, Triticum aestivum
  Clone ID: PAT_TA_73897
cggcacgagggccaaggaaggtttcttatctatgaatatatggagagaggagacttagcaaaaatattgacaaacaatggaagggcaatcgagttggactggggaaggaggacacatattgtgttggacgtgggccaggctttggcatacatgcatcatgattgttcatcaccaatagtccatagagatataacaagcaaaaatattttgctcgatccggaatttagagcatgcatatccgacttcggcatggctaaaattctcaatattggtggtcagaatctcacaaggcttgctgggacgaagggatatattgccccagagctagcatatacaaagaatgtgacggagaaatgtgatgtatatagctttggggtgctgatcctggagatatttatgggatcccatccgggcgacttgctctcatccctctcattgggcaccaagaataatgatgtttgtctacatgatctgttggactcgaggcttgtgctcccagatgctgaagccgctagagaaatatactgcatgctcaatgttgcagtacagtgcctggacccaaatccgtcacgcagaccaacagcacgacaagccagtgatgagctatctgatatgaaagcatgtgaaggccatgttgattatctgcatgttgtcctaactagtcctgcatagtagtccctatggccatggatgatgacttcatgtcatgttgtttcttctttgcaaccaacatacctactttcttaagaagagtagtttcgtctatagctagcaataacatataattcagactgtat

SEQ ID NO: 73898 - DNA, 584 bp, Triticum aestivum
  Clone ID: PAT_TA_73898
cggcacgaggctccttctgtcccgcaaacccccgagagatcacaccatgttcggcttcggtcaccacggccaccatggccagaaccccccggcccacgctccggccgccgccggcggcaaccagcccaccttcaagatcttctgcaaggctgacgagggctactgcctctccgtccgcgacggcaacgtcgtcctcgccccctccaacccccgcgacgagcaccagcactggttcaaggacatgcgcttcagcagccagatcaaggacgaggagggcaaccccgcctttgccatcgtcaacaaggccactggcctcgccgtcaagcactcgctcggccagtcccacccggtgaagctcgtgccattcaacccggagtacctcgacgagtccgtgatgtggacggagagcagcgacgtcggcaagggcttccgctgcattcgcatggtgaacaacatccgcctcaacttcgacgccctcaacggcgacaaggaccacggcggcgtgcacgacggcaccaccgtcgtcctctgggagtgggccaagggcgacaaccagagctggaagatcctcccctggggcgaag

SEQ ID NO: 73899 - DNA, 779 bp, Triticum aestivum
  Clone ID: PAT_TA_73899
ttcggcacgaggatggacgtttaaattttccccctctttaaaaatataatgccttcattcagacgttatgatttttttctctcgcttttgccattgtttatttctcacctaccttcaccacttatgattaaatccgcatactaaatcttctctccttccctagacaatgacttcatggctaccatgaccattttcctatactattaatggcttatttatttcccatgtctgaataagttacgctttataatatgagatagagtatctcattagtatatggaaatatctcttctttcttctttttttttagatttattaactctaatggatcccccattttcctttctaggaaaaatcaagagttatggctactatacagaggtttcttcgttgaagtaaacatgttcaaggggaataataagatgcctgctgaactttctgaagatgtccacacttacactgaaaaatatcggtggtgctttggattcaattagtccgctaaggacggtctggctgatgaggattcaaatctgatggttaaactaaaattcctgacctataaggtattttgctatagttctcttcttcattttggactttgctcgttggtacattttgagatatgaatactatgctggttaccttagattggttactttcatgttgaatttggtgcacttctaaaattaagttttcaatgacactaatattcttatggttgtgcattccagttatgtccatctgatctccctctgatgtttctctgtggacttcctttc

SEQ ID NO: 73900 - DNA, 762 bp, Triticum aestivum
  Clone ID: PAT_TA_73900
aggtttgcgagtcgtcgacggaggagaagaagaccgagattctccgagtagagtacgaccatgacaaggccatgccaactctgggggatagaaaaaagtacgtggctattacctgtgctcattaaaatttctccctttttgccatgaaagtttgctctgatttttcttatatgttggttcggcttgaactttgattgggtgtgcagtctcctccctggtccaacccggtctgtccttttttttctgcatgaaaaccttttgatctatttatcaaatatcatgatagtacaaagaatacaggaagcaatagaaattatatttatatccatagaccacctagctacgacaacaaacactgaaacaagccgaaggcgcgccgtcgtcatcgctcctccctcaatggagccccaacccgacctgtctagtgctgcatatgccgtactaacatctactaactccattcctagatgtaaaactgccccagcgtcttatatttaggaatggaggtagtatgatactaaaatagtttcgttacatcatcgtaaagttttttcattttgaaaaatcatgaagtatatgtttcactgtatgttttgattttgtggatattattaacatgtttgtctatatatctggttaaatgtacggaatttttcccacaaaaagatatattaactgatttgaaataaagttaaaaccttatataatttgagactgaaggaccacatggtataatcacatccacacatatttcaaataaat

SEQ ID NO: 73901 - DNA, 510 bp, Triticum aestivum
  Clone ID: PAT_TA_73901
atcgttttagacatggttactgcaagcataatcctcggaaaatggtgaagacttgggctgaaaaggaaatgcgaaatcttttacgagttagagcagaaggaatccgatgcccgaagccgttgctcttgaggcttcatgttttagtgatggaatttataggaaaaggaggttgggctgctcctcgacttaaggatgctgctttgtcagatgacaagttgcgtgaaacttactttgagattgttacaacaatgcggacactttaccaaaagtgcaagcttgtccacggtgatttgagtgaatacaacattctttattttgagggacacttgtacatcattgatgtttcacagtctgtcgaccttgaccatccttcagctttggatttcctgaaggaagattgtttgcatgttaatgatttctttgaaaaacgaggcgttgctgtcatgacagtaacagagctatttaatttcgttgtggatcaaaatatcgctgatgatgatgttgatgatt

SEQ ID NO: 73902 - DNA, 491 bp, Triticum aestivum
  Clone ID: PAT_TA_73902
cttccaccaaaccaaagttgctggcgccccccgttccaacgaagcgagcggcaccgccggatcccgtcgcctccccccgttccactggagcaggcgccgctgctggatctcatttcctcatcgttcttccaggccagaccaccagatccggagtgccgccgccggatcccgtccccgtaggaacccttcgcgtcaccgggaatcccacggcggcggacatggtggcctctgcaggcgagctggctccggtcgctcggctgtccactccgctccaggatcccctgctcccctgctccaccaccaccagtggccccacgcgcgccaccgggagtcccaaggcagcggccatggtggcctctacagacgagcgggctccgaccgctcgggtccgccgccgctccagcaccgaccgatgggcggccatggcactccgcctgtctccgcccctcgacgtactaactctgttttttttctgtatgtgttgacctcgg

SEQ ID NO: 73903 - DNA, 750 bp, Triticum aestivum
  Clone ID: PAT_TA_73903
gaggggaggggcccccccatcccacgcccaactggaagcaccatgctccgtgctggctgacgatactaccgaggagcggctatgcccgtgcacaagcggaagcacgccacccaaccaggtccctcggacctgggcgtcgcgcgcccctcccgaggcctcggagagggtaggtatggaaattgtttgcacgtcaagggggactcctgagcatcgcgacttaggagcctaactggtcacgtagcccctcactccttggtccatcccggtctccggtcggcccaatggcggttgagatatgcgtgtgaccgggctctgccaacgtagaacattaatctatcatcacgaactctccctatatgttgtttgcgcgtcaagggggactcttgagcatcgcgactcaagagcctaactggtcacatagcccctcactccttggtctgtcctggtctccggtcggcccaatggcggttgaggtatgtgcggggccgggctctactgacgcagaacgcaaagcaaataggaaggaaatcaccaaatctcgaagcaaatattacaagcatattgttctcacaataccaaatgaaaagtataaacgcctccatgaggcctgatgcatgtcgtaggaaagaaacgggaagagtagccgcatgtcacccctggatatcgccatcgcccgcggaaggagctccctcatgggcaacgatgttctcaccttcatcaccagtcgtaggacccgtggcatcgccagac

SEQ ID NO: 73904 - DNA, 717 bp, Triticum aestivum
  Clone ID: PAT_TA_73904
gaggctttgttgtctagggtcgccgcccgccgccgccgccgccggccaagctaccctttaccaagtcccgcaccgccacacccaaactttagtaagcgaccgacaaacaggcatgtcgacggagaggatccggtggggcagtgaatcagcgatgcagccatctatgtatgattcaagaaacaaaaatattacgtatatctgctaatctttggtgtttatttataatttcgtagccccgagttgctatctgtgtgctacatccgaccaactatcgtcatgttattcgggatttgaagaactacgtccttgaggtaaaaattttgtgccaacttgctcttgggaaattgctgttgtgtgggttggtcatcacggaaatttttccgttgttgtaaagtggtgctcacctgcaccttgtaccttcaatactcgttccacaagcaaattactaaattgattcggctactgtgtcaaaaataaataaaaaacgaaagggattccactctgttttgctaatattttcagggagactttccaggacgaaatcaagcaaacctgcaggtggagcaataccaagaccctccttgtgatgctggattcaggaatggtcaacatgttgatcacaccactattccagcttctaacagtgagagggacattctgggagcaaatcaagcagaccagatggcagtgcaacacgagggacattatttagttcac

SEQ ID NO: 73905 - DNA, 726 bp, Triticum aestivum
  Clone ID: PAT_TA_73905
cggcacgagggccaaaggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgggatcctctccatggccaacgcgggccccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaagtcgtcatcgccgactgcggccagctctagatccgtccgcccgccggtcgcctgtcgtcgtcgccccgtgtcccgtgtcgtcgatctaaataagagagtcgtgtgtcgtgtcgtgtcttccccttgtccgtccgatgagatctccgtggttgg

SEQ ID NO: 73906 - DNA, 559 bp, Triticum aestivum
  Clone ID: PAT_TA_73906
cggcacgaggggcacctcgcctccgcctcccagtcccaggcgctgcatgggcaaggccttctccctcctgcgcccggagccacagacgcagggagagccgggggaggggatggcgatggagctgaggaagcgcccgcggccgcggcgcctcgaccccgacttcgtctcgtcgccgccgcccacgccgcccaggaagcggccgcggaagcaggacgcggagaggaagcagccacggcggcccgcggcggcgaagaggcagccagcgccgagcaagagggccaggtgcgcgcagcagggcatcgggagccccgtcgccgggctccagccttccaggtgctgcaggatcgtggcgccgctgtcgcgcgtctccttcatcccccgctctcgcgtccccttcaactggtatgagccggacatctggacggaggtggccaagcacctgcacggcgctgacctgctgaggctctccgccacctgcctctggttcttccgcctcctctacgaggactccatctggcgctacgccttcctccgcgacctctcgctccacaccaacgat

SEQ ID NO: 73907 - DNA, 479 bp, Triticum aestivum
  Clone ID: PAT_TA_73907
cggcacgagggtgccgttccccagcggcgtcaccgccggcgcctcaatccccataccccatgccccccgcccccacccaccacggcctctcacgcgcgcggccgccatcgccgttcccgttcttcctcgtcgggacatcgcgttcctgccgtctccaccccgtccgcagttgagttttgaggcgcgcgcccggcagaacttctagattcgcccccgcggcggcgcccgacatgtcgaccccctccggccccggggaagccgacggagccacgcccgctgcctctacgtattacgacgtcttcggccccgacgctaaacctgatgttatttttaaggaggccacttcagattccacattgaatctgcaggatgtccaggggctagtaacttgggttattggtgaaggcatgccgccttcatgggtgtttgttaaaaacaagcctcttatcccaaaagttatccttctctatgttcctggc

SEQ ID NO: 73908 - DNA, 518 bp, Triticum aestivum
  Clone ID: PAT_TA_73908
gacagggggaccgctcgctccttccgttgcttcgatgtctccgagcttaagcgccgcgtcctggccggcctctctaagaaccccaacacggacacgcagtggaggtacctggtcctgggcgaagcttgctttcacctgggcctcatcgaagatgccatggttcttctccagaccggccgccgcctcgcctcggcggctttccgccgcgagagcgtttgttggtcggaggacagcttctcatcatcgactgtcgccgcagctgttgcctcggtgccgtcgggcaacgcttccaagtccgggtcggcgttcatcataccggccgtggagtcggaggccatgtcccagctcctggctcacgtgaagctcctgctccgccgccgcacggacgccatggcggccctcgacgcgggcctcccagcggaggccgtccgccatttctccaagatactcgaggcacgccgtggcgtgctcccgcacaccttcaccgccgcgtgcctcgtcggccgcgccgcgtcatt

SEQ ID NO: 73909 - DNA, 764 bp, Triticum aestivum
  Clone ID: PAT_TA_73909
gaggccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcacggtgtacccatctccccaggtctccacctctgttgttgagccatacaacagtgtcctgtccacccactcactccttgagcacactgatgtctctatccttcttgacaatgaggccatctatgacatctgccgccgctcccttgacattgagcgcccaacatacaccaaccctcacaggcttgtttc

SEQ ID NO: 73910 - DNA, 570 bp, Triticum aestivum
  Clone ID: PAT_TA_73910
cggcacgagggtggctaccgcgccggcggagcggggggcgtgcaggccatgtcgcagtgcgtgggggacctcgacgccaaggcctgctccgactgcgtctcggccgcggccgcgcagctcaaggccgggtgcggctacgcctccgccggcgaagtgtacctcggcaagtgctacgcgcgcttctggtccaacggtggcggcttcgtcagcggcgcaagctcgggaaatggatacggatttgggccgcgcatgaacggtgagcggctggctctcgccgtcggcggtttcttcgcttcgttggcctacttttcagttctactcgtctagttacggttgctgcatggggttgagatcaatgttagctatgctgtgttattgccaacaccaacatgtatgtcgcgtattgaattacatacagtgtagttttgctcttgtgtgtagcaaaactatcatgttcgtacgtataagttgtaacttagccgggtttccaaagtgtttaactgtaaatctgatctgatgaagcattgttttacttgctatatttagtcgtaaaaaaaaaaaaaaaaaaaa

SEQ ID NO: 73911 - DNA, 745 bp, Triticum aestivum
  Clone ID: PAT_TA_73911
gcctcccgtcgggcgtggcgagcacggggcatggccatgccgctccacaacggcgtgcgcgaccaaggcatccctgcatgagccgcgagcacgggcgtggccagagcgctccacggcggcgcgcgcggccggggcctcccggccggcacgtgcgcgactagggcactccaccactacactcccccttgtacggtggcgaccagggcctctggcggtcgccccaagcacgagttcccaaccaaaacgcgttggatccaggggcgatagaggcctggggcagctcggcgatgtcggggcggcgctgcgagctcgagttcatccatggcggcgggcatggcagttggtcctgtttgacagagagggaaatcagggaggaatgaggagaagaaaaagaaaggggcggcgaggggagctccagcggcttgacagtggcggccaggtctcggatgtccgtcgaccagcaagggccgcgagccgcgctggtggcgtgcagtgcgctgataagcgcccatttcgtgtttgttgaaatgcccacaagaaaatgattttttttgaatggagacaaacaaatgagtcacttacaggtgggacccttgtccacacaaacatgccacgtcaacatgacaggtgggcccaacttgtcagtttcactatttttgtgtgcttatcagacaatcaatgctccccgtttgtcattaagcacataattggtggttcttgtgccctctctaaaagtggtactaaa

SEQ ID NO: 73912 - DNA, 575 bp, Triticum aestivum
  Clone ID: PAT_TA_73912
cggcacgagggtcaccaaagtcgcagctcaagtcgtagctcaagcccaagccgtccttggtcaacttatttcagctgtcgaaggtgtcatctcccaagtcactgaagtcattgctcaactcactactcaagccacaaccactgttaatggcgctaccagtatcgttggcgatatcaccgttcagttgacagctgtcatcagtgtagctgttgaagttgtttccggtctagttggccaagtatctggcatcctcagcggcgttaccggactcctcagcaccgacgttgttggtcaaattaccggaaccgttttctcttctttggacgtcgttttcagcgtaactgctcaagtcaccgttgtaatttccactgttaccgatgttgtcagtggtttgactggcgttctcggcggactcagtggtggaatcggtggatcaactggcggttcatccggtggaccatgcccatgcagcggttaattcacaacgtacacacaattattggtacgaaaatggcctgtctctggaacatttagtttgtaagcgcattccgaaaaagcaaaaaaaaaaaaaaaaa

SEQ ID NO: 73913 - DNA, 568 bp, Triticum aestivum
  Clone ID: PAT_TA_73913
ttttttttttttttttttgtaaaaataaagaatttcacctcaaacattaaaccaagtcaaaccacaaagatgtttacaacaagattcttcaacacacagaaagcgaaagcaaagagacaaatctgaagaacatgatgaaaagtcaaacactcatttaagcagagtcttgacaatggacttaacattcagctttttgagatcggtatacgactgtccacatcccacaaacatcacaggcgatcccgatatgtaaaccatcgataatgcagccccaaccttgtcatcgatggtatcaaactttgtaagcaggatcccatcaatcaacctagggctgggagaaggtgagaggtcggctagcttctgattgaacttggagagctgatccaccgcatcgttccccaccagagcttcccccacaaaaagcaccaagtccgggctgttcacatatatcagcttcgacagtgcacgcatcagcggttcattgtcctgcattcgaccagctgtgtcaacaaggacaacatcggatccgttacgggcagcttcctgaattgcttccttagcaacaatt

SEQ ID NO: 73914 - DNA, 731 bp, Triticum aestivum
  Clone ID: PAT_TA_73914
ttcggcacgaggccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgccgtcgtcgtcatcgccccgtgtgtcccgtgtcgtgtcgtcgatctaaataagagagtcgtgtgtcgtgtcttcccctggtccgtccgatgagatctccgtggttggtt

SEQ ID NO: 73915 - DNA, 493 bp, Triticum aestivum
  Clone ID: PAT_TA_73915
ccggcatcccgacgcttggcgatcgttgcagcggctgtactaatgctgtgtgctgcgcaagttgagcttgtccatggaggtaatttagcatgcctaatcacatgtctgtgaatctccatgcctcctttgaactctctgttatgtgatcacgttgcgcctgcaggtggaaggccgtggcgaaaacctccggctcccatagcgaacgggttgaaaggtagtcgtgtctgcaatccagattattatccctgcaaaggcgacaacccgtcactgcggccgccgattccttcttctcctgccgcagcagcagatgtacctcctcctggtcctggcagcccgacgtaatacagctttgctaattcctacttttgagttgcgcagcaggccagccgcagacaattcaccatttactacccatgttaattagctgaacagacgacacatgcttgattacagaagatgctgctcagagttcacacgccaagacaaaaaagag

SEQ ID NO: 73916 - DNA, 624 bp, Triticum aestivum
  Clone ID: PAT_TA_73916
ttatacgtttatggagcctcgtgtcagcaattatccaaaaactacagggttgttgacagctcaaacctcggccaacatggtcggtcggaaccatcatgagctagcaggcagctgaggtctgcacaggcttgctacgggcaaaaacgttagatgcggctaatgcatgtaggcgaagggtttctttctgttatgcggcgtcatagacaagtacagcggctagcgacgatttattcagtgcgaagagtcattatggcagcagctggtagatgaacttcagtgacagcaatgcatgcaaatcaagtgtttttgtgtcgtgttattaaggacaacagctaggaagaatacattcaggttattagtttacaacttgatctcttcgccttcttcttcattttaattctttttattacgtgaataacattttatgttattaagagtcagagctatagtgagcagtttgttttgtacagccatgagatgcaacatttttttttactttttactgttagtcatcagtttgtttttacttttttttgccgcattagtatgtttgtagcagactagtagtaccagattatgtgatgttataaaagttgttcatttcctatcaattttccttaacat

SEQ ID NO: 73917 - DNA, 627 bp, Triticum aestivum
  Clone ID: PAT_TA_73917
ctctaatgtgaagaagcagccatcgtcgctgattaagatccgcagcctggatcactggaccatgatgatcgagcaggaggacaacaagctgctcgtgattgagttcaccgcgagctggtgcagggcatccgacaccatagctcccttttttgctcatctcgccaaccagtttccagatgccatttttctcgaggttgatattgatgatatgaagtatattgccgaggcatacaaagttgatggtgcgccgatgttcctgttcatgaacaggctagaggttaaggacacgcttcgtggcgcacacaaggatgagctgcttgagaagattcagcggcagatggcccggcttgtggacaaatgatacggcgcttgctccccccggcattcatatccttggtcgccggccgtatcatgcatccggcgtacactgttccgtgagctgatttgatcctttctttcgcttgtttgatttggatttcatctttaggacaaattattgcctaataaggccgtttgattccttacaatgtgtgtccgtcagactgcagtaatgattaatagtcctaataatactgtaagccccgacattgtttgcgtctgtggcatattaaaaaaaaaaaaaaaaaa

SEQ ID NO: 73918 - DNA, 588 bp, Triticum aestivum
  Clone ID: PAT_TA_73918
gattcggcacgagggctttgcattatgctttgacaaagataaaagagcaggaattacaaattgaacggctacaaaagaatactggaggtgtgacaatggctgctcaatctgaaaaagaagtcgaacaattacgaaaggaaaaaagtgatttgcaaatcaaacttcaagctatggaacacgcaatgcaacaacagcagaagcgactccaaaatgaaatacaagagcaaaaagttgaaattgaacaattgcgaaagaatgctgaagatcttgctgtagctgcacaatctgaaaaagaagttgaaaaattgaaaaaggaaaaatatgatttggaaagcaaacttttcattatgagacaagagatgcaacaaaaagaacgtgaatgtcgagaagctattgaagagcagatgcgactccgagctgaaaatgatgttccaaggctatggtggtgattcaacaaatgaaaaaatctcatccttttttatagaagaaatatagaatttattgtttttaagaatcttaatttgttttctttttttgctgtgtattatactcgttttttatttttaccatataatcaccaataaattg

SEQ ID NO: 73919 - DNA, 740 bp, Triticum aestivum
  Clone ID: PAT_TA_73919
tcggcacgaggcgactggcctcacacctgtaacgtgcagaccccgctctcgctccccatcagctcctactgtgatgtgacctccggttcggagtcggcgctgcaggacgccgttgcgcagcagcccgtgtcggtcgccattgaggccgatcagtcgtgtttccagttctactccggcggtgtgatgtctgacccgtcgtgtggcacgcagctcgaccacggtgtgttggccgttggcttcggcgtgaccggtggcaccaaatactggaacgtcaagaactcgtggggcacgtcgtggggccagaacggctacatctggctcggccgtgacgtggctggccagcccctgggtgtgtgcggtattgcgtcggagccgtcgttcccgtacggtggcaagtcgctcggcggccaggcccacgccacccgccaccaccgcaagcactaaaccgactgcaaaacgccttcggaatcgacgttgcacgtcgcattcgttgcgctctgctgtgccacgtttagcttgattggtgggccgcacgcatcgctcgacgcgttatgttgatggccggtgacgcggcgtgaactcggcagttcattggttgctagcgctggtgttgccattcacagttcacgtcacccaccggcgttatccatacgcgccgctgcgctgtctgccccgctctttattcgaactctttgtgtgttcgcattcctaccttactgttatacaaaaaaaaaaaaaaa

SEQ ID NO: 73920 - DNA, 692 bp, Triticum aestivum
  Clone ID: PAT_TA_73920
gattcggacgaggcgacggtactcgtggtggccgccatggcgccgctctacttcgccctgggcctcggctacggctcggtgcggtggtggaagctcttcacgccggaccagtgcgacgccgtgaaccgcctcgtggcctacttcgcggtgcccttcttcgccttcgacttcgccgcgcgcatggacccctacgcgctcaactaccgcgtcctcgccgccgacgcgctctccaagctcgccgtcgcgctggcgctcgccgcctgggccgccgcgtccacgcgctgctgccgcgccggcgccaagcgcggcggggagctggcctcctcgtggtgcatcaccggcttctcgctggcgacgctgaacaacacgctcgtggtgggcgtgccgctgctggacgccatgtacggcgggtgggcgcgagacctcgtcgtgcagatatcggtggtgcagatcatcgtctactttccgctgctgctgctggcgttcgaggcgaggcgtgcgtgcggtggtggcgcagggaagcctgacgcggcggtggcggtttcagcgagcgacgacgacgtggaggacggcggcgcggaggggaggaggcggcgcgagccggtatggccgttggtgagagcggtctggctcaaggtggcacggaatcccaacgtttacgcgggcgtcctcggggtcgcctggtcttgcgt

SEQ ID NO: 73921 - DNA, 626 bp, Triticum aestivum
  Clone ID: PAT_TA_73921
atcggccaggccggcatccaggtctggaacgcgtgctgggagctctactgcctcgagcatggcattcagcctgatggcaagatgcccggtgacaagacccttggctcgcttctcctggagcgcctctctgttgactatggaaagaagtccaagcttgggttcacggtgtacccatctccccaggtctccacctctgttgttgagccatacaacagtgtcctgtccacccactcactccttgagcacactgatgtctctatccttcttgacaatgaggccatctatgacatctgccgccgctcccttgacattgagcgcccaacatacaccaacctcaacaggcttgtttctcaggtcatttcatcactgacagcttccctgaggtttgatggtgctctgaatgttgatgtcaatgaattccagaccaacttggtgccctacccgaggatccacttcatgctttcctcctatgccccagtgatctcagctgagaaggcttaccatgagcagctgtccgttgctgagatcaccaacagcgcctttgagccttcgtccatgatggccaagtgcgacccccgccacggcaagtacatggcctgctgtctcatgtaccgtggtgatgttgt

SEQ ID NO: 73922 - DNA, 657 bp, Triticum aestivum
  Clone ID: PAT_TA_73922
tccatccgcccctcgttgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtggcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgttgggt

SEQ ID NO: 73923 - DNA, 578 bp, Triticum aestivum
  Clone ID: PAT_TA_73923
tcctcccacccccaccgtctcgccgtcgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatc

SEQ ID NO: 73924 - DNA, 568 bp, Triticum aestivum
  Clone ID: PAT_TA_73924
cggcacgagggccgcgacagtcctccccattccagttacagcgcggctacgcctcagccaacggatcccgcgtcgtcgagtccccagccgcactccaggccgcgccgtccgggctgccgcgagcttccgccgacgccccacgccgtcgacgagcctctcccagtcgtcccaagccgccacgagcctccctcgccatagcgctcctctgctgctgtccccgcagcgacgagcttccgccgacgcccagcacctgtcttgctcggtcccgccgacgccacgcctcctgccgcgtacaagtaaattgcttgcgaactccctttcttttttgataattctttttccatcgggtaggccgggtatgtctagcccacgcaaaactttcggattttaagaatgattaaaaaaatgtaaaaggcccatgcttccggcccaacagcgagcccgtcacctgtgccctgtctctgtcgctcgtgctgtcctcttccaatcgagtcgagctatcgatccaggcaaacgccgccgccgccgccgcgccgcctgcccgccttccgcctccacgactggcccg

SEQ ID NO: 73925 - DNA, 520 bp, Triticum aestivum
  Clone ID: PAT_TA_73925
cgtttaatctggaaacctcgccgcttaccgctgccgctgccgttctgcaatcgggctgtggtttataaatagaccgtatttcttgccatatcattatctccatggtagctccttcctcctgtcgtaatggcccgcggcgttcgggtcggcctcctcggtcgcggggggctgtggttggccggcgtggtggccgttctgctacgtctgcccgtggtgtccgctcaagccgtatgtatggagcatgctccgccgtctgatgatcggccgttgtgttggggtggccgctctgtacagccttccggttctggatgagcggcagattttgtggcgcaatctgggtcttgttctctgtcatcggactctgctgttggtggttcttgtgggtagcggagggaggagattcggttgggaaagcgggcctgttgatcccactctcaatcgacgacgaacaacagagaagcgaaccggcgaagcaagcagcacatcggggggaggtggtcacttgcaagtcaaccgcgcg

SEQ ID NO: 73926 - DNA, 649 bp, Triticum aestivum
  unsure (1)..(649): unsure at all n locations
  Clone ID: PAT_TA_73926
cgcaaatcagattacttgttatcaaacaacttacacacctcaaaccctcaaagagaaaaaaaaactcgaacacccctcaangaaaaaatctgacaactcagacatgttgcaaaaatttgctttcatgcatctagcaaaattaccatgctatatagccatggttgcagcaagttcatcgcaatggaagatgggatattgctgactacagaaactctagatcttccttctgctgctccagaacaactgtggcaagtgcccgtctatacgccgctgatctcgcgttcctgacaagaacacagatctcttgacccagcatactcttttcattccattgctcttgccgcaacgccgccagaagccttgcatcacagaacgcaaccgcagcaccatccttcccagtgcttccatgtatgaaaccagtcgtgacaaaacctatcggccatctcaatgctttccctgtggtgtcatctttgggacccagacatggaaaataagaactgatatgggactgtgggagctggactttccatttttctagacattgttcctcatcctcctctgatctggttttccaagctgtaagatctgataaaaatggggcacaaactacagcgccatcttcaaagaaaccttccttgaacactcgaat

SEQ ID NO: 73927 - DNA, 508 bp, Triticum aestivum
  Clone ID: PAT_TA_73927
cacattgagcatggtttcaaggaaacaatttacaccaatgttgagctttactgtttgtggtaaaaccaactgtagcatgtacaaacagagactgtatcgtgtacaaacaaagacgctaatgagttcgctaagatttttctgtacatttaccaaccgctactactagcggcagttcagctgcagatgacttaggtaacctccatcatacaatgccctctgcagatcacacagtaaccttggataatctttcatgaccatctgaacaaaaaaactggagatcacgcctcgactgatgcttcgagctgttccagatgagcctgaggagtcctcttacatcgtactcatagaagacacggttcccattcttatcaagatagtaatatgtcttcaggagcattttgcatcttggtaatgaccagccatcaaagtgagacaaagatgctgacaaagcactccaccccttcgtactttcaatgctgctgaacaactggtacatcactacgaatgt

SEQ ID NO: 73928 - DNA, 418 bp, Triticum aestivum
  Clone ID: PAT_TA_73928
tataaaactcattacatgtatgagactgagatttagcatgatatgatgctacaagcgaagggacatagagatagattggtgcatgaagtggctgcttgtcatagcgattgctgaagaagcatcagcccaatcttcagatgcatgcatcgctgcccgtacaagttccagcacgaaggagcacggacggacacaggtggggcacttggactgctgaagcagtagccagagcaatgtcctacggagggccgcgaccgtagctggacagcaacgtgcaagggacgcggcgtcggatgcgcgtgggatggccggctgcggcgagtgggatttggccgaaggctcgcgctgcaagtagcctggccacgcgcacgcatggtggagcgacggtggcaccatgggcaggtcacgcgggcgccatggg

SEQ ID NO: 73929 - DNA, 508 bp, Triticum aestivum
  Clone ID: PAT_TA_73929
gccaatgaaatccattcattgtgtattgcactatggaacacagccaatagtaattattacatttaatggtgaaaatacatgtcagttaagtaaaaaaggaacacaaattagaacatagcatgaccggtaagggcactctcaaatcatcttaaacacatatgtatctccaaattcacatagatagatatctaattagttcacaaacatggcttaaactccagtgcatatagccagaatcatcagccctccgcatggcaaaaatctaccggatcacaaatcataaaattgcaaagttatatgctgccatcttgtatccataatatttgttatcccatcttttctcttggccgatgacccacatctgtggagtaataaaaccgatgacatccgacattggtaagccggctctgatgtgcgctgatgatatgggccgatgtgatcgagattttgtaccaacggcgttcgtctatatgagcacatttattgcacaacggcttcctatcgctta

SEQ ID NO: 73930 - DNA, 465 bp, Triticum aestivum
  Clone ID: PAT_TA_73930
atcgcttgtaaaagattacagtgcgagctaggtatagcgtttctgttcgggcaaaaaaagctaaaactaccagatttacgcgggtcagcaattttgtggcatctgctagagcttctctaaggactctctagctcacactgtatgaggctagaaccttctaagtggctgctccaaatcagccgactgatttcttccagaaatagttggctcgttggccgccttcaaccgttggatacgacaacacactagatggaaatttggccgtccttccctcgcgaccaaaaacagcagagaaatccccttgaatctcactcccaccacaggtacacgaaaaaggctcactccaagggcggtgagttccggcgagggattcggcagtctcccctactacagtgcaactccaagaccgccgacgaccgctgcatcgcatcatcaagagccactgtggtgctgctctgtggcaac

SEQ ID NO: 73931 - DNA, 458 bp, Triticum aestivum
  Clone ID: PAT_TA_73931
gatcaataagatcaacatgtcatcagctacatacgaaaatactacatagacgaaggttagcaaggtggaaatgcaccgacaatgtgccaaaaaccctcgtgttcacatgtcttcaggtcatcatatagtttggcgagcccgaaatctgagatcttaggattgagattggccttgatgtccctgtgcgcaacacaaatgctagattcttcatgaagataagccaaacctcttgcaacgcctaagcatatcgcaaaacgtgtgggccagtccaggcttgacttccatttgcatgcaaatgtaggtttaagtccttacttgtctatacaaagcccgattctgcagatttttagctgcatcaatgaaaagaatctgtaccaaatagggcatggtccaggctcccattctccgggtactcataaccagcatcaaccatacaacttcgcaagattacggtgttg

SEQ ID NO: 73932 - DNA, 426 bp, Triticum aestivum
  unsure (1)..(426): unsure at all n locations
  Clone ID: PAT_TA_73932
attggacggcattcatctttttgttgatgacaaagtagtagaatttcataaaaaggggaaaatgatcccatcactgtgacgttttcataaaaaggttggtcatgatgttgggcagcttcatgagcctcccgtcgtcctgcgccgggtccaccgccgacggggactggtcgtcggacctcccctccgagtcgccgttccagcccatgaagtcgagcagcgtcatgctgtctgcaccatcggggacctgggggggcgcctccganatcgagccgggcggcgcgtccttcttggccttctccctggccacgttgtcggcgacgatcacgtcctctatcctggacatgacgttgaaggccaggctctcgaggatcctggagtagctctccaggagagcaaatcccacgtccctgttttcttgtatctttg

SEQ ID NO: 73933 - DNA, 481 bp, Triticum aestivum
  Clone ID: PAT_TA_73933
aacatacgagaccgacttcaatcttcagaggaacgcagttacgcagataagcatactttgttcttacaatgcgcctcaactcactaaatcttcagcggcagaaagtaccaaccaacgaaagcatgcctcgccgatcacaaacacgtggcggcgtcattgttttcatcaacaggcgcggcacattctcgccacagatgtcagtgagagatcatggaagctttgtgacgacgagtggcatgccgaacccgggctcgatggtgagccggaacagcggcgcgtgccggtaccccggcgacggcgagaaggcgaacttgctcagcaggcgaacgagcaccaccttgagctccaccatcgccaggttctgccccgcgcaaatcctgggcccgtgcccgaacggcaggtacatgtgcgacggctcgcacgccgccgcggcaccgttcgtgaaccggtccggacggaactcgccggcgtcctggcccca

SEQ ID NO: 73934 - DNA, 619 bp, Triticum aestivum
  Clone ID: PAT_TA_73934
tgcgacgtttcccgacattttattcacatgttgaactatattttcgtgaatactccacactgcactaattttacagctaaaatcgtgatttggtttggttcaacgtgataatacttcagatgtagttcaacatctcttttgtccttcttgaaaaaaggttgaatcaccccttcacaaagtgtggttgagttgtaggcatagtgtaaaactggatcggcccatcggtttgattggaaaagagaagaaaccaggggccccatatgttcatttaagcttcacgtaccgtttccaccatcagatgggtgaaacgaggtgaaccgggcagttttctgcagaatcggacaataaacttggcaggttgaaccagatgaatcccgaaaaatatatttggaaaagtgggattcaaaccctgcaattgagtgaccagcatgtcaacatcatactgataccagttctctcctgtgagtacctccatgattattataccaagactatagatatcaagctggtgtgtgatttcaccgttaccacattctggtgcagaatatctcaatgttccgcgtatgtttacagtaaaagtctggctttgcattggacgaaagcaccttgatagaccgaa

SEQ ID NO: 73935 - DNA, 333 bp, Triticum aestivum
  Clone ID: PAT_TA_73935
ggacacacacacactacaccatcataatacggagatttctggcaatagctgtcagagagccaaattttggggacgattcttatatctaactaatccccatcatacagattgcctgcaactcaagcagtcatccctcttattttcctttgctgccattgccgctttcgtcatcatcaacatggaagaggtccaggcggctgtggcttaggcggagcgagtacattgctgtcttgtactcggcccaggtgaatgaccggtaccggggtggtgagccggctgtgaccatctctgggagcgccgagattcgtgcatgcagtggtggggctgcaaagt

SEQ ID NO: 73936 - DNA, 504 bp, Triticum aestivum
  Clone ID: PAT_TA_73936
cgaatgtttgttgctttattcgaaatctccttttctcaccattttcattttatcagtcatgcgagttgaagtcatatacacgacagaatttcatacaatggtaatcaatataataatatgtatttataaagatagcgttatgagtaaaagtgctctggacgtaacgtacaatgataaaaatatggacagcgttttggtcggtggtgcagctactggtttctgccgttgctgtccgaagaccatgccctgcgggatggtctggtagaacgcgtgtaggctcctgtgccttgagaatggtcggacaatttattcctcttcctcctcttcctcttcctcctcctcttcctcttcttcctcctcctcagcggcctcctcctcctcctcttcctcctcttcttcctcctcctctgcggcacccgcaggctcgtctaggtcttcatcggcgcctcccttcatctcctcctcctcggggctgtctggggcgcccttcttcttgccgggcct

SEQ ID NO: 73937 - DNA, 532 bp, Triticum aestivum
  Clone ID: PAT_TA_73937
aaatgtcaacgaccacacatttagaaaggaaaaagaaatttctctaaacatcacacagaggtgtctgcaaaccataaaaagaaaaatgtacagcaccgttaagtcgtggagtatcaacttcccattaatttagctaccctaggtccagcaactgagcaaagaaaccctttgtaattccaagcaacagagggcgggaactgaagcaaaccaacctaacaatatggccaagaaagaaagaaaccaatcaacctaacattctgcaaatatcctaggatgttcggcctgtgcaccgacagattttcctgcaaaccagtggtgcaagaccgcatgggaacagggctacagctgctgctcctttggcaaacgaacattaccagaagatcctacaatatgttcggcacatgcgacgagagtttttcctgcaattccctgatctgagaacagagctcgaccttctgctccttgtagctgtgaagcaagaagtctttccctccgataacttccttcagctcacccacctccctcttgagca

SEQ ID NO: 73938 - DNA, 590 bp, Triticum aestivum
  Clone ID: PAT_TA_73938
acatcgttcaaaatgagaaaaaaattaaagggcacatcatttgtactccattgtatcatgtgaagaaatggtatcaaatagttggcctatacacacaagctattatttacacattattatctgggaaatgagcaggtttctttccagtgtgggcgagattctttgtgcagcatgatgtcattggaccttgacagcatttcactgaatggcttgcctcatcttggtaatagttgggtgctttatcaacttcaatctgttggtacaccacttacttgagcttttccattaatggtgactttactgactcagaacacattgcagctgaactgagcaattatgtgctattcttgaagcttcttgacttccttttggggtaccactcagcatgtctcactaatgttgcagtcttgctccttgcaattcaatatcttcacagaagcggactgccaaacactgagaaggagtagctggggggaaatcttcagctggcattgcaaacgggcgggtcattttatcaaatttgtctaaggtcagatatgaaccaacttcttgcaatcgctccggttccataatttgcattgtgtggtcat

SEQ ID NO: 73939 - DNA, 507 bp, Triticum aestivum
  Clone ID: PAT_TA_73939
tctccataatagctatcatctatggcatttgtttatatcaaacatgcctaaaacattatttatattgaatccacataacaagtatttatggcaaggagcaccgtcacatagattaaagaaataagagggattaatcaatagttcaacactaaagcactgatcacttccatggttgtagaagcaagtggcaatgcgtcaagtctttaaggctgtgttcggcaatcctctcctccttctccttcaccagggagcggagcgtgcggagcaacctgttggccgctcctcaaatttatactgtatggagctccgctctgcaggggagttactgatcacttccatggtcgtagaagcaagtggcaatgcgtcaagtctttaaggctgggttcggcaatcctctactcctcctccttcaccagagagcggagcgtgcagagcaacctgttggccgctcctcaaatttatactgtatggagctccgctctgcaggggagttacggagcggaggga

SEQ ID NO: 73940 - DNA, 485 bp, Triticum aestivum
  Clone ID: PAT_TA_73940
gtatccagaatacatgagacctatcatagccatcacagacaagacgaaggagaatgtgctggctattatgaatgcatcaaatgcatacctcccggcaagtgttggtgttcctccattaatatgttcatcagctctgtaacctccaggaagggcaaaagtaacagtaaacgtcgcagttgcaactagagccacaccaatacatagtgtttgtgttggttctttcaacttttctaattgttccgtttcatcatattttaactgacgagtgtagttttcttcaaagtgatcacgacgactgccaccactcctagcattaacaactgtcagtgcaaagtgtatcttcgcttcactgttctgttcatcaaaaaatcctgggggaaccccatatggtgatatatctagaggagtttgccccatattatttgataaattcaaatgtgtttgtcgattccctaacaaagcacaaaacattcgaagactccgtg

SEQ ID NO: 73941 - DNA, 569 bp, Triticum aestivum
  unsure (1)..(569): unsure at all n locations
  Clone ID: PAT_TA_73941
ttgaatgagaaaatatacaataaattctggcacccaccgcctgtacaatggagcttgatagcacaaagggattttagggcgtcttgtagaattcaccaagcttccgcctctgggtgcaataattttggcaatattgaaggcgtaaaggtccctcctcaaacccaaatcaccacatctctctggtttcagcaagatctccttcccgngaagagccagtgcatcttgcgctcatcatctcgactaaaaaccggcattatcatcgtataagatggaagcatcgacattgcatacatgcgactgtcttgagcacttaaaatcgtaaccccattcatcaatcaactgagtaagacagataaacgaatttgcccccaggtggaggcagcaatccagtacttgtgccacagctgcagcagctggcatgagatagctggagatgctagtggtcatgtaggagctgggtctttgcctgtcgaattcctgcacgtccagcaacatcttctggttgaggtcaagagcaatcaccttcgacggcatgttgttggtgttttcgctgctggcattggtcaaga

SEQ ID NO: 73942 - DNA, 657 bp, Triticum aestivum
  Clone ID: PAT_TA_73942
gattcggcacgaggattcccttctcctcctcgtctcctctctgctgccccttgctctctctatccatcttgctcttccagatcttcgatttctccctcaccgtgatcctccctctcctgatcctctttttccccggcccctcatctatgcccccagtcctctgattcatatagtggcctgctgctgcccccacttttattgcttcaaatctcagcctaatccggggagagttttgcactagctcgctctcatccatgtcgccccagatccggcacagctctgcagtgcggcgagtctgcgtgtttcgaacttttaaggcttgaatcagctgcgcctagattggtgctaagtccagtccttctccgcgtgataggagttgaggcagttcgtgcccatccaaagtttcgctatctcctgttgtcgtggtttggccgtccgtcagttagccgctgccagtctcatccttggaggactgttagtcaagctaggcggcgtaagacgccatgagagcaattgcttgaaattgtcgaggtatgggtcggcggctcggcaatgatcgtatgctgttcctggccaacttgatccgatctactaaagcgcaggtaacttttgtttcagaaatcaagtcttctaaagttcgttctgtagatcttgtta

SEQ ID NO: 73943 - DNA, 467 bp, Triticum aestivum
  Clone ID: PAT_TA_73943
agcagcccagcggcatcatacccctccctcccacccaccggcgccgcgctgcagacgcaaacggccaaaggcgagcggcgtggggcggagcgcggggcaatggggaagtacatgcgcaagtgcagggcggaggacggcgcggtgggcggcgtggaggtcacgcaggccgtcggcgtccgcacccggtcccgcgcggccgcggccaacgtcgtcgtctccaagaggaggcgcccgctgccgcccggctcgccgtcggcctcgtcgtccctcgctcgcgcccagggcgggagctgctacctgaagctgcggagccgcatgctgttcatggccccgccggcgcccgcatcgggggctgccgccgggcacgggccggcgccgccgctcccggccggcctgtcgcgctgctccagcacggcgtcgtccgtggacgcgtcggccgcggcgcaggacaggagcctgccctcgtg

SEQ ID NO: 73944 - DNA, 574 bp, Triticum aestivum
  Clone ID: PAT_TA_73944
cccaaccgcaactactggctcgcctccaacgtggtgagccgcaagcccggcacgcccaccggcaccgccgtgctcagctactacggcggccgcagcagcccgcgcgcgccgccgcccacggcgccccccgccggccctgcctggaacgacagcgcataccgcatcggccagagcctggccacggtggcgcacccggagcacgcgcacccgccgccgccgcgcgccgaccggaccatcctcctcctcaactcgcagaacaagatcgacggccggatcaagtgggccatcaacaacgtctccttcacgctgccgcacacgccttacctggtggccctgaagcacggcctgctgggcgacttcgaccagcgcccgccgccggagacgtacaaccacaccgggtacgacgtgtacggcgtgcaggccaaccccaacgccaccaccagcgacgggctgtaccggctggcgttcgggtccgtggtggacgtggtgctgcagaacgccaacatgctggcgcccaacaacagcgagacccacccgtggcacctccacggccacgacttctggacgctcgggt

SEQ ID NO: 73945 - DNA, 663 bp, Triticum aestivum
  Clone ID: PAT_TA_73945
tggagtaaaatttagagcacaaaaagtttcagtcaactggtgaacgctctctgaagtgtaatttaaaagatataaagtggcacgggaagagtggagcgtgtccagctgattgagatcatctcgtgaagagtagtgtttttgccctcttatggagatttgaaagtgcaattaccccaaagaagtgcagttaactaatgaacacgtgttgtaagcaggtccaagttcattagttttgaaaatcaaacaaatcagtgaaagtccagtagtgttggattagtatatgattatatgaatagacgggccatctagactaagcagaccgaaaccaaaagcaagaaggcacaacacgcactgtctgaaactatgcagggctatctaatccttaacaaaagtaatgtcaccgccgggctcctgtgcgagcatcacagaagtgatcgtgctccggcgatggtgacgccgtcatcgtcgtcattatcggggggtgctgctgccgcatccgtgctcccgaacatggcgtcctactacatcccgagcagagatcgtccggtgcagcccgcagcccattgataccggagctgaagctacagctgatgctcaccatgcccacggtcgacgccacagagaagttcatccaggaggaagagacctcgggaagcaacagcc

SEQ ID NO: 73946 - DNA, 684 bp, Triticum aestivum
  unsure (1)..(684): unsure at all n locations
  Clone ID: PAT_TA_73946
aggtgcggtggtggttggttcaccggtccggtggcactggattggcaccagcacagagctcctgcttacggaaacgacgatccgttcttggggatgcgaagatccagggaggcactctcccgttcagttctccttgctatcggttcagggccatgccacagcaggctggctttcacgggattggcattggtggcgcagtcaatactacctacagaagtgccaccaacttgcaccaagctattgcgtcaaggggggaggagaaaggaagagggaggtgcggtnggtggttggttcaccggtccggtggcactggattggcaccagcacagagctcctgcttacggaaacgaagatccgttcttggggatgcgaagatcctgggaggcactctcccgttcagttctccttactatcggttcagggccatgccaccgcaggtgaaagttaatccccttctgggctggcagacgtgacatggctggctttcacgggattggcattggtggcgcggtcaatactacctacagaagtgccaccaacttggaccaagctattgcgtcaaggtccgagatctttgatttcctgctgtttggaagggatccacgagtcgccgccactgttcaagttagatctaacaaaatctgtaacgctccattattgcgatttggagactccatcgtgagt

SEQ ID NO: 73947 - DNA, 776 bp, Triticum aestivum
  Clone ID: PAT_TA_73947
tcggcacgagcattagggcgctacctcctccgtccaagtaccacgcagccaagccaaatctcttctctccctgaccacaacgccgccgccaccacctctgattcagctagctccggcgctctgtctcgccgttgctcaccggaccagctgccccacactgctctcctccgaccccccgccatggcgatgtcttccgcgccactacatgcggcccgcagcaaccctaggtgccacaggtcgccagcgcccgcgcctcctctggttcgccatactacccagtccccgtggtacatctccacacgcgcggctgctggctcggcggtggtgttgctgctccgcctcggcaacctcgactccgacgccactgacggttcagtaagtcactcctcgtctgacccttgttttcttaccccacttggttctttgtgtggcaggccatggcagattcttctttgccggccatcgtgatggcgatctgcgggaccttgatactcattctgatccacctccgccaccggcgtccatgccactccaccttcatgaatcagagtattcctaaagatgacgttctgtcccatagcttccccttttccttcccgcctttcagattgtataacactgagcgcttacttgtgtacctctatccttctctcgtagtactgctaccatgtacgactctgattgaaacaacgacaatgcgaaacacagggagtttgcgtcgttcatatctatgtactatctcattatatacatcaatgtccattatatgtacagct

SEQ ID NO: 73948 - DNA, 519 bp, Triticum aestivum
  Clone ID: PAT_TA_73948
agcaagcaccagcgctctcctctcccctcgcttcctcgctgcaatgtcgaccgacgtggccgccgatgtcccggcccctgaggtggaggtggccgccgaccccgtcgtggagaccacggccgaggccgccgccggcgacgcgaagccggccaaggagaccaaggccaaggcggccaaggccaagaagccctccgccccgaggaagccccgcgccacccccgcccacccgacctacgccgagatggtgtcggaggccatcaccgccctgaaggagcggacggggtcgagccagtacgccatcaccaagttcgtcgaggacaagcacaaggcgcacctcccggccaacttccgcaagattctgtcggtgcagctcaagaagctggtcgcctccggcaagctgaccaaggtcaaggcctcgtacaagctgtcggccgccgcggccaagcccaagccggcggcgaagaagaagcccgcggcgaagaagaaggcgccagccaagaagaccgccaccaagaccaa

SEQ ID NO: 73949 - DNA, 812 bp, Triticum aestivum
  Clone ID: PAT_TA_73949
tcggcacgaggtcctatgggtacggcagccgatggcggcctcaccgatgacgccagagtccccacggtcatccgcgactccttctcctccaccactaaggcccaggaggtcatcgcgaccccccatggtgcgtccctggactccatcaacccgatgcccatgacctgtttgacgactggctcgacccaggtcgacgccgtcgccaacgtcgatgaggcccaagacgccgccaccaccgtccacccggagcacgcggacatcgtcagctacacggaggtatcgcagctcataccggtgcaggcaacgctctccatcgacatcagcacctgctctgccgaggtcatttcctcaacggcaaccaccaccgacaccatccccatggcaaccaaaccagctccgaccaagtgctcggcagaagcttctgcccacgcgagtgtctgggtgcagcctccgatcgtcaccatcgacagtgtcgacgagacatatgacaccaccaccgaacacctgcacccgccttccttcgaacatcgaccatggccacggcctgtacaagtgcagatcaatcacgcgggacatctcttcaggccaagtccgtggccgtcgttcacacctctgtcaaacacaacctacccggaaaggccatgttcaggtatacatcgtcaatcacatggaggtccctgcttcagtccttggttaattaggttgatgttcagagatgttcccctggaggagcctatccattgttttccagctccagagatgcagcttgagtgtaaaattgggttcagctatgggcttgttctgtccctgat

SEQ ID NO: 73950 - DNA, 555 bp, Triticum aestivum
  Clone ID: PAT_TA_73950
cggcacgagccgtgccgccatcgccgccgcaattgccgccgccgcggctgcggcagccgcagccggcttcgccctgaccgccaaatctgccggtcggccgctcccgcgcccgtcacactctgcatccctctgggcctccctctcccttgccgacagcggcgcccccggcaacgtcgagccccgcaccggcgccgcattccccgccgagaccgccggcgggcgccgcctcctcggcgttggcctccgcaagaccaccatcctcggcctcaagtccatcgacgtctacgcgttcggcgtttatgcggatgacagcgatctgaagcagctgagggacaagtaccagaagcttcccatctctgatctgaaggaaaatgatgagctgatcaacgatgcactagagcgtgacattcgtatgacggtcaggcttcagatagtttatgggaggctgagcattggttcagttcggagcgcttttgagaagagtgtaggaagcaggcttcagaagtttggggggtcagacaccaaagagttgcttcagagttttgtttcactttt

SEQ ID NO: 73951 - DNA, 587 bp, Triticum aestivum
  Clone ID: PAT_TA_73951
tgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaagtgcggcgtcagcgtgcccttccccatcagcatgtccaccaactgcaacaatgtcaactagttcaatatataatccttcctacgtgcatgcatggacgcgcttgcgtggagcttaatttctacgttgatggagtgctcatacgatgttgagctactaaaaaataaaatgaagttgcctgtgtgtgttatttcagtagtgtgtctatgtctgtaccttgca

SEQ ID NO: 73952 - DNA, 506 bp, Triticum aestivum
  Clone ID: PAT_TA_73952
ttcggcacgagcacaaaagaagctacaccaatcaaggcctccatccaatcccaagcaacctcgaagatgtcttgctgcggaggaagctgcggctgcggcagcgcctgcaagtgcggcaacggctgcggcggctgcaacatgtaccccgaggtcgaggccgccggcgccaccctcctcgtcgccgccaccgccacccacaaggcgagctccggcggcatggagatggcggccgagaacggcggctgcggctgcacccagtgcaagtgcggcaccagctgcggctgctcctgctgcagctgctagatcatcggtcatgcatgcaccgcgtgcctcatatctatgatctatctatatatccatctaccaccatgtaacgctacctgatcacggtctttgtatgtatgtacgcacctgcctgcatgagcagagcaggtgccatgccatgcatgtaaacccctaaataaaatctcccgtggtttaaccccctaaaaaaaaaaaaaaaaaaa

SEQ ID NO: 73953 - DNA, 342 bp, Triticum aestivum
  Clone ID: PAT_TA_73953
cggtactccgagtgggtgctggaggagctggacgagctgcgtgggagcttcctgctcacggacccggccatgccgggccaccccatcgtctacgcctcccggggcctcgccgcgctcacgggctacccgcgccgcgagctgctcggccgcaacgcgcgcctcttccagggcgccgccaccgaccgcgccgccgtctcgggcgtgcgcgaggccgtgcgcgcccagcgcgcccaccaggtcgccatcctcaactaccgccgcgacggctcgccccactgggtgctgctccacctcgcgcccgtcttccacgccgccgacggccgggtgctccacttcctcgcc

SEQ ID NO: 73954 - DNA, 736 bp, Triticum aestivum
  Clone ID: PAT_TA_73954
tcctggggaaattgcttccgacattacagcgggttttggagtcgctactgcaccaaattgtgctcaggcttcgattgcgctcctcatgggcaaggttcttctgaacaaagaatacaaaatgaagtgcaacgcttgctggcgggagttggaaggacaagccataacaacaacttgtggccatcttttatgtacagaggatgcaaagaaaatactcagtaacgatggtgcatgtccaatttgtgaccaagtactttccaaaagccatatgaagcctactgacataaatccaagcgatgaatggacagatatgtcaatgactggagtttctccacagatacttatgaagagtgcatacagaagtgtcatgttttacatcggacaaaaggatctggagatgcaatacaagatgaacagaattgttggtcaatgtaggcaaaagtgtgaagttatgcaggcaaagttcactgaaaaactggaagaagtgcatgcggcataccagaagatggccaaaagatgccagttgatggaacaagagattgaaaacttgacaagggataagcaggagttacaggaaaaatttgcagagaaatccaggcagaagaggaagcttgatgagatgtatgatcagctgagaaacgagtatgaatcagtaaaacgttcagccattcaacctgcaaacaactacttccctagagctcagcctgacttgttctcaggcatgcccaacatattggac

SEQ ID NO: 73955 - DNA, 649 bp, Triticum aestivum
  Clone ID: PAT_TA_73955
cggcacgaggccattcagctccatccgcgcgccctgctctcgttgcgtcgtcgaggtcggcacgtaggcttaattagttgggtggcagagcgcgcgcgcggccggccatgacgatgttggggcaggcccaggcgcagccggcggcggcgttcggggacacgacgctgaccaaggtgttcgtgggcgggctggcgtgggagacgcacaaggacaccctccgcgagcacttcgagcgcttcggcgacatcctcgaggccgtcatcatctccgacaagctcaccggccgctccaagggctacggcttcgtgacgttcaaggaggcagacgcggccaagaaggcgtgcgaggacggcacgccggtcatcaacggccgccgcgccaactgcaacctcgcttccctcggcgccaagccgcggccccagccgccgcacctcctccgcccctcgccgccgaccaccccggcgccgcaccacatgcccgcgctcccgtcccctcaccaccagcccgcgccagccatcgcggtggggtccaggggcgtgtcgccggtgccgtggtactaccacccttccacgacgccgccgccgccgccgcaggccgcgcactacggccacggcgctcaccagcagtaccacggcgttctcccgttcta

SEQ ID NO: 73956 - DNA, 659 bp, Triticum aestivum
  Clone ID: PAT_TA_73956
caccagattcagaatttggggccaaatatttctcagaaaagaagaagaattcagaacagcagatgagatctgcttgaggggggaagaccagatcgagaagagattgagcagcagcagcagcagcaaggaacaagatgatgatgtcgccgaagcagctgctgaccaccatcctcatcgtcttctccacgctctccttcatcaagctcatgctcctcacccactccgcatcgtcgtcgcccgcgcgccccggccgctcggcctgggacgccggcgggtcgggcaacggcaccgcgggcgcggctacggacggcctcaacgccaaggagttcgcgctgctccgctccgtcgtcgccgcgcgcgcgccgtgcgggctgctcgtgttcggcctctcgccgcagctcctcgcgctcgcggccgtcaacgacgggcagggcgccgccaccgccttcgtcaccgacagcgccgaggacgcggccagcgcgcggcgcgtgctcgctgggcgcggccccggcggctcggcggccgtccaccggaccacgtaccaggacccggccggggaggcgtgggcgctgctgcggcgcgcgcgggcgagccctgtgtgcgggcggccgacggggacggtgcgcaagtccggctgccggctggcgctgacctcgctg

SEQ ID NO: 73957 - DNA, 714 bp, Triticum aestivum
  Clone ID: PAT_TA_73957
attcggcacgagcgatctctcccccgtccgcaggacctctcgcccccgccttctccggcgccgttcgccgcccgcggtttgccgcccatcgcgcccttcgccgcgggacagccggagccgccgcccgtcgcgcactgcgggagccgccgcaggttgtcgcttgtcgcgcccttcgccgtgggagagccggagccaccgcccgtcgcgcgccggaggagccaccgcaggtcgccgcgggagagccggggccgccgcgatcgtgagcagccgcccgcccatcctccatccctacgcgggcgcaccttccttcagctcctcctcgcgccgcccctctcctttgccccggccgccaagacccagcggtcgcttcaccgggttgcggcgccgccccgcccgatagcctcccagcggccgcctgccgccatccgcgcagactgcttcaccgacgcccgcggccgcttcaccaggccacggcgtcgcccgcccatccctgtgtgtgcaacggctgaaaatttcgatctgcgatggtgcgcggagatcaagcgatgacggcaacagcgtcgggctttgcagatttcagctagagcttgcagagttctaaaatatgttgaccaaatcgtttcttcaaaacctggttcacaaatactatgatcttgctactagcttctatgagtgtggctggactgaatccttccactttgctcatagcatttt

SEQ ID NO: 73958 - DNA, 672 bp, Triticum aestivum
  Clone ID: PAT_TA_73958
atcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccatcgacttcccagagcacgccgttctccagctccctgtaagggaacgaatccgacagaagctcgtcgccggaaagcttgtcctggtacacgagcatggtgccgcctcttgagatttctcccccgaa

SEQ ID NO: 73959 - DNA, 683 bp, Triticum aestivum
  Clone ID: PAT_TA_73959
tcggcacgagctcatctgctccatcttctaagcagccatggaagcagcagcagcagacgaggagaggcccctgcttcatctccaaccgtataatcaggatgtaggttcagaatacgccggcgatggatctgttgacatcaacaatcagcctgctctcaagcgcaacacaggcaattggagggcgtgctacatgattttagccgtcgagttctgtgaatgcgtcgccttcttcgcaatcgcgtcgaacttggtgacctacctcaccaccgtgctccacgaaagcaaggttgccgctgcgcgggatgtgtctgcctgggtcggcgcatgcttcctcgcaccacttatcggggccttcttggccgacacatatctgggaagatactggacgatggttgtttcccttccggtctacaccatcgggatgctcgtgctcacggtttcagcatcagtcccgacatcctactaccatggtgatgttcatcatgctgtggtggtgtacctgggactctatcttgccgcacttgggaccggtggcatcaaaccctgcgcgtcggccttcggcgccgaccagttcgacagcggggacccgacggagctggagaagaagggctccttcttcaactggtactacttcctgatcaaatctggctcccttctgtccagcacactgcttgtttggctgc

SEQ ID NO: 73960 - DNA, 777 bp, Triticum aestivum
  Clone ID: PAT_TA_73960
attcggacgagctctctctctctctctctctctctctctctctctctctctctctctctctctctctctctctcctcaccctcgtcctcggctacttcggcccgcgcaagcgcaagcgcccaaccaccaccacctccacctccacccacccttggcaaatcccaggccacgcacgtagcagcacaccaccactgccccgcccccaacaagcaagcagccccgaagcgaaagcaaaacaggaatccgccagagcggagcggaggaggccatggccacggacgcggcgctgagccagccggatcgcgccaccgtgacgctcggcgagcccgcccacgaggaggcggtccagcagctggtgcagcagccggactcgaggctccggagcctcaacccggggccgatacccatcccgggggcgcccagctccagatcgctgctggagaaggtttccgatcaaaccgtaaatctggatctcacagcctcgcatcaaagtgagaatggctccatctctacagttagctctacagttagttcagtggaatcagagaaagcagcttatgaattccttgctcaaactcctatcaagtcaactgataaacaccttgtggagttttcagaggctatgagaactgttgcaaaagcactgcgacaagttgctgaagggaaggctgctgctcaagcggaggcggcagagtggaaacggaaatatgagttagagacggcgcgaaagcaacaaaccagaatcaaagactgtggcacttgtaccgatgataacct

SEQ ID NO: 73961 - DNA, 627 bp, Triticum aestivum
  Clone ID: PAT_TA_73961
tgcagattcggcacgaggcacacaccattctatatatatacctcggattgggtttataactggggcatggattttaggtctagaattaactaacaaaacatgtgtaactatgccataaaaatgtatgtttagaaatttcgtttgacgatgaatctaaagttgtattttttgtgacatataatacatggttcgctagttaaattgaaaacctaaaaatctgtgccgggcttacatacctagcaaatgtgagaacacacacctagaaactgaactgatatgatcaagcttccatgactgcgtgtagacatattcgacaagttcaaagatcagacaggaaatttcagcacaagcctatgcagtgacctagtgagccttctgagcctttataatgcagcgcacctggcgacgcctggtgaggatgcactaagtgacgtgatcgtcttttcgaggtaccacctcgaggcaatgagaaacaagcttaggccaccaatggcggaacaagtctcacgtgccctcgacattcctctcccacggaccgtcaggcggttggaaacaatgcactacataaaggagtatgagaaggacgagtctaacaacggcccgctgttggagctctcccgacttgac

SEQ ID NO: 73962 - DNA, 127 bp, Triticum aestivum
  Clone ID: PAT_TA_73962
ctagtgcgtgtgtgtgtagatcgatcggtgagatgaacaccttgtaatttgtacagatttgtgtttcttgtttggaaccagcagttaataagatatgcctctgaattaaaaaaaaaaaaaaaaaaaa

SEQ ID NO: 73963 - DNA, 580 bp, Triticum aestivum
  Clone ID: PAT_TA_73963
ccaccggtgatccctttccctaatgctaacgatgagcagtcgccgcgacttctccacgcctaacccctcccctcccttccgcgcttcttcttcttcctctccttcttcctggcgttccgtactgattcggtcgtcgcgcctgggttcgatttgaccgcccccaccacctgtcttatccgcccgtgcaaccgctcgggccgttcgtttcttggttcctcgctcatcggttttcttgcgctggtttggggattattgggagcaatacttgtccagttcttcactctgcataccatgtgaacaagtttgaaggtagggccatacctgtgctgccgtgcagcacaatgatatctactaagacgccacattggtgattgttgtaattatattgttcaaaagtatagaaaagagacgttgaagaaaatcgacatagatttgtgacggtggatactggttatggaaggtatattattaatcagaacagtttgaatcgaaacgagacaatgagcaaaatgatgatttaaccggacttcccagagcctttactgttatggagatttcatcacatgaaccatcagaagca

SEQ ID NO: 73964 - DNA, 671 bp, Triticum aestivum
  Clone ID: PAT_TA_73964
cggcacgagcctatgtgtatgtgtatgtgtatgtttaattaattctttattaagggagaaggtgcacataaaatcaaacaagccgtttatagttctagaaggggagggccgagatcactactatcggagtttcaacagagtgtctactttcaaatcagcgacgtttcggtgcgacgcctccgatttccaggcacggaatataacgttcaagaacacttatacaattgataacaacacggtgccagccgtggctgctcaagtgtcaggagatcgatccgcgttctacaactgtggattcgtggggtccaggacacgctgaatgaccagcaaggtcgccattactacgagaattgctaccttgagggtgcggtagattttatcttcggccatgcaagatcaatctttcagggctgcacgttgtggacatgcaagctaccatcgtggaagtatactggcttcctcacggctcaagggcgcgaatcgttgagtgaagataatgggttcgtttttaaggagtgcaccgtagatggcgtcacgccggtctacttggggcgtgggtggcgattctgttccacggtgatcttctatcgaacttttttgtctaacatcatcgtcccccagggatgggacgcctggaatgccaagggtcatgagacctcgctgacaatgtt

SEQ ID NO: 73965 - DNA, 593 bp, Triticum aestivum
  Clone ID: PAT_TA_73965
cggcacgagatcccccgcctcctcgagcgcatccacgccgcaaacaacaactccggcgacggcgacgtgatagcgcaggcgacggcggccgcgctcccggtcgcggccgacgggcggggctggcccgtcgacgacgtcttcgacctcggccccagcgctgtggctgatgtggagctgtcatgcaccaccgccctgtcgtcttcgtcgtcggtgtccacggacggctgcggcgtgcagcccctgcccccgccggcgcccatggtggctaccgccgagagcgcgcacggaagcgtcatcagcagcgctgccatgcacgacacggcgctctggcagccgccgcagacgcacggcggcctcatgatgacccaagaacaacagcaccaccaacaggcagagtcgcagccgcagctgctcggcgccgagacgtggtggtcggatcagacctcgctccacgccgggctgtacgccgacgtcggcttcccggagctggagttcggcggcgagaccatgtggggcgcctgcgccgatgacctgtggtgcacggacatgctggggctgtgaaacatcaaacatcaaactaccggtgacctgtg

SEQ ID NO: 73966 - DNA, 296 bp, Triticum aestivum
  Clone ID: PAT_TA_73966
cggcacgaggtagtttctagctagctagttaatcagcagtgttacctcgattagccctagtaaaatcttttctgttgttgtgcctctcttgttctcttcttgtgctggtggcaaggcttgctattagtcggcagctagtgcgaggctgccctctgtgtgtgtatgtgtgtatggagctgcttttcaggcagaaagaagaatgtaaccccaagaagggagatgctcctgctcctgctcctgcaaaaaaaaaaaaaacaaaaaaaaaaaaaaaaaaaaaaaaaaaaaaaaaaaaaaaa

SEQ ID NO: 73967 - DNA, 558 bp, Triticum aestivum
  Clone ID: PAT_TA_73967
gaggtggtttgttcttcctgagtcctaattacgtcttcgacaggtgcgcgcatctacacactggcacaaggaactgtgtttcctcccacactccgcgtgcacacacacatatctgatgcattgcttgcagttttataacgagttaaatgcaaatggagttatgtttaaagttgttctttcagtttatcatattttagcactaaaatcttcattttcattgcagctgtttgattattaaattggcgtaaacagacgaagttgtctctcatttagtgacattgactccgagatatctctgatgggctatctaaatcttagaggctctttgcttccattgctctgtctgcacctgctcctgtcgctgttcgtctcattagctacagcagacatagcctctgagaagcaagctctccttgctttttcctccgcagtctaccatggcaagaagctcaactgggatcaaaacatctcactgtgctcatggcatggtgtaacatgcgcagaggatcggtcacatgtatttgcccttagggtaccagctgctgggctgattggtgc

SEQ ID NO: 73968 - DNA, 513 bp, Triticum aestivum
  Clone ID: PAT_TA_73968
gcggcgagacgctggaggtggacccgggcctgacggagttcatctgcccggactgcgccacgccgcagtcgctcccgccggagctcatgccgccgccgccgtcgcggcggaaggcgctgcccctgccccgcgcggccgccgacgtccggggcgcgcggctcccgtgcggctcctgcggcgcgctcctgagcgtgcccgtcgggctggcgcgctgcgcctgcccggtctgcggcgccgagctcgccgtcgacaccgcgcggctccggcattacctcctctcgtccgctacggcggagggcgccgtgcccgtggtgccactcggcgacccctcggccccacccatcctccaagcccagcaggtgcggcaagaacatcctaattttgggattcgtgcaggacttttgtggacagatcctgataatcggacaaattgtatgggacaggtacaaacaaatcagccaaatcagcttattccagagcaggcagatctggataatcctggttctacgattg

SEQ ID NO: 73969 - DNA, 615 bp, Triticum aestivum
  Clone ID: PAT_TA_73969
cggcacgagatatgctttatctcacctgatcagtctcgagtatgccttgcggccttacctaaatgtcttgaggtactactgaaaataaacagccagacatgctattgctcaaatatctgttatatattttgccacttgatatttattgctgttttcattgtgaaataaataacttcagtattaacttcatcttccatgagttgtgaatttgtgatgccttcatccccttctttttcttcttctcatgatagcatcattgctctgttctactactgtttcttggtatatcgagcaggtcgtggtttgcaatttatgatactgatgcagtatttgccagtttccttgctgggttgtccctatagctactttttaaattctgttggcgaatcatatttttaaacgcaacataaattgtactccatcttctgcaaactaatataagactttttagatcactatatgctttagtgatctaaaaagttttatattagtttacagagggagtattagttacagtgtcatagctcagttttttgattgtttgctggtaatgattttctaatgtttgttaagatatttaaatcacttactgcaacatcttctctgagttggtgt

SEQ ID NO: 73970 - DNA, 693 bp, Triticum aestivum
  Clone ID: PAT_TA_73970
tcctgcctggttggacggcatgctcgatgaggatgagaagttctttaaggccaatggcgttcccctcttcagctcccacatgatcgatctctcagaagagagcaaggaggagaacatccaaacttccaagaagtacctccagcgcgctgctcctatgaagcagttcctcgagatggaaatcggaatcactggtggagaagaggacggtgtcaacaacgaggacgtcgacaacaacagcctctacacgcaaccagaggacatctacgacatttaccgagagttctctgaagtatccaaatacttctccatcgcagctggctttggcaacgtccacggagtctactccccaggaaacgtcaagctacgtcccgagcttctccagaagcaccagcagttcgtcaaggagaagaccaatgccaaggatgacaagcccgtcttcctcgttttccacggtggcagtggcagctctgtcgacgacttccgtcaggctatctcatacggtgtcgtcaaggtcaacctcgacacagatatgcaatgggcttatctctccggtgtccgcgactacgtcctgaacaagaaggactacctgatgtcccaggttggtaacccagagggaagtggcaagccaaataagaagttctacgacccacgcgtttgggtccgtgaaggagaaaagacaatgagccagcgcct

SEQ ID NO: 73971 - DNA, 586 bp, Triticum aestivum
  Clone ID: PAT_TA_73971
ttttttttttttttttttttggaaacagaagaggcagcgaacagtatgacggcgaacggcggcatggcgctcccgatctgctcgctccggcgcccctcaaggtcccgatttgactataagccggtggatctgggttctcccgatggtggagttgaaggggccctagtggctaaggacacgaccggcaagcgggaggccaccacaaccagcgttctggagctctaccactaatcattcatctagcacacatcatcacgtggattatgttgactggagagatcgcaagaggccgaacatcctgcccaaagagggttcatttcctccatcacgacggtccccaaccagctctatgccaccggaacactttagtattatcccatattcatcgattcacttggcgccggagctctttagttttgctcactttgggacttgatgaacaactagaagcatcagggttaggtcattgattggaagtttaagatcaaaagaagagcatcaacagcagcttgattgttttcatggcaacctctgattgtaaaatgtcatctgcatctattcaaaaagatgtactctttgtttgcgg

SEQ ID NO: 73972 - DNA, 635 bp, Triticum aestivum
  Clone ID: PAT_TA_73972
cgctactcccctgcctccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctat

SEQ ID NO: 73973 - DNA, 700 bp, Triticum aestivum
  Clone ID: PAT_TA_73973
cggcaccagatcattcacccagcaatatatagtcagatattattgagttttattgtgattgtctgtgaaagtagtttgatgtttacacatatatccaacattcctgaagcctctagcttcttatgataatttgtgatccagaccaagaattgtattccttagaaaatggtccatagaccttttaggctttagccatgttacggtatgcggtgggcacatacctggttattggtatctcctatggccaaatatacgctagtgtattcaaatttgtgcttctgtcctctgggcagttgaacaaaatgaaatcgtgatggtcaagttttgcaactgctggtttccacatttctagcagtacattcagacaacttgttaaattaacatgtggtatagaactatctgagtaacaaattgttacatataagttgtactgcattcggggtgggctacatcacctgttggatttggcatgaacagttaggatgacagcatgtatggatggtcttaacttcgcacagacagtggtacaatcttcttaaacatggagtacttcaaatttgtagcaacgcgccagcatgtgctataacttgcaaaatgtatttgtgtgtctttgtggctgaaaaccatgaaatagcatgcagtttatgttgctcaattgtgacttcttgaactgaaaaaagcgcagttgtactttggactg

SEQ ID NO: 73974 - DNA, 534 bp, Triticum aestivum
  Clone ID: PAT_TA_73974
cgcgtgctcactgctcagctcgcatacccagccatggcgacgccgactccgacccccacctcgcccgcttccatccgggcgtcaggcggccctggcgctggcgaccgatgggtggtccgcgcccagccggcggcggccgagctggtggagcggtcggtgaccaccatccggttcctggccgtggacgcggtggagaaggccaagtccggccacccggggctcccaatggggtgcgcgccgctgggccacgtcctcttcgacgagttcctccgcttcaacccggccaaccacgcctggttcgaccgcgaccgcttcgtgctctccgccggccacggctgcatgctccactacgcgctgctccacctcgccggataccaaggcgtcacgatagatgacctgaaagctttccggcagtgggggagcagaactcctggtcatccagaaaattttgaaacagaaatcctgaggagtacaaggagaggtcctaccaagcgatgttacttccaggattagcatcgaagccggcgtcacact

SEQ ID NO: 73975 - DNA, 629 bp, Triticum aestivum
  Clone ID: PAT_TA_73975
gtccctccccaacgacggcgatgatggagggcgccgcccagctcctggctgacggatttgctggctccccgctcctcggggccagcccctccccgtgccgagtcgagcatcgacttggaggccccttggggctgccgccggtgcgggagttccgtgcggccgtgcgggctgggtaccgagcggcggggcccgtggtgcgacgctcgatggatggcctgcacaacgcggacgactgcttctctcccaggagggccataggaagccactacatgtcggagctgttgcaggagcaccagaagcttatcctgttcacacaggtgctaccaatctgcatcaaactattgggccactatgagagcctggattcactccctcgccgccgcccggtctaccattattggcctaggttggaacttgtccttgcagattcgccttggcctgattgcttatgtttctctcttgttgatgcaaacttgctctgcttgactctgttttggcctcaaggcgtctcacttgtcacatattgttatcaactcagagaagaaaaaggttccatgagggtgtatattacagaagtggagaaagagctcgcctaccatgcatgttgcctggtccgatgagcagtgcta

SEQ ID NO: 73976 - DNA, 450 bp, Triticum aestivum
  unsure (1)..(450): unsure at all n locations
  Clone ID: PAT_TA_73976
cagtaggtgaagataaagatcggtccagattcagtcatcaacagatgctctgcttctctctgcttgtgtgtttgctcctgctcatcagtcagtcaacagaagttgtaattgtaacctgtaatcagtcggtcagtcagtccaagatccatcgtcagtctagcataggcctgtgtgtgtctcgatcagtcaatcagttcacagctgcggctgggcataattgttaagaagaagaagaagaagattaattaacaaggggagctgaagtgaagttcccgggataagaagattagcaataagaacagtgttacagagtgtgtgctctgtttgtgtatgtatgtaatactgctgctggaactgcgaatcttgaactgctgcccccattttgggcagtggcaagatcataatatgctatcnnaaaaaaaaaaaaaaaaaaaaaaaaaaaaaaaaaaa

SEQ ID NO: 73977 - DNA, 697 bp, Triticum aestivum
  unsure (1)..(697): unsure at all n locations
  Clone ID: PAT_TA_73977
cggcaccaggcgcttcagggtcctcacgatatattggtgagcagtttggcattcttttttttttacttgttaatttatatatctcacttcatccctgataggatcatttaccattgttataggagttctgtggggtgtaacggtaagaaagaatccgttgttaccgttgtgatttcttgatttgtggatagcttattagatccataattccgtttctatcttgagtcatgagcctgacaccgaattggaaagcttgaattcatatcgatgtatttcttgtgacacccgaaaatatggtgtgcagatggtggttccgtgatgcaaaatctatctcttcccacaaacacctgggaatgttgtcttgcttgtttttgccaacttgctattgttctcgattatgtatgagttatcggaattatgacatgccatcagttcaagagttaactggtaaacatgcatttactctttcgaaagcatgctgaattcttctgttggtctttaatatgcgaccttcaccattataattatcaaacacaccagaagtttacaatccgaaatgtcatcactaaagctcggtctctgcaccacgatatgcggcactgntgaatgttttatcttttcttagtgaagctgtgcttttattttaccagaactgccttttgtgttacagagatggctggaaaaggaagctatgttc

SEQ ID NO: 73978 - DNA, 699 bp, Triticum aestivum
  Clone ID: PAT_TA_73978
cggcaccaggcggcacaagccaagctcaggcaagcaggcggcacctcagctagccaacagcaaccaacagatggcctcctccggctacctcagagcggccagcggcgccactcgcagccgccagacgctcctcctccggcagcgccccgctgctccggccacaagcgcgacaccgagcgcgctcgtcgcttcctcagcgacgcggcacgcgtcgacagtccccaacccgccgcccggggcggaacctttgccagaggacgcgccgcggcagacaccgccgaggctcggggagccggaccccgtgggacctcccacgccgacgcccaaggagaagataaccggcacaccgccgtcggaggaggatgacggtgggctacccggcggaatgccggacacgaccccgccaccggacgtgccgttaccccctgcctcgcccgatggtagcaccgtctagctcgttcggtccgtctgtgcgtgcttgctgcgtagctttttttgttcttttggatcacttgatgcgtagcttttgcatacggtgtcagtgtgtacatacatgttgcagtggagtacgttctacctttttcactacggagcaccgacgtgtactgtttgtattctctcgagtcacgagcatgcagcttggtgcgcgcatggtgttaggctttgccttctcataaatcaatgcacactaagtcaaac

SEQ ID NO: 73979 - DNA, 700 bp, Triticum aestivum
  Clone ID: PAT_TA_73979
ctgatgagctttttaagaagatgatagtttatccaccaagagcaccactggcttgggcacaggggcgatattgtccaggtcagcactaaaactggttcattttttttcttgaatcttatgctggtttatttttgaaggaagttgcagtggcttaactatttaggaattagaatcactaaattaaaatattattagtatttgatggataacatggttgttttattctatgcatagggctaaaactattgctggcttgaagtatactattcaagctggtattgattccctggaaggttcaaggcaacaattaatgggtaggctattggaaattaacaaaacaatggataacccaagggacgatgacattgagagtcagagatattgtccaaagtgctatgatggtactggttctttgtgcatccagtgtgaattagatgggctgtctcaggggtatgaggcacgactctttgttgttaagaaatcgaacaatgattctgttattgcttcagtagatgaagcacgggatgtacagaggcgaaactatgagttgaatcactttttccgtaacaaaaaaactaatgaaggatctgaagttggtggcaacaatgataatccaagatctgttcgggaaaatatacaggctgcctctctttacaggtctataggcatccttctcaaaccgagactgctctaagggcta

SEQ ID NO: 73980 - DNA, 647 bp, Triticum aestivum
  Clone ID: PAT_TA_73980
aatcaatgatcaagaagaagaaatacaattgtcagctatggaatccttcagagttaattactttctagtcattgttgacaatgcaattctttcattgaccagccgctttgatcagttgaagaaatttgaaaaggtgtttggtttcttatttaattcaaaaaaatctgaagtccttggatgatagcaaactacaggaatgttgcgctacttttgcaaaagctttttctgatgataaatcatctgatgttgatcttcatgattttgtctcagagttaaaagtgttgcaggtaactttgccagatggtttgatgtcagcgcttgagattcttcagtttgttatggctgtagattgctatccaaatgtctctgttgcctatcgaatcctcttaacagtgcctgtgactgtaacctcagctgaaagaagtttctctaaactgaaactactgaaaaattatttgaggtcaactatgttgcaagatagattgaatggcctggcgatgtgctgcattgagaaggatatcttggacaatgttgatcttgattgtgcccttaatgacttcgcatcacgaaatgcccgaagaaacattttttgaagcactgaagtattattgttgtcgatggagtcagtctaatttcgttcttatttg

SEQ ID NO: 73981 - DNA, 704 bp, Triticum aestivum
  Clone ID: PAT_TA_73981
cggcacgaggtaagatcaatagttggccctattgtctgtgctctgttctgttaaggatttctgtattggaaacataggcatcctgctattccctgctctagtttcagttcagtcataaacctattgcccgggtcctttgatacttgatttcctgggtcaacggtacctagattcccctttggcttgatcttaccttggatttatgattggaatacagattggataaacaagaggaacttggaaaagagggttggccaaagcataacgatagtgcattcaatcgattccactctagttttgcatatcttttccctcaataaatagtttatatatgaaagaaagtgccaacttattgttcttggaatgctgatttccatggatttcttcttggcatatcccccctgatttgatgacctggctaaaacacctattccttttttctggaattgctgccgaaagcctgtttgcagcatccatagcaatacgtgttagtactcaatttctttgattttcatttgatgaagtgaagacacttatctatataccatttatagagtggtagagtaatcttgcaatgcggcatgaattggatgacttaatagttttctgcagtttagtactaacatgcctgtgtggtgaactaactaccttgggaagcaacaaatatgcccccaatcacgctgcctatgtgaacaaattctaaa

SEQ ID NO: 73982 - DNA, 636 bp, Triticum aestivum
  Clone ID: PAT_TA_73982
cggcaccagtttttatttttaactgatgaattcttttattgcccatgacatctgcatcatacatgcatatagaattacttattacaaagttgctatacaatggcttcgccagaaagagagaaaaccaaaaacacaagacagtccatggaaagaaggatgtaacatgccaagcaagattattataaatactaagaaacctgcacgccatcaaaatagggttataaactccataataatccactcaagtttcttggtggcaagctccaccggctctcatattttgtagcaacgtccatgccgcaaccaacttccaatcctgcttacgaagctctgagattcttattgaaatccttgtttcattcctcgacggctaatagaggtttcttgtcctcccacttgtgtaatcttttcattgcttcggccacctcgttgtcccaatttgtcctgatggtaacccacactaggatgacggtctgcatgagagtacctccaatcataccgcaccatatgcccgccgcgccgagattgaagtagaagccgaggacgcaacccaaggggacgccgacgacgtagtaacatcccacgttgacgtaggcgacgaatgcttgccaaccgcagcccacggccatccctgat

SEQ ID NO: 73983 - DNA, 641 bp, Triticum aestivum
  Clone ID: PAT_TA_73983
cgcatgttaatatgtgatcgttgtgacgaagcattccacttgctttgctgccaccgtcgcatcaagaaaataccagataatgattggtattgcctggattgttcaaggaagaaacctaagaggcagcgtgagatgttgccgagtacaaaaggatcagccaagcatattcaaagacctctccaagttcttggctcaaaaggagatatgttgacgaatgctgaaccatatgaaactcaagtaaggattggtagagacttccaagcagaagttccagagtggtccggtccaatttctggcagtgatgactattttgttgaacctgctgaacttgatgccactgaaatgacaaatctgagtttgtcactaaggcgtgaggacaagaaaaccagcattggtaactggattcagtgccaagaagtcttggacacaggtgctatttgcggcaagtggcggagggcaccactttttgtcgttcagtcgagcgattgggattgctcatgttcagttctttgggatccaattcatgctgattgtgctgttccgcaggaattgggtaccgctgaagtgcttcagcaactgaagtacataaataagctgaagctgcgtctggacagttataagcagaaacgctgaaagatcta

SEQ ID NO: 73984 - DNA, 613 bp, Triticum aestivum
  Clone ID: PAT_TA_73984
ctggccgcctaagcctagcggtcgttcaggcttatttgtatccggaccctcaggcccctcccccaattatctctctctaaacctagatagcacgaatctaggtcttccaaactcaacaggatgattcgcctcctccgatcaggagttcaactcaccgggcttggagtcctcttcacggcgtaacgcatcttcggcatggcatgtatcccacggccatggccaaggcctctgaggtcgcgtgaccttttaggcctcgcccatggctatggtgttcatggtcttatttgtccatcagatctatctaaatcaccaaagtctgtctggatctttcatgtatgtcggccatgcccaggcccttctaaaacgaatttgcgacaccactcggcatcaggcggaacagatcctgtatttttttttcttttttctccccactattacttttttttctcagcacggacgcatggacgaattcaaactctggcttcttttttgggtctgtaatttttttactggatctgctattttatgggatttattcggtgcgtttttaatttatattataaatttgaaggttcgacggtttttatggtatttgcaagagctgctcttaaag

SEQ ID NO: 73985 - DNA, 647 bp, Triticum aestivum
  Clone ID: PAT_TA_73985
ttttttttttttttttttttttttcctctagggcatatttccttcacctagcccatcttaaaactttgaacctagcccttcttcaaacctagcagaagaccaaagcaacaaatttaaaaggagggactggttagttgtattttttaaacttcgcacagagaactgaatatcttttcatctttgcggaaacaaaaacaaaagaacataaatgcatgatataaaatcaagaagatctgcatgtaaaacttgtatactgcatattctcttgacatgcataattagtatttaaaaaatgacaatgtaaagcaaagaaaattggtagtaagagaaagagctagctagcaaataattagatacagaccaggttataagttggacagagaatataagcatgtaattaaatcacagaaaataggacaaaggatcataaagcaatccttcgtggagagataccccttattttttcttaaatttggaatgaatttctttacacacaacaactgagtatatttgcatgtaatgttgtaccaaggatggacaagcgatgaacatgaactgaatcataaaatccatataatttgcattgtttgctttctaggacaaggcagaatcacgagcaactaaaatacgatcaagtaagtcgaaag

SEQ ID NO: 73986 - DNA, 666 bp, Triticum aestivum
  Clone ID: PAT_TA_73986
cttcactattatttttttttctacaaaaaatttgaaccctgtcctttgtgccacagattagcctgcctttttgttctggttggttctggaatatgacatcgaggggaaccttcagttacacatttctctatatttttttctacagaaaaatgatgtttgtcctttgtggcacaagcatgagtggctacaaaaaatgtggtccttgcagctacaatctactatacccatctgctatgccatgcctccaatgggattgtatgggtggattatgagctatctgctgctgcgtttagggccaggagctgaatgccacatctgctccatgtcagcacgattgatcattgatggcatctcgtggccgattctcaacaagataacatgttttgggggtttcttctgtcgaatattttgatattttccccgctctaggacaatacgacgagagtggatgcttccgagcatcgataagattcatcatttgcaatatgttctgtgaactagtacacatatgccagattattaactgtaatttctctgaactctgtagaattcatctatccagcaaattgggttggagaccagacaatactatacaaccaaattaagaaagcagagctgcagagatcactagaccctccgccgttgacaaatgggggttcttcatct

SEQ ID NO: 73987 - DNA, 718 bp, Triticum aestivum
  Clone ID: PAT_TA_73987
tcgatcttcatggagtacttagataagttcgtcgtggtttacctcgatgatattcttatttactcgaagaacgaagaagagcatgccgaacatcttagacttgtgttagaaaaactcagagagcaccgcctttatgccaagttctccaagtgtgaattttggtttacagaagtgacctacctaggccacgtaatctctggtaagggcattgctgtcaatcccgagagagttcaggctgttctcgattggactccacctgagaccgttaaacaagttaggagtttccttggtctagccagctattttcaccgctttgttgaaaacttctccaaagtagccaaacccctcacggaacttctcaagaaagataaaaagtttgagtggtccccacagtgtgaacacagttttcaggaactgaaaaggcgcctgacctctgctcccatacttgtgccaccggatttcactaaagactttattatctactgcgacgcctcacgacagggactaggttgcattcttatgcaggatcgtcatgtgattgcctatgcgtctcgacagttgcatccacatgaggataattatcctacacatgatctagagcttgcagccgtagtctatgcactcaagacctggcgacattacctccttggtaaacgttgtgagatctacaccgatcaccagagtctcaagtatatcttcatccaaccggatctgaacc

SEQ ID NO: 73988 - DNA, 763 bp, Triticum aestivum
  Clone ID: PAT_TA_73988
gtttatagagacaggatcagagctaaggagcaactattctgaagttatagctccacacgatgttgctgtctatggtgcactatgcgtgcttgcttcttttgatcgctcagagctgaagagcaaagttattgacaactacaatttttgcaatttcttggagttagtgcctgaagtaagggagctggtaaatgatttttatgcaagccgctatgggtcatgtctgggatatcttgagaagctgaagtcaaacctgctgctggatatgcatctgcatgggcatatagaaactctgtacaaggacattcgacacaaagccatcatacagtacactttcccattcatatctgttgatctcaacttgatggctgttgccttccagacatctgtgtccctgctagagaaagagctggcagcgcttatcactgataacaaaatacaggctcgtatcgactcacacaacaagattctatacgcaagccacgccgaccaaaggaatggaactttccagcgtgcactgcagactggcaatgagtttgagagagatgtcaagtccatgcttctgagggcgaaccttctcaagcacgagttcagccagaaggcagcagaaaggaaggtgtgaaaacaagttctccttcgttcgggccataggtgcattgagcgattttagtgatgattcgtgccatagtcaagtgtttcatgtcatgatcggaatattcaagctaagatactagacaaagataatattactcctgccatgcacgtc

SEQ ID NO: 73989 - DNA, 489 bp, Triticum aestivum
  Clone ID: PAT_TA_73989
ggccagcacactatccacctccacgtccacagccaacgcccgatctcccatcccatggagcagcgtcacgcggacaaaatgccggcgagcgcgccgcatcacgacgagcatccgaagcagcagtctcccgacgaggaggaggcttcttcgctgagccccacggtggcgaggctggtccgggagtccatcgtctccaagccggcggacggcgggaaggcggccgcggacggctcgtcggacatcctggccttcgcgcgctccgtcgaccgcgtggactccagcctcgagtagcttcgctagtttgtgctttagtatccacgctcacttgcttgtataccgtagtaataaaacgctcgacagtttatttcccttgttgtgagctgcagaacacctcattcgcatccttgtctttcccccctttttttcaaactgagaagcaaggttgctaattaaaaaaaaaaaaaaaaaaaaaaaaaaaaaaaaaaaaaa

SEQ ID NO: 73990 - DNA, 544 bp, Triticum aestivum
  Clone ID: PAT_TA_73990
ttcaagttagtagtgtacgtgagccttcccagtgcaagtgtgtgtgcattgatcctgagagagctagttacttttagttatctaacaattggcaccagagctaggttatgacaaagatgatgccgcgcgatactacggcgatggtgcccagtggatcgggcaacccggcgatagcagcggcagcagcagggaagattccgttttcgcaactgacaaggacaaactacgcagcatgggcgatgaggatgaagtacctcttgcgagcacatagtgcatggggtgtcgttgatcgtgagagcccgtccaaggaggttgatgaaagcaaggaggagctagccatgacaatcatctcacagtcaatcgaggacgcgacgctactacgagtggcagaaaaggagtccgcatctgatgtatgggcggcactacgctccatgcatgtgggtgttgagcgcatccgagagtcaaggatccagtcattgcgctctgaatttgataacctcaagatggctgatggagagtctgtggatgattttgcgacgaagtt

SEQ ID NO: 73991 - DNA, 677 bp, Triticum aestivum
  Clone ID: PAT_TA_73991
ggcgaccgctcttcaccgctgccccccttctcctctcgggcatcggcagatctgcgcgggccactatcctctccttccccacagtccttcctagccatgtcgatcttaaaggcatcgtttggtgctgtgaggaagcctgaggctgtaggcagctggcggcgcatcaaccgtctcccgtgaggaatcaacagtgtggatgaaggagaggaggcagcatggggaagaaagggcgaaggagagaacgctgtgttgtggtacctgtctggttgctggcgtactgctgcttgcctgctcgtggagttagggctagcggaaatggggacggggtggagtcggctgcatggaagagaatcttgggggagccctaacttcgtgtcgtgtgcatatgtgtcgttctggtgctttaatggactgggcagtctacactgactcctttttattctctttatattttctttcacgaatgtgtgccttcttcaatcttctgcattgttagactgccacctagcctgcgcttaagcggggtaggtgataagcgctaagcggccatccagcagctgcctcaaggatctagcatgttgttggaccttgatatgaaatttttactctttctcaacagaacgaaagctatttggtgattgcatgactaagtatgttatcaatactattgcttggtg

SEQ ID NO: 73992 - DNA, 577 bp, Triticum aestivum
  Clone ID: PAT_TA_73992
caaagttcttacagtctcagagtctgataatccctatgctttggtcctccattgcgacgttgctcttgcacattcctgtttgctggttattagtgttcaagaccagccttgggtacattggagccgctttggcgataagcgtatcatactggttgaacgtgttcatgcttgtcgcatacatcggatgctcaaactcttgtaaggagacattctcgcgtcctacactcgatgctttcagtggagtgggtgtgttcatgcgcctagctctgccgtctgcattaatgttatgttttgagtggtggtcatttgaggtcattattcttctgtctggacttctacccaatccagagttgcaaacttcagttctatctacatgcatgacaacaatcacattgatgtatactatagcatatgggattggtgctgctggaagcactcgtgtatcaaatgaattaggtgccgggaatcctgaaggtgctcgactggctgtccgcgttgtgatgtctattgctgtgactgaggcagttctcatcactggggcactgttagcatcccagcacatcttgggatatgcata

SEQ ID NO: 73993 - DNA, 638 bp, Triticum aestivum
  Clone ID: PAT_TA_73993
cggcaccagccgcactccatcgcctcgccgccgttccccgcaacctgtcgacccaatctcacatcaatcacccgacggcgcctcgtcctctccagatcgggatcttacgcccgcccgcccgcccgaggtagcaactagcaagtggcatggcatctgggagcgccacagctggtagccaatttgtgtttgatgtgttttgcaagatgcaacttacaatgagatggggggacgaggatcgatcaagcacttgataaaagagacaccaaatggggcagtactctagtctattctttattttgatctatttctctttaattttctgtcttaactctatattacatggcatatttttattttattttatatatactccgtatccccgaatggctgtttttggaaaatccccgtatccgtatccccgtctttccgtccccgtgtccgtgctttttaggtcctcactatgcccttgcacatgggattcaattttttatttcccagctgtttagtttattgtttcctttgatggtgaggcattaattctggagatgcaattttcttgctcacaataatacaatgaatgatgggatctctacctactttgaaccaaattatattatattccctctgttaattatttt

SEQ ID NO: 73994 - DNA, 547 bp, Triticum aestivum
  Clone ID: PAT_TA_73994
ctacagccgtgccgccggatccctgccgcctccggcgaccctcaaccatcacgtcacggccttgcagctcaccccaccgccggagacgcactgccccaacccaccttccaccagcgatcgagttgtggttgcccatcttctcctcaccacgctccgcctcggccgcctcgccacatcagggtcatcaacgtcggcgtcgtggcgatcagcactgcacggacttctccagcacccccgtgacgtggtgggcaacatgcgcgcgctggccagcgggggagttgcccttcacgcatggctgccggatccctcgttgagccgcatccagagcttcctcggccgttccccgcggcggtgccggcagccaccacagcggacggggcacagtttcccccacctcgccatcgccatggacggcacaactgtgacccccggtggccggtctcccctccggtgagcagaggatcaccaccacaactgagccatcttctgaagagacgaatcaacggcagcggaccaccacaccggaccagaaccagaacggaaagaa

SEQ ID NO: 73995 - DNA, 651 bp, Triticum aestivum
  Clone ID: PAT_TA_73995
tcaagtcccggccgaccccaacgctccctccctctccctcgccaagctcatccagcatgcaccccgtcctcatcttcctcctctccctgctcgtgctcccgtcgatcttctggctagtgatcaagtcgtccccctcctactttgcaatcaccaaacggcgcatgggcgtcatgtccatgatcgcctcctcaaccatgactgtcctctccttaccctatgtcctcgagttcatccaggcgagcgggaacgtcagcctgatggacgagcggagggacagggaccatgggtcggagggggaggaggccacggggaggaaacagctcggcaatgtcatttgtatgacgtttgcggcgtacttggtggcggatctggtggtagggaggaagtactataggaaggacttgacggtcgtgaacggctacatccaccaccacgtgtacgcgttcatcgtcatcggcgccgtcgcaacctggcagacctccctgtttgccctctgcgccctcatggaactgccaaccttcttcctcgcgctcgcaaacaccttcccgaaacaaagaaacgactgggcgttcgcgagcacgttcttggcgacgagaatcatgctgcatgcgtggatctgctgggcgtacggcgtttgggtcacggaggggt

SEQ ID NO: 73996 - DNA, 406 bp, Triticum aestivum
  Clone ID: PAT_TA_73996
gggcgccatccgccgagctgccgaggtcaggtcgcaacgtgccacaaggcggcgtaacgtgacacgaccccaggggccccgaggctgctcatcctcgcacccaccgggctgacgcagcggaggagcgggagccccgtccccgtcggcccagtcctgcacctagggctagcgggaggccgggagctcgcctaattaattggaggaggcacaggactgaagacccagattattattttggtcatggagatggaaccaatgtgaggataattctctgagatcacatggtccgagaggttttcgaagggctgctggtctctgatccacggcgagaatgctgccacgaacctacactcctgcacagtcagtggtcagactcagaccgtatggattcctgatccttgggagt

SEQ ID NO: 73997 - DNA, 583 bp, Triticum aestivum
  Clone ID: PAT_TA_73997
cggcaccagggcgggaggatacgcggtgctgatggccggacagctcgtcgccggtgttgcgtgtgggttcggcctcgtcgtcgcgcccgtctacatcgccgagatggcgccggcggcgtcccgtggcttcctctcctccatccccgagatcgccggcaacacgggcatcctgctcagctacatcgccgacttcgcccttgccggctttcccaacaacgtcaactggcgcctaatgatcggcgtcggcgccctcccgccgctatttctcgcggtcgccacgctcctcgccatgccggagaccccgcgctggctcgtactccacggccaccacgacgaggcccgccttgtcctcgcccgcaccacgggcgatgcggccctcgccgaccgccgcctcaaggagatcgtttcctccgcgcaggaaagctccaagcaggccgtccccggcggcagcgacgggacgacccggtcgacaagcgtctggcgcgacatactgatccggccgacgcggtctgtccgtcgcgtgctgctcgccatcctcggcctccagttcttccagcaggcgtccggcgtggcggctctcgtg

SEQ ID NO: 73998 - DNA, 453 bp, Triticum aestivum
  Clone ID: PAT_TA_73998
ggtatgtaaaatgcttctgatcctgttggatttattgcccttttcttcactctgataaattgctgtttgatgtcagtattcatcctgttctactgagcaataacctagacactaatatccctagacactaaccttaacatagttgagtactatcagagtccaagtctgcacataatataccaatatatcaccaaatttctgtatttcgttttactattcatggtataatttgcatggttgttataattgaattcttatagtcacttagttccacatgtagcataaactccctgtcagtttttggagattgtgtacattaatctacaagttgacaacatattcttttttgttctaagagaacttgttccgttgtcagttaccattcagtaatgatcagtatgccaaacaacacagggtgttacgtgtggaaatttccccctggagtcctcattt

SEQ ID NO: 73999 - DNA, 131 bp, Triticum aestivum
  Clone ID: PAT_TA_73999
ctgcggttttcctaaggctagctagatgtgattcaactacatactgtacatatgtttcatatgctaggctgggttgtgcttattttggttagcagaggtgcacttttaactaaggctagctagatgtgact

SEQ ID NO: 74000 - DNA, 695 bp, Triticum aestivum
  Clone ID: PAT_TA_74000
cggcacgaggcttatgctgctctgacacgtcttcgtggagagtatcaggagttggacacctcccccttcaggcacattgctatcacatctgatattggtgcggagggttactacactgctgcctactccactgtcacccgagagcccttctaccatcagaacctggttctgcatgctgatgggctggatcgagctaaccgagctcttcgccacgagttgtacaccactcgtcagcacctctaccgtgctctaaagatgttgcaccccttcgttggatctggggagctgccgcgttctgctatctacccagccaggaccgtgatgccccagggtgtcggttggccagaggtgggaggctactctcccgcacttggtcctcttctgccacttgagcgtcaggttctgcaccaaagtacccgcggcccccaggttgccgacgtggtgtacccgctgccacactaccagctttcgggctacagctacctccgtagtaccgcttcagactgatgtagacttgcttgttagtgttagatgcattcgccgcgagcctgtgtgccgcctatgatgtcttagcctatgtaccgaactctgggtaacgaactctatgcatgatctcctttgtaagatatgccgactactatgtagtatctatcgtgctgctttcgttgtgcatgtttcatcatgaatgatttttg

SEQ ID NO: 74001 - DNA, 715 bp, Triticum aestivum
  Clone ID: PAT_TA_74001
cggcacgagccaaaccaaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatg

SEQ ID NO: 74002 - DNA, 482 bp, Triticum aestivum
  Clone ID: PAT_TA_74002
cggcacgaggcagggcaagacaagaacatttagttggatccagagtattgagattgcagaggactcaacaaagggtctgcacttattctataaattcagtatcacgttagtgcctctgtttagtgattatatagaactaccttttgaacttgcagaaattgaatgcatataaggatcgaggacctttacattggatgcatgatgatgatcatccaccgagcagcacatcatcttggaaaagcatatgcaaatttctgctaggtttgcttctccggttgtccctcccatcaactctctcagctcccaaaccattaaccccgtcctggttgttcctatattttctttttgttttgtttttaccaatgcacttttcttgacatgttttagtgtgttccttcctacggccagctcgaccatttgctccgcagggagtttttagctcagaaggagcaaataatttgagaatgcattggtcttttctg

SEQ ID NO: 74003 - DNA, 536 bp, Triticum aestivum
  Clone ID: PAT_TA_74003
gaggcgccaccggcctgcctccccattgcttcaccggagcgccgccccctgcttccaccgcgtcgctggcccacctctctgctgcttccaccgcgtcgccgccccgcacactggttgccagtcgcgtggccgccccttgcccaacctcctagccgtcggtgccatggccgcgccaccgcttcgcaagcctccgttcaacgacataacaccaagccgttcgatgtcgcggctcgggagaattctcaagccacagaaggtcccaggacattcactgtcggcaccatagtccgttcaccgacgcaaagatgaggtcgcgttctcctccagccgcagaccaatgctatgatgaacattcaaggcagcaagcacaccacaggtcgcagcgccgccgttgatcacatgtgcacatccgtgcgattgatgtgtgtgtgctttagtccaactgctgtatccggctgggctgctcatgtgacgagctcctcttccagagatgaatttagaggaagatgcagcactggaacgcagaagactcagtt

SEQ ID NO: 74004 - DNA, 626 bp, Triticum aestivum
  Clone ID: PAT_TA_74004
tgtaggtcaatctcacccttgtggagaaatactattttttctccagatttagcctacactgtccaggttgtatgcttcttctgagatcccatcaaggtaatgctcttcccccacatgttgttcttgcaaggaaagtataaacaagatacaagtgagtgtttatggggttgcttgttcgtatgatttgttcatgtgcttcatgttataattccattcaagtaaagaccaaagaaacaagctaccctctttactattgaagttttgcaaccatgttaatagttaatgcaaattgctggactcttctgggaagataatttcaatagtttatttctgtaactacttgttagccttttcttgttcaacaataaaggttgagatccctacaagaaatggttctgattggtactccttagatttaaactaatgaattatgttaagttttatatatgaggttgtgtttctgccatgtacactgtgtgtgcatgtgttgtttgtgtcgaggttaacttatagtttgcaatcagtttggtttggttttttatgagctgtgttgtgttgtgttgtgctgctcatggttgtgttgtttattgtattgtgttaaaggtgcatgattcacatatcttgat

SEQ ID NO: 74005 - DNA, 612 bp, Triticum aestivum
  Clone ID: PAT_TA_74005
tgagcggagggaacctgtagtggtgcgccgcccccatggccggaagccgtcgccgccgccgccgcggatgagcgctgctgcggcagcagggcaccgaaccctcgccggcggaagacgccgctctcagctccagagaagttactactgtggagagtccctgccatgcctcagcctctacctttttgcctttgcctggaccttatgtttgtgcggatctcctggacagcctgcttcatgaaattattgctctctttaactcattccaagacttccttgctttcattggcacctgccactcatggcgcactgcagtctctacctttccctctgtgtatacattcagcttcccgccactccatttcaaaccagatggtccatatgttcatccacatagtggggatgtcaagcccatccttttatctaattgcagatggcagcttagtgatcctaccaagaaaaacctatcccttgtgtgctcagtgcctgaaaatagtccgaatgcaatgcactatttgggctgctcatatgggtatcttatcttctcctacgaggagcactgcctccttgtggatgtgtacactggtaccaatgtgaagccccccaaactcccac

SEQ ID NO: 74006 - DNA, 578 bp, Triticum aestivum
  Clone ID: PAT_TA_74006
cggcaccttatcgtctttttacttattcaataaagcggagctaggactaacgtcctaccttttcgtattaaggtcctttacgggctgatccgggttgaagacattgtcaggtggggagtttggctggggcggcacatctgttaaaagataacgcaggtgtcctaagggggactcattgagaacagaaatctcaagtagaacaaaagggtaaaagtccccttgattttgattttcagtgtgaatacaaaccatgaaagtgtggcctatcgatcctttagtccctcggaatttgaggctagaggtgccagaaaagttaccacagggataactggcttgtggcagccaagcgttcatagcgacgttgctttttgatccttcgatgtcggctcttcctatcataccgaagcagaattcggtaagcgttggattgttcacccactaatagggaacgtgagctgggtttagaccgtcgtgagacaggttagttttaccctactgatggagtgttatcgtaacagtaattgagcgtagtacgagaggaactgctcattcagataattggtctttgcgcctgtccg

SEQ ID NO: 74007 - DNA, 350 bp, Triticum aestivum
  Clone ID: PAT_TA_74007
ctgcaggcttcacacctcttctccactaccttgtatgacaacaaggagatcattcctatggagtacccatatggctcccgcggccctgccgtattggatgacttcacttcttcttacggatacaagttcagcgacgcagcaggataccagtggcccatgaacgagcagaagttgtagatggtgactacacttagaaagcgcctcgggtgaggtctgctcggggtgacgaagaatacatttttgggagggttgagcagcttaggtgcactcaagccaatagataatgaatacaacggcatttgcatgtcgtaaaaaaaaaaaaaaaaaaaaaaaaaaaaaaaaaaaaaaaa

SEQ ID NO: 74008 - DNA, 713 bp, Triticum aestivum
  unsure (1)..(713): unsure at all n locations
  Clone ID: PAT_TA_74008
gtcttgttcttgctattttatgttgttggttattttctcttgttgaggtgactttcgtttttatgttttttcagaaagtaaaatcattgaagtggaagttgtcttttgctggtagaagaaatgtgaggcagaaacgttctaccgattaccctacttgttctaccttgaccagatactctnggaaaaaaaattctctggagtagtagatggtatgtgtcctaggtataagaatgtcatcgaaacttgtggcatggggtgtcttcttaattttgtgaggactgaggttcctctcaggctagttaagtggcttgccagtaggttcgatgtcccttcttctgaattccagttgaaaaagaagttcattccaatcaccaaatatgatattcacaatatccttgacctcccagtagatggtgagccactcctttgtgatcctgagtcaggacgtgattttgtcctctctcatttcaatctgtcaagtattcctccagtctctttcttcaccaagaagcttaaatcttccgaagtcgagttgcctgacgatgacattttcatatgcttcatgattgttgctttctcctcctttctatgtccaaactctagtctcagtcctagtccaaagtacctacacatcttcaacgattgttgatctgtttgcaagttggatctgtcccagtttgtttatgagtggttgctgtgcagtattaaaaaat

SEQ ID NO: 74009 - DNA, 548 bp, Triticum aestivum
  unsure (1)..(548): unsure at all n locations
  Clone ID: PAT_TA_74009
gcttccaccgccgtcgcttcctcacgtctccaccggcgagtgcataaaacttgatcttccagagctccgcgaccacgaaacacttgggcgcacgtccgagggcctcctcttcctgctccacaagcgcaccaacattcgactactaaatccgctcacgcgccacctcgaagagctcccgccactgatcacgctgctgcctccttaccggcaaacagcttcaatggacgtgcactgtttatggctagacattgctctctttcggtgtccacaaaagtttttccctccatcagttctgacactatctacatgagcttcgatttggatgagagagtgaatatgcaaattcaagcctacaatgttgtggttagaggtaccgaacttgcaagctacatcctgaacagctccacggcagcgctgccgtcgccgcttactcttgttgactgtctctccttgtgcaatgttgtcaaactaaattgcaaacacttagcatcagtgatttgagttgcaattgtatttgttctcnnnnnaaaaaaaaaaaaaaaaaaaaa

SEQ ID NO: 74010 - DNA, 529 bp, Triticum aestivum
  Clone ID: PAT_TA_74010
ggcagggcggcggtcgttgtcggcgacggggaggcgtgctgaacctgccggctcgacccaggagcggcaggtgcagaggcgcgtgcgctacacccccaccccgtgctgctctccgccgcccagtcattgtgcccgctgctcaaactccgccaccccatcggccgctccgacgccactcatggtatccgggaagcacgcggccattgctcgattctcgcctaactaggtcgccgcttctccttggtgttccacaggagaggagcatccgcctccacaactggagagacgcatcttctcccctcctcgacagcaacacagggacggaaccatcagctgagatggaggatgccgccctttacggcgcgctcgcggtggcctggttaccatctcttggagagaggcaggcctaccccttctcccccacaggtttgctctcggttctattggcaagggatctttgggcaatagttgagcaccaaaggacaatctaaattactatcatgatatttcaggtctcatgtcttccggc

SEQ ID NO: 74011 - DNA, 614 bp, Triticum aestivum
  Clone ID: PAT_TA_74011
tttttttttttttttttcataaccttcatcgcagtagacgatatgcaactacaagcagttcattcacgattcagataatggtgttgttccgctccctcgaggagatagagacaaagcaaactgcattgctctgcgtaaacaccaaaaggagacgagcaacaaacgttgctgtaatattatcgcctgatgttgccctcatgacctctctactgcctgcctcccgtgaatggcatccgctggaccaacaactttgccagcacccgacacccctgagccacacccctgagccatgccactgccagccaacaacttcatgtgctgtcctctgttgccagcaccggtggacatccctcggcccagcatctttccattgccccctgctgaagtacatctttttccctttttcttgtaagagacagtagtccataaatcctcctcattatggggttgatcttcttttaactcaacaccatatgtttggagatcccactttgagtgtaggtgtaactgaaacccatgcatctttcagcgtcaaactcacccaccgcttggagagccttggtgctcgtgttgacagcaagcacccatgcgttgcgatctgagagagaactagt

SEQ ID NO: 74012 - DNA, 495 bp, Triticum aestivum
  Clone ID: PAT_TA_74012
ctgcggccgcactcggcagcatcctcctccgtcgccaccacatctctcttccccatctctcctcatacatgcccgagcccctccattgccgccgcctgcaccttcgctgttccgccgttgaggggagcagcagccaggacacgaatttgccagcgtctcaaagagaagagtctccatcgagcagcctcggcgccaccctccaagatccacttccaggacgtggtctctggttattgtggcctcctaatcggaagtcctataattttgtacgagatcatagcatttgttctccctggtttaaccaaggacgagcggaaattcctagggcccattgttttgggttcttcagttctgttctaccttggcattttattctcctacactgttcttgctccagcagcattgaacttcttcgtgaattatgccgaaggagcggtggaatcgatatggtcaatagaccagtactttgagttcgtacttgtgcttctgttcagc

SEQ ID NO: 74013 - DNA, 693 bp, Triticum aestivum
  Clone ID: PAT_TA_74013
tttcgcagcagcgggtgatgcatgtgcttattgttggctgttggtatgtggtatgcattttctcattgttggctgtttgttgtttgctatgattaagatacattggcatgtacattttatatcagtttcgttttcaacaccacctatcactgtataatttgtcgttaatagagtagtttctcctttattgcattgcataatgctagcaagctacattgcaccataaacaaaaataatcctcttccatggttaaacctgttttttccttctagcaaagatcttctctggaaaagatcaattctgttagcctataatattgcagttctttcttatccttcaaagatttaaaattattttctgtttccactccattcgttctcatggattctgaaaaaaatatttttgttttttgttgattaataatattgatttccgtttcagttttgtggtggtcgatgcatgtagaatatacggactttcctagaatggcgccttttagtttttttgcttgatgttagttcattgatgagaacacctatgtacatgattgttgcatgcatgatatcctactatatactgagaaatatttttctttttcggacattgttttctaaatcctatcaatatattacctgatatggtctttgaagtttctattttatagcgagctttgcactggtcaacttgagtatg

SEQ ID NO: 74014 - DNA, 404 bp, Triticum aestivum
  Clone ID: PAT_TA_74014
cggcaccagctcagggtatgtgcagttcttctattcagttctttttttttctgttcacctcttcttttctttctctctctctctctctgtgcctaaccaaaaaactgtgtgtgcctgacacatgtcttttttcattgaacaagacatcccagagcacggacaggcgggacttcgttttgcaaaagggatatcatcgaagcaagtatggcacctccaaggacggccgcatcttttttaaaatgggatgaaaatagttcactgcaagcacaggcctcaagtcacgttcaagacagccgtcagcagggagctggagatgattgtcgtcgtgaatgtcctctaagtatagttggagttcagtaggttatgctagtttgtgtctagtcataacttgtttagtttagctc

SEQ ID NO: 74015 - DNA, 741 bp, Triticum aestivum
  Clone ID: PAT_TA_74015
tggattaatttcacatatcctcctttgcaacatatggattaattttcagtagtctcagtttaaagtaaatgaaagcacgcacacatgcgtgtgtgtggattctactatagcagtagtactcttgctaaattcagagctcagtgacaagaatccctgaatgtaggttgttataggttttggttatacatgcacatttgggtcttaattcctgcctattttctctgaaaaaactgagacatgtttgagttggcaatgactgagataatgtagtaaccagtaaaaaatgttttatgaagccaaataaataaatatgcttttgtctgtgaactaataacaatattgctggcattctatggcaacatttgcagatcttgaggcatgtgtgtggctggaagaaacactcaagaaatttgaccgtatacttgtgatatcacactctcaggacttcatgaatggagtgtgtaccaacatcgtccacatgcagaacaggaagctgaagctgtgaatatagctggcaatattactaatgttgaagctgaagcttcagcttcagattctcttgtgcttccaacaatattcttggcaatattactaatgtgttaagttgtctaaacatgctttctgctagctttaaagttgatctaaagaaccattcatgcatttacacattcatgatttcctctgctgtttgtaattattctggttaacttgctagtagatattgcctgggatttgtagctg

SEQ ID NO: 74016 - DNA, 778 bp, Triticum aestivum
  Clone ID: PAT_TA_74016
ctgcggtcttgcttggcacctacggcccgagccgaagctccgaccgccgccgccgcttgcgatggaggcgctccgggaggcgacggccgagctgacggtgtacgtgcacccctccaacgccgccgacgtccgctgcgccgtctcccgccagctcagcaccctcctattctcgtatgaagatcgctttgatggcgtgttgctatcacatgaagttgaattcgaaggtgacaacgaagatgaccaagacagaaaagttgacggagacgggaaaaaggttatcaacgccaaaatcctggatggtctggtaccatattttggcgtaccggtgactgcgaacctgctgctgttttctccccagccagagatgatactagaagggaaagttgaaatgcttggcaaggaatcaattcatgccattgtcctgggggttttctcagcagccattatgtcagatgatatccctgagacattcaaattcaaaagaagaggacatggaggaaaatttataagccagtcggacaagcggcatgtgattaaaaaaggaagcatgatacggttttctgttaaaagggtggacacggaaatgaattgtcacataactggatctttgatgccacctcacacaggatgcatgcgttggctatcagtacatgatactgaatacgcatcggaaattagcagtggtaaaaggaaaccaagggatcatactaagagcgagcagaaggtacaagattgcacaactgcgaaccgcgaagatagcgtggtgaattctgaacga

SEQ ID NO: 74017 - DNA, 657 bp, Triticum aestivum
  Clone ID: PAT_TA_74017
cgtagtgcgctgcctctacctacgtcgctgcacgcccgcacacggcgggggagctccggttacttcggcagaatctgaaaaccgagcctttcgttcgtcattttgggttcgaaattacttaaccgagccgaacaccgaactacaccaaccgaatctcggtttctacctacctaaacgcccacgcctcttgctgctccacgccggactcgccaccggaggagggccaaaaccgaatacgaataaagccgccaagtcaatgcaggccgcgatcaccaccgtcgcctccgcgaacccgcatctgaagcctctggtctcctcgctgcggccgtcgcccccgcaccgggtccgagtccaccctcctcgccaccgcccgagcacgagggcgagcgccatggcctcctcggcgccgcaggagctcaccatcacgcgcccagacgactggcacctccacctccgtgacggcgacgtgatggccacggtgctcccccacagcgctaggcactttgagagagccatcgtgatgcccaacctgaagccaccggttacgacaacggcacgtgcgatcgcgtacagagatgagatcctcaaggcgctgcctcccgggagcagctttgtgccgctcatgacgctctacctcacggacagcactagcccaga

SEQ ID NO: 74018 - DNA, 727 bp, Triticum aestivum
  Clone ID: PAT_TA_74018
tcggcacgagaagatgatgatccaggtagttcgccagatccagcgtttaacttcgatgtagagctggccctgatccggacggattccgcctaagattttaaatcttcttctgaaaaacgttaggcaccgatgtttgataattccagtgcccagtgggttcaatttaagttactctttttagatctgaagtttctaccggagttgctgttggctcattcatattggttcagtatatgttcagtattgcctctgtattttgtctgtgcaagtctttagacctcttgtctttgccatgactagattcaaggagaattttctgaaaaattagatagagggagggtgtatatctgatccagcaatttgcaggataatgctgggagttttcaagcaccagtaggttattagcaatcctatgtctagggtaaaaaatttgtgacactagtaagtttgatgttttttcctttatttttctttcttccatccaactgacgtctgttgtaatagcagacactacacgttatgggtttgtgggaaagtgagttgttgcttttctccctgttgtttattgcaacaagggaaagcacatgcctttctctgcattttagttaccgtgttaattgtttcatgtgcaacttcgattgtctgatgcagttcgtctctgtacaattaatagcactatgaggtctgttttcctgaatcgagctcatcacttcatttttaattatat

SEQ ID NO: 74019 - DNA, 662 bp, Triticum aestivum
  unsure (1)..(662): unsure at all n locations
  Clone ID: PAT_TA_74019
cggcacgaggtaaagaggtatagttgattcatctaaatggtactacctctgttcctaaatataagtctttttagagattccaatgcgaactacatacggagcaaaatgagtgaatatatgtatgaggtttgtattgaaatctctaaaaagacatctctactactatagtacatgtttttttgaatatctgaatctaccttcgtctcacatgtttagcccgcctcttccaatatgaattcatttatagccgtcggatctattggatcgaatggcttagagtgcatggattcgccactcacgtttctcccgccaacctacaaacacccgcaccttctggaagactccgtaacccacgattgcctcctggtcctagctggatgcatggagaaaattgattgctggccccatccgctgtggagacgtggagcatatggctgcagaggaacgggatcgtgcgctgcatcggcaggggcaggccgacaggcaggaatggggatctgatttttttattcttttgataaaaaggaacgggatctgatcaaggggtgtggtggntgtgctgacgttctgctttttttttacagtggctatagctgcacagtggcaggcttagtggcccgtatggccgagcagggtgtcaaccaaaattcgtagttcaactc

SEQ ID NO: 74020 - DNA, 798 bp, Triticum aestivum
  unsure (1)..(798): unsure at all n locations
  Clone ID: PAT_TA_74020
cggcaccagatcaacggtcgttcttctgattttcctgccggtgttcatcttgatggctatttagtcggtgctccatctgtgctcaaccgtccaagagtggtacctttgcgtgcggctggtgcctttggtcggcctactcctcctcttgtatgcgggatgcagcctccgttttcaaaggattatatccaattgcttaaggctgaaagatatatggacgaccaagattctgacgatgatgccgactgtgattccgaggatgtggatgcttctcgtggacagattgtcgttaatgcttactcttgcatagaggctgatcgtctagagtaccatttccgtaagcaagataatcttcgatctgagacctaccagggcatatctgatgctttgggtgaaggtgacaagagattgcggatgctcttgctgccgaacctagccagactgctgctgactggcctgatattactactcgagtatttagtatgaaatttaaggaatttcttgatggagttaaagatgatttgtatctcgtggagtttcagaagagaggtttgccacatactcacancgttggtgtggttgaaagcagataccaagaacccttctccttcgtttatagatggacttatttctgcggagctgctggatcctttagttgaccctttaggttatgctcttgttgatgaattcatggtacatgggccttgcggggcgtacaatgctaagtgtgcttgcatgaagaataattgttgttccaagcgttttcctaaagcgttgagtgacggcacaatggttgaccat

SEQ ID NO: 74021 - DNA, 627 bp, Triticum aestivum
  Clone ID: PAT_TA_74021
tctaagcttaccaaaaacgtagatgctacctagacgtaaatgatatttgctggatagtatgtagtttaacttaacctagttccagtcttctagttgatgactggtataggttgctgcctggctgattggtgatagtgagctgtctattaagcaagatagcttcagaggcagcaccctgtaactcaggcagcaccttgttaaaaacacttgcagccattcccgtcaaaacttgttgctactttactctttttgaaagaatatcatcaaatactgatattatgtgccataataacgcaaaattctgccaatttcaatgtgaatcaactgtgcgattgaatatcaatgtatggcatattgctgatttgacaattttcttttctgcctgcaggaatgtatctgattatatattattttagattgtttgcagttttttcatcatttacccactcacctttatttagcaatgtgccctgtggtttacagcagaattttttagttacgctgctgcccatgtggccaccacttccacagttagctttcctagcaaaatgctctacagtatggtattatttggtaattcagtgtaagcaggtgaaagcatgcgcaaactacgtggcttctttgtgc

SEQ ID NO: 74022 - DNA, 743 bp, Triticum aestivum
  unsure (1)..(743): unsure at all n locations
  Clone ID: PAT_TA_74022
gagagggatgagcaacaagtctgaatggacagttagttaattaatgtgccctcactggttgtgttcgataggacgggccagggaagtgctttcggttgtttcaagactgagcttgataaaacgacagaatccactattcctaagatcaaaccatgtaaccttgcaaatattgtactacagcccaaagctattgggagtggtgacatcacaggtttccattttatgaagaaaccatcaagcaaaacgcaggcccctcgtattgaaatcgcaaagctccacaatggcggcaatcaccaacttttctaagcacatgatgcttttgggcagggtaatatagactctgtcatgagcatcattattgggagctccatcaccatcctgttgttccactcggtatgtttgaaaataaacatctggagcagaaccgacatttgcattaataaaagttcaaatagagaccatattactaatattatattgtagtggtaactcatgacagcaacaataaacctgattgggcgaagatcctagcttcttcatcatggtctatgtctccatttttttctccttggttcccgtctcccaagcattctgtttgtgaacattgaataatagtgtgttaggagtagtaaatgatgcccatttgctgttatgcatagtgnggagatgaatctaaaaatgacattatgcggaccatcaatgtttatcgtgtgcacatcgggctccagtagtccgtatgcatc

SEQ ID NO: 74023 - DNA, 765 bp, Triticum aestivum
  Clone ID: PAT_TA_74023
tcggcacgagagcaacctcaacaacacctagcctccaccacagcagcagcagcctcagcaacaacagcagcagcaacagacgcaaacacaccagacacccaatcaatcatcaggccggccaggacttgttgttggcccaagggtatgtttcctttggtttgctgtttgatgcatgtagctagtgttccgaacatttaatcatcacgaccagtaaacatctaattaccacacactgcctgttacaattattatattctttatgtactgacaactgtcatcccatggttaaaagttaaatgtgggagatttgccaacctgtatataccatgttgcaaaatgcaatgagtacatgccagttttgacctagtactttcattctatttgagtgaaacatgaccacaacccctaaccctgaagtcacattggttctactatgctcgaatcatttttgtactcaagtgatattttaatgtcaacttgtgaactatctgtattgctgctacaatgtcaaaagctacctattttacataaaaccaaatctattgcacagaaccagtaattatccatttagttgtggatcctaaatagtaaattcctccatagtccttgcactcattcctggtagtgttttttaactacatttccactgcttatggtatcaattattcgcaatcgctagtgaccaggcggcatatctttgccctggcctgcttccacattttatatcctacgtaataataattcttatgcattgccggttcatgc

SEQ ID NO: 74024 - DNA, 743 bp, Triticum aestivum
  Clone ID: PAT_TA_74024
tagatttacgttcgccttttactcgttctattttttgcataattgtgtcctgtctgttaagacatgctgaaaagctagctattctgcagcaagcagagagtcatgggctctttctgtgagtcacctgcttctcatgtacaaatatttcaccatctaagtttgaaataaaattgtacatcgaagatatcaatgatttgccaagactccaaagtcttgttgttattttttgtaacttctgatcttgaactttgatagacagataattatgactctttgacatcagaaaatattttagtttattttggggtggatgttattatggcatcaatacggcttcattccactttatctggcgcgacacagtgaataagaactgcagtagtttctcaatgtggaggccattatatttatgatataagatggaatcccgaagggcgatgtatacttttggggttaaggatataaagaacaacatggcttatgaggttgaagagagctcaagtggcatcttttggttcttggaggcctgcactttcctggtggagcagtagcaaaataattcagaggctttaaagctactccacttcacgtagcaaataaagagaaggcagatgtattgttttttctggagtacgggatatgtattgttacgagtgaagccatccatacaagtcgtggatgatatccattccaattattgagatgatggaagcaccacttaggagttttgtctctgacctaac

SEQ ID NO: 74025 - DNA, 206 bp, Triticum aestivum
  Clone ID: PAT_TA_74025
acgaggatgtggaggagggcgctgccgatggcgccagaagcagctcgacaagaaccaccgtcacgcggaggcaagtcgccatcgacacggcctcttcgtctgcgccatcaagggccaacagctccagatccgggagcatcttcccggaggcggagccggcgactcctgatgcacctggtgatggccggggtagcgatccagtcgac

SEQ ID NO: 74026 - DNA, 685 bp, Triticum aestivum
  Clone ID: PAT_TA_74026
gaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtgaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgtgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagtttgaggccaagcgcgccaagagcaaggcaagcagggagaggaagattgccaggagggaggagagattggctcagggcccgagagatcatgcaccagcaccagcggctgcagctcccgctcaggcagcagctgcacctaagaaggccaagaagtgaaggtctgataagaagctttatctttctggtaatatc

SEQ ID NO: 74027 - DNA, 730 bp, Triticum aestivum
  Clone ID: PAT_TA_74027
ctactgtccggtaggaatttagatgattatgttcaagtgaagcacatcctagttgaaatgggtgtttactttcaaagtcaggacgattatcttgactgttttggtgatccagaagttatgggcaaggtaagttgtttcacttcctctattattgcagaagaaattttttgcatttaatttgtgaaaccatcctgtcgcaggttggaaccgatattgaagacttcaagtgctcttggctgtttgttcaagcactagtacgtgtcgatgagaggcaaaaagacatcctatttgtaaggcacatgaactggatcattctataatattgtgtagcacaccatcttaatgtctgtaatgtcatgcacaggaaaattacgggaagtcagatcctgcttgcgtcgcaaaagtgaaggctctgtataaagagctcaatctcgagagggtgttctctgagtatgaaagtgagacttatgaaaagctgatctcagacatcgaagcgcagccaaatgaagctgtacaagcagtgttgaaatcctttttgcataaaatctacaggaggaggaaataggactattcttgcatacaaaaagattgtcggatggaacaacttctttcctgtcggcatgtgcaagatgaataacactcccttcttccaaaataactgtcgttgtttcagttcaaattacagagggagtattacttatgaatggtccagagtttttgcataccatgt

SEQ ID NO: 74028 - DNA, 652 bp, Triticum aestivum
  Clone ID: PAT_TA_74028
ctgttcaggtgctttgtgataaaccaccctctccttctcaaaataattgaagttctaggattgtcctaagtcaaacttcattaagtttgaccaagtctatataaaaaaatgtcaacatctacaaaatcaaatttactttgttagattcataatgaaatgtattttcatatcatctatattttgatatcctagatccttgcggatttttctataatgtttgacctagaaaaatcctagaacttcaactgttttggaacggagggagtattcactatttcagacccgtatgcctcgtgtaccttttggtaaccccattttgtagaatatgtatagttgtatggtagctgctgcagttttccacttgcgtattgtagttgtgccgtgcttgttcttaaaaatatgctggccaaaatttagcctattggctgctaaaaacttaaatagcaaatcacctgttctatgcaactcctttatatgtgtgacttctattactattaagacatcttcattttcattgaatgactatcacaacttgatattattttccttgttatagatcattgcaaaaatggctgctgctaatggagtaagacgtgtctgggttggacaagacagtctcttgtcaactccagctgtatctgctatcatccgt

SEQ ID NO: 74029 - DNA, 648 bp, Triticum aestivum
  Clone ID: PAT_TA_74029
cggcaccagcgcagaagacggattcacgcaacacaccacacgcacgcacgtacgccggtgacaagcggaaggaggacgccggcatggcgaagagcggcacggaggagtggcgtcgcaacgccgacacgcacaagatgagcccggaggaggtccgggccgcgggggtggaggcgtccatgcgcccgccgggccgtggcggcggcgccggggaggtcctgcaccagcgaggcggccgcctgccgtacgggcccgggacgatggcgctgatggggttcggcatcgtcggcgccatcggctacctggtgctgtaccagaaggcgaggcccggcacgccggccacggaggtcgccaaggtggccgtcggacacggcgaccctgccgtcggccgcgaggtccagaagcgccaagacgaagcgcagccgccgccaccgccacgcgaagggaagtagactagtttagtagcagaagagctggaggatttgcggcgtttgtgcttcgagttacttctgactcgattttatctgctagccgcgcttctcagcttgggtaccttttgtcgtggaccatgcacgcgtgtgactttctatcagaaatgacacagcagaaataaataatcgtagatgtattaaaaaaaaaaaaaaaaaaaaa

SEQ ID NO: 74030 - DNA, 628 bp, Triticum aestivum
  Clone ID: PAT_TA_74030
cggcaccagctctcgcagctacctcggtggcctttggagcgcacgagatggcgtaagttctcccgccgaaagaaaccttggcactgctcgtctctgtagtcttgattgcagtggtgtgctgcatatattaaatccgatacgtgttgttatcttgtttgtaactagcgagtgcttttgggctacttatgaaatctcagtgttggtttgtgctcttaacatccaggggcgcaattgtttattttgtcgttggttggtcttccccaattaacactgatacacatgtgttatttgttgggcatttgggtattatctttagaatgattttattctgcaagtagttgggaagcagattgtttagtaccagttgcgttcatgattattaaatattataagatactagttgaaatttcaaaaataataatagctgttttactctgcttgcaaattacagcggctttcaatagtgtgccctccttgtgattttacacttttgaacgatgtctattgtgatctacctacggtgcaagatagttgtggtacttgattgtttaatctcgtatcccctgcaaaagaaaaaaaaatctcgtataacatgtaggttaatgtaacatgctggtacctgattgcc

SEQ ID NO: 74031 - DNA, 618 bp, Triticum aestivum
  Clone ID: PAT_TA_74031
tttttttttttttttttttttttttctctatttttatctgtctgggtctctttttatcatatacccccgataacttatgtgacggtaatatacaaaccacatgccccataccctatgtacaaataccatggtaacttgactagggggttgaaaagcatcccccgataacatgcgaaaataccatggtaatatatcaaccgcatatccaataacttacgtacaaacaccacgataactttgactaaaatggaaaaaagttgttgaaaaaccataacccggtaacttatatcaaaacaacatggtaatatacaaatagcatactgacatcttatgtacaaacactgcgataacttttcagcaaagaggaaaagttgttgaaaatcatccctcggtaacttatgtgaaaataacaccgtaatgtacgaattttcagtttcatttgatctcatctcaggaaggtacaagtaatgtgcaagttgaaagaaaccacatgacgtggtgtagcccagttggttgttgttgctaaattaattgtgggaaggttgtgggtttgagtcccgtcctattgcatttgcatttttttcgcttttttcaaactgcaagcgagggtgtgtgtgc

SEQ ID NO: 74032 - DNA, 723 bp, Triticum aestivum
  Clone ID: PAT_TA_74032
ctgatggtggtggtcatgagtctgaattcagatcacagagggaggcagagtcggtgatgctcatgggtttggacaccgttgccaatggggacaggacggtcgaatcacacaagccaatgctccaacctgcatatcccagcaccaacatattgggttgtggcggcgacgatgaaaaggatgagatgggcatgcgcaaatcagacgcgtattggactgtgaactcggacaagttgatgctcaaacctgcagacacaattggcagatgctctgtccaaggctgtcctgatcatgacgagatggacacactattggctaaggagatggctagcgaggcggagagattcgcttcatatgttcgcagctgggaatttgcctggggcagaacgtgcggcttcttcagagacatgagtgacggcgctgagttccatgcagtttacgcactacacgccgggacaaaaactcaacagcggtcctgcgtccgccactcaaaccttgcagatcttctccatcaagctcacagaaatagctgtcggccttaagtggccattgtctgtgtatggcttggttgctgtccgagacgtcgcggatcacaaccgcaaccttctcttctctcgcaataggagccaggcccaagaactgaaagaagatgataggattttgcggttgatcggcccatcacgcgcaattgtgtttacggatagggttgactttgaaatccaactg

SEQ ID NO: 74033 - DNA, 619 bp, Triticum aestivum
  Clone ID: PAT_TA_74033
cggcaccagccgcggagcgagccccggagcagcagctcgctccgccgccgccgccgccgcccgagcgcgccatggggttcgcggagcgggccgtcgcggcggccggcgccgccgtcgtctccgccgtcctcgtcaaccccctcgacgtcgccaagacgagactacaggcacaggccgctggagttgtctacaatccgatatggtcagattttaggtgctatccatggtgtaaccctggtggactgaaattaagtggtttaggcccatcctgcagtcctgaatgctttcagtatagaggaacaatggatgtgttctctaagatcgctagacaggaaggaatttttaggctatggagaggcactgctgcaagcttagcgttagctgtaccaacggttgggatatatctgccttcttacgacctgttgcgcaattggattgaggaatattcagatcacagttatcccaaacttaggccatatgcccctctaattgctggatctattgcacgatcattggcatgtataacttgttccccaattgagttggcaagaacacgtatgcaggcgttcaagcaatcaaatggtggagcaaaaccccctggaatgtggaagactatgct

SEQ ID NO: 74034 - DNA, 689 bp, Triticum aestivum
  unsure (1)..(689): unsure at all n locations
  Clone ID: PAT_TA_74034
agccctttaaccggacgccatggggcacgccgtcgccgacgccgccgtgccgttgcgccgcccggtcctcctctttctccggtccggccgcctgctctgctccgtcgcgccccgctcgacgtccgtacgctgcctacacgcgcgccctgcgaccactcgacgccctcgcctccagacgacgaggaccctgaccacagggactgagcgcccagacagaaagcgaagaagcggaaggtcccatgagccgagaattggggcatgaagctagccacgttctcaactatgcacatcaagctgcattgccagaccagaaccgtgtaccacagaagtggcggacgctctcatgctcccgaacataaatggacccgatgtgcagcaaaacactgaagaggcactacaatcacatngtgagactactctgcggtgcacaatctgaaccgacggaagaccttatccactcttcgaagaatgcagatcaaagcaggataccagcttcaatatcagaagtggcatagcagtccatgacgtctgaccaccaagcagggagcgagttagctcctgcaaagcgacggagagcgaaacctatcattgtatgtgaacttgcgaagaaacggttagatgggccttggcctggcaacacaattgcaggtaaccgaccaagttttatgggaggaactattgatggaatt

SEQ ID NO: 74035 - DNA, 726 bp, Triticum aestivum
  Clone ID: PAT_TA_74035
gatttacttagtctctcgcaatataatacaacttttaattaattcaatcatatgaactgtatcatacatcgaggtaaggttaaatgaatactggaatcatatttcgacttcgaatctttcttttatctatccacgatcaataaaaccgaaagagcctcatcgattcaatcaaggaactttagatattcatcatactaaaattgaataaaagacgataatatataatacattaattcttaactcaatgtaaactcatgactctacgaattgatcacataatccacattctacttgcgactccgttgttggtaacaacaaggcattctcgatccatatgattcactcattatagcttgatactatactatttacgaaattctatcatttgtatgcatatgtttacatacgattcactcgtgagtttaaattaatgtaacatatatatacttagattgactgcaatccaacctccacataattgacatccattacaccaataggattgttaacaacacataatattataatatcgaatgcaatatggcatatcaaaggactcgaaattcaatccaactttatatgatatttcactaactgtaaactcatagtcaatatgtcttcaattgcaatcaacttcctaattttatttagaatcaatattcggttacttgatatttcattctttcactccttttaatatttgcagaactagcaattccactatcc

SEQ ID NO: 74036 - DNA, 680 bp, Triticum aestivum; identical to SEQ ID NO: 65997
  Clone ID: PAT_TA_74036

SEQ ID NO: 74037 - DNA, 673 bp, Triticum aestivum; identical to SEQ ID NO: 65998
  Clone ID: PAT_TA_74037

SEQ ID NO: 74038 - DNA, 730 bp, Triticum aestivum
  Clone ID: PAT_TA_74038
aaaataatttaactagggccccccctggcggatttggtacagtatttttggcaaggggatacaaaataaggcaaaaccggggccaaaaaatccaacgaccaattttgggcccccccttgaaaaattggggggtggaagctgccttgccaaaaaatgtttccccctcctctacctggcgggtggtaaacaaaccgatgcttaaagctcgtcctttaaaggctcgggggaagccggttcccccgcctttttggggtccgccgaaaccgcctgcccaaaaatttctttgttttttttgaggaaagaaacgaactcgggggccggcctgccgcccttgaacgaaaccttttttccgctgggagggacaaagaacaggggggggaaaccctggacataaactcactgggcacgtttttgggggcgggccattttggggaacacaagggtcttttttttttgaagggggggagttgccttctcgaagaagggggctaattttttgcaggggcccgcccgggggggataaaactctgaaaagaaacctttttgcccaaatttgaaaaccccgcgtgggaacgttggcgcgccccaactaccctaaaaaggtttattttgggggcctcaagaaaaagggccaaaacccccctggagagggggcaatttgccaatacaaagtattccttctccccaaaaccaaaatttggcccgcctcaacccggttctttaaaaaata

SEQ ID NO: 74039 - DNA, 853 bp, Triticum aestivum
  Clone ID: PAT_TA_74039
atcaccccctacattttactatctcgcatgctgctccttgcttcccatgtcaccccctgtgaacgggaccactcacatgaacatggcgcccatcgcacatgcatactgtgtgagcgattccacccatgaccatgtagatgtacgcgcttggatgtatcgatctgcagtgtgtccatacctgtaagattacactgcttaagatgaacacgagatccttgaagagctgctggccgctcgtgacgttaacattgcaacgcacgacgatgatcacctatgatcatgccctgtggcacacagagagcacctagctctacgtgccagtgcttgagccctctggacaccgagactccatcactaccatgatcaccggaacctactagactgactgtaccgcgcttactgtcagcttacagactgcctgattggagggtgccatgctgactgactgatcaacaggagcttacgcgatatttgctgtcactctggcaacgtagcacattaccagccgctcatgcgattaacaatgccccacttctatcgacttggacatgccgttagtggaatatagccacggatccacttcgtactctcaggaggtggcatgcccatctacttaccatcccctgaatagcataatatggttacctgcttgcatactgagtttgaagacttcccctccttggctggtccaaaagcctaacccttatttggggctttaggcaaatcaaaaccccaaatagtccttaagcctagcccggaccctttccctaaaagaattgcccgggaagaagggatgggcacaatcctccgctcacgcacttgaaaaacctaaagatgctcggggtggccagtc

SEQ ID NO: 74040 - DNA, 669 bp, Triticum aestivum
  Clone ID: PAT_TA_74040
ccttccacaattcgcgcaaaggcacccagggccggacccctctgacctgttccccaccccacactcggcccaggacggcggagatgtctctgactacgctctagtgtcggaagcttgacgaatcgtttggcgtcgtcgacaactggcgcgaggaggccgtgtccgcctgctcgctgttcccggtggttcttgtctggggcttttcaggttgggtcgtgtctccgggtgacctgttttacttgcgctgttgctgctacttcttcggtgtcggtgtctatgtcgtcatgtctcctctgttttcatgattgttcttttttttcctttctcttattgtttcttttccttggtcgtctgatcttttttttgttgttatttgtcttatttcttcttctctttttttactgtgcttcctattgtctttacgtctttattttctctcctctatttctattttttttttttttatttatactattcttctcctttctcttctcgttgtttcctctcgtctttttgctctgctttttttttctcctcctttatgttttctcgctccttttagtatctcttctctcttctttctattcttttaccctttcttttttaattatttatttcctttttttcttttttgcttttttttctttttttctttctgactctttttcg

SEQ ID NO: 74041 - DNA, 697 bp, Triticum aestivum
  unsure (1)..(697): unsure at all n locations
  Clone ID: PAT_TA_74041
ccgactcttgattggattacggatgataacatgcctgccgaacgtaattacttatttcaaacatgtcccgcctatgctgtgcacagcgccatcccaaactgacaagactacaggctatatcgcatcctaggagtacgaccctgaggtcagcagcaaagacacaagactcaccctgcggatcacgaggacgactacctctacactagagtgctcatcggcgaatcccaagttgcttggagcagcatcttatcacgctacactcgcagcgagcactgcctagagtactagttcagcatcagagatcagttcgtcacccgcaccctacaggtacaatgtcncatacttaagggtcaaaaatcaatactgctggacaagagaggtatcgtgcaatgacaagntgttactagagggcaatctgggcaagctctcttgtgcctgacacaacaataaactgatcatcgaaacatcatatgggggttagtgagatccgtgacaatgtttacttcccaagagcattatgaacggttggaaacaaaacccaactttaacaccttacggggggtacctacccaaactgagggccttattcagaaaggatagctacctttcttgagactccccctggaaaccttaaagacctaaaaatgtaaaaataaacttttcgaaattgatcgaacactacctccacagccttgtg

SEQ ID NO: 74042 - DNA, 714 bp, Triticum aestivum
  Clone ID: PAT_TA_74042
ctattatctgtacttggcaccacactacctagtatagttaccatcaaccgcctttgagtacgtgtatttgagtaatgcacagtttgctcggtctgccgctgatgcgcttggcgctcgcatgaaggactcgatgccacaatagaacagcaacatgtgatgtgctgacatagaactgcaaccacgtgattcgtgggctgtatctggaatgcaggctttgcgagctcaccgaaacatagaggagattttgctctcaaccacaatggtgggcgtaccgcgcacaatcttgcgctagatgaagcattgaacgctgagcacagagaggccaagccctacctgcatctccagcagagagcgggactacttttcgaagcggcttgatggagatggtttaagaacagacgcacgtacttgctgctatacagctatacggataacaggggacggaggcattattctgggtgccttccggaagtcgcatgattcctctccaaacttattaaggacggggctcctggtactcatgggggatacattctctgggcggcattgccaagaacaacactctacaaaccggttcaagaaatcttgatgggaacaagtgggaccgacttctttattggcaaatccttctaccaaagtggccgggaaaaccaatactggggcccccctatgtttgtggggccgcttacttcgggagacttgttgtgggtcaac

SEQ ID NO: 74043 - DNA, 607 bp, Triticum aestivum
  Clone ID: PAT_TA_74043
ccgaggttttttttttttttttttttttttttttttttttttttttttttttttctttttttttttttttttttttctacctggcccaggtgattttgcgggcgggcaaaacaaatagttaagtgggtttgtttttagtacctccccaagccggtgaaactttttttatttaaccttgggcctggaccggtttacaaaaaggggggttaagttggggggaaaccttgcttggcccgcactttttaaaaaatcccgaggggtaccgggcggtgttttttgaccttaggtgggggccccttggcctttttttttggggtgctccctaaggaaaacttcaagttcttggccttcaaggttaaccccataatttttcccactttgacaggggagaaaaaattggccgccatatagttttcacccatggatttgttcttaacggcgcgaccccggggcccgcccttgtggcgcttttcaaggttttttcgggacttgggggttttttttgttttcctggggggcaacgaacaaacctccggcttttttgccctttaagggttttttttttgggaggtttgtactctttttcttttttcccccggttttccct

SEQ ID NO: 74044 - DNA, 506 bp, Triticum aestivum
  unsure (1)..(506): unsure at all n locations
  Clone ID: PAT_TA_74044
gagagagagagagtgcnnatcgctctcttcttcctctgcttcaccgaattgctgatcctgttctctcgctagctccttctcctcaccctcagcatcctcatctgctcattcttactcacccaccgcgcctccaccatcccctccgaccgtgtacccgccccaccattcatgttactctccaccgtcctcatgcccctctccctctggagcttacccacctccctctgtcgcataccctgctctacttggggtcttaccctcctgcactcttactcctcatgccctcatgtcctagaattcactcctcttccccatcatgcacaccgctcccggtgctcattctggtggccatgggtacccctctggtgatcatcgtctcccatcttactgcccttgattccctccacaacaagggtaccctccttaccttggcttccccccgcacttccattcttaccctccccagctgcctggctatccccctccccgcttcccctgttcatccc

SEQ ID NO: 74045 - DNA, 828 bp, Triticum aestivum
  Clone ID: PAT_TA_74045
cttgatgacgccgtgctcgcgctcgctgcgcgcctactccagggggacggagatgaagctcgcggcggcctgcgataggtccttgagatagaacattggatgagtcatcatgggcagggctaccacggactgttgatgacgaaatcgccgtacaccggaagcaccaaaacctgagtcgagaaggcgaataaatgactgcctgacaatgactctgactattgctaactgatgcatagctttagaagaatgcagcgaaggcgtactcatagactgactcgagatgaaagacgaaggtcttatgtgcaattgttacgatcaatgtaattgactgacatagctcttggcctcgattaaaatattggatgtggaaccgctataaacgacagagagtcactgttttctcgatgaaaaatctggtagtcacagtaaggattcgagagtgtgagcatactgaaataaacacatatggtgcaagacgtgctatactgggtcagacaattgtaaaacgattcataggtgtgcaccctattgaacttatatatatagcgttcgacaatttaccaatgcaacatgggtttggaacatagagattggaatgataacctttttaccgaagctacaagcactgataatggcgcatggctaagtaaaggcagctcagggtatgcttaagattggctttgcaaattcaaaacaagcagcccgaattaacaattcgatgccccggggattatgaaaagtacccttaaattcggttagctttgaacgcgagaaagggcatggcggtttggtgcaagggcgcaacaaagaacacctttgttttaattt

SEQ ID NO: 74046 - DNA, 835 bp, Triticum aestivum
  unsure (1)..(835): unsure at all n locations
  Clone ID: PAT_TA_74046
gagagagagagagagagagagagagagagagagagagagagagagagagagagagagagctagcccgagcccgccaccgggagagagacagagcaactcagagagagaggcagagatagtgatattcttggagcccggcaaggcggtgatcctgctgcacggcaggtgcgccggggagaaggtcgtgatcgtgcgcgtgttcggggagggcacccgccaccgcccctactggctctgtctcgtcgccggcctggccaagtacccggagatggtgatccgcttggtctcggacaagaacacggaccacacgttccgcgtcatggtgttcctcaagctcgtcaacttcacccacctcatgcccacccgctgacccctccacgtcnacctcaaggaggtggcctccggcgcgcccgtctccctcacctacaaggacaagaatgtgggcgcagcctacgccgccaaggccaatctcgaggagaggttcatgaccggccagaacatgtgtttcttcaccaaactccagttttaggctgcaggccgaccgcgcanggcgtttctttgccgtttctaccctgaacccgttacattttttgctcctggctcttggtctccggccctgtttttggcctttccccacgaagactctgtgttttaccgtggttctttttaaattttatgggtgtttcttgtgttgattcatgccaaaaatttgtcttttgccggaaaaaacaaagaaaaaaaaccttcagggtccccgggtttccttttgctttgtttttccaatccgcccccccccttaatttttttattttggaattgggaataggaaattttt

SEQ ID NO: 74047 - DNA, 756 bp, Triticum aestivum
  Clone ID: PAT_TA_74047
caagggcactacccatattttctgaatttgttactactaggacttcttgctcataggccacgcccaggattctggcaataatcagaacatgggcgtctgaccaagacagagggcaacagaggaattatttaacttctatcgtaggcaccagcacatgggaatcaactgtgacaagggctacaggggtactacacaagttctactgactagttgtacaagggcatgaaccactgacaagggcgacaggggcactgccgcattatgtcctagaaacaggacaagcgcaacgaccaagataaggccaacatgtaggacaagttcatcaaccaggacatgggcaacaagggtactacccaatttctatgcttcagacagggtcagggcatcagtcaggacaagggcgaccatcatatcacggacacctgctaggtcaacggcagctgtcaggacaagagcgactatgattcgacatcccataccatgtatcacagagcatcaaacggccagcccatagtgggaacgtgctacaacccgcgacacagatgtcgaatatgtgtgcgatgtggggtggcgacgcattggtcgctttccagtgatagacctttctcaaacttgcatggtgcttgtatgcatgcaccttaactatccaataacaatgaactgttgctggaaaaaacccttgcttaccccaacttaaacctttagggggggccccgtcctcaaatcgcccctatggtaacccgtttagaatttaac

SEQ ID NO: 74048 - DNA, 824 bp, Triticum aestivum
  unsure (1)..(824): unsure at all n locations
  Clone ID: PAT_TA_74048
ggagctcggagaccggtgcgcctggcggccatgcccaacctgctgccgccgtcgcgcgccgcccagcggctcctcgcccccaccgtcccgcacctagcccgccttctcctcacgcacgcgccggcgatcccgccgctcatcactgccatcctgcccgcctcgccttccctcctcacgccgctcctctcccacctcctgctctcccactcgccgcccctcccggcgctctccctgttccgccgcttgctcgagctcccccacttcccagtcccggagagcaccctccccgtcctcctccgcctgctcgcgcgctcccgccgttacgcgcaccactcgttccagctgctcgagtcgctcccgnccacccacccccaccttcttttcgtgcccgccctctccgtcatcctctccaccgcgctctgcgcctccgcccccggcgcgtgctttcgcgccgccgtcagccgcttcaagtccgccgccgccgtttgggcgcgcgcggggcgttcgttcgcgccgccgagcctaaagcgctggttccggttttttgggcccggggacccgtctccgagcgcgcgccctgttccaccggtactgggacgcgtacccgcccgaaacccggacccttaaaaacgctggtggttgggttcaaggaggcccggccacgcccaagcgccttgacctcttctaccatgacgcccgggcctggttggctttggtcccggacgccgggttcctacctgggtgaaggagggacgccttactggaaaaaaggggcagttttttggacgcctcttaacctttctcgacaaattgccccaagaagg

SEQ ID NO: 74049 - DNA, 838 bp, Triticum aestivum
  unsure (1)..(838): unsure at all n locations
  Clone ID: PAT_TA_74049
gagagagagagagagagcgagcgagagagagagagcgagagcgcgagatagagacatttagagcgctcgacctcgcgttgccgctgtatcgctctatgtatctctatccctcgctctctatctgtctttctgggtcttcaacactgtcttaatgccttatcggtgcatacgggcaaacaccttcccacccagtgccacattgatccgttgttctgccacttccccatctctcgctgattttccttgtgatctagctttctttcgtgcccattagactatcacattcccctgtatgtttcctttanatctgaccatggaatcatatatactttagtttcccttatgtccttctaaacaaaaaaaatctcgagggggggcccgggcccccgattccccctatcgtgcagtcgtttttctattccctgcccgtctgtttacaccgttgtgcctgagaacccccttgtcttcctccactttctcccttttccgcactttccccctatcttcctttggcgtattagcgaaaaagcccgcccctttccctcttttctcctttttcacagtctgcttttcttattggttatttttagcctttttatttttttatctatccccgtttcttttgtttttattccttctttttttttcccattgggcccattttcctcactttcctttttatcttcttcaatttctcccctttttcgcgtttctttttttccgtttttgccccatccttctcttttttccctccttgggtctccccctcccccggctattataccctttttttctcttttttcccctttccttcaccttttcccccctttattctttt

SEQ ID NO: 74050 - DNA, 273 bp, Triticum aestivum
  Clone ID: PAT_TA_74050
acgacatgctccgctccaaggatacggtaagaaagtcgaccggcgaagagttgcagaggaagcagatggcgatgaagaacgtccgctagtccgccccgatccacgcggcggtgccggactgctatcgcttccgcgccgatcagggcccgctcggctgatctcaaggcgcctgactagcgcgcatctacctctctcgaagccgccatgagggccgctgtaccggcatatcaacctgtagggcaatacggttcttcgatatcagacatccggcgt

SEQ ID NO: 74051 - DNA, 836 bp, Triticum aestivum
  Clone ID: PAT_TA_74051
cgttgttgacaccgtggcgctagacaaccttcccgaactgcaacatgtcatcctgcgcttcgatggattaaacaaagcgcaattttcgaccactgtccatgtggcaggccctggccccgacgatatcgagccggcatcgagtatgaagctcgaatctgagatggagtaataaatgaaacaccctgaccgtgcgatctttggagcacataccttaaccgcgttcctgaggcacgatctgactgcctaagagtatcgcgaaactgcgtgtcgatattcagagcgacaaagtcgtatatgacccacaagacattaacgccgcgaggctttatcacatagaccacaatatctttatggtcctgagggttaataacggtcgacacatgacctgcctataccggatgtgctctccgagcgccgacggtgttttagcgaagatcacatcaatgattcattacgggaacaatcacactcaatattctcttagtatacaaactgcgctaaaggcctaaataggatatttcgagtgagcccttttttgtagatcacgcggtagcaagatcacgaaatgaggcgggttttgttggggcagacactaatagaattattacctatcgtcaccttttagaagatcggtgcctcctttgattattgccttcacccctcttttttattgtggcgcgtcaaacttttttggccggccctttacttggtattgtttccccaaccccttcttgatgattttaccaacatacctttttaaaggcctgccgcttttgcctcgtgattccccgtagggccttccctcattgtttgggggtgaaaaattttcccgttct

SEQ ID NO: 74052 - DNA, 868 bp, Triticum aestivum
  unsure (1)..(868): unsure at all n locations
  Clone ID: PAT_TA_74052
cttatcgagaccgtactgctcgatctgcggcccgcaacccagttcccgctatagagacacgcgttactgttgagtgatcgtcactgtaccaccgaatatttggcccgataccgcgctttaacaaacttacgccggctagtagccatttgctcagtcggctgctgcagtaccaccgattagcacccttccgatagcgcttcaccgctcataagacgactgcatggacccggaggccatgcacgaggtaatagttgaccggcaatcgagttacctgtttaggtacatcaggttgttcgttagccatttcggctaaacgcgaccgagtcccttatcattgaggagatatcacacgcggtagcatcgagcggtgatccagattggaatcgagagactactatcaaagaacgtgacctgcgacgagcgatgctgaacgaccagcgatcagcccggaagccccattaccctatagagaatcctaatacagttcattggccgcgaggtgacataaagcactactgcgagaaccctgaacggtagccaccgttattacgagcttggacggacatacgccccttcgaccgtgttggagaaaagagcgggaaagaccgcggacacggaggggctttctaggaccgttgtgacagttnagaaggccacaatgtgcaattttccaccactcaacattttggtttaaattcccggttacatttttcgttagataggttcatttttttacccaagaggccgcaaaccgcgcaaattgttttttttactcacaccattccgactcgggtttcggtctatgggtgtatacacctttgtaccaggatgcctctaatttaagaacgggggaatttccactttatct

SEQ ID NO: 74053 - DNA, 862 bp, Triticum aestivum
  Clone ID: PAT_TA_74053
cccaatcctcgatctgttctcaacctcccctccgtccgtcgcacttcccgatttccttcccccatccctcgatcatgatcgacattcttctcttcgcccctcctcgtcccccttcttctctcccccctcttcctccccctatgttccctctccccctccttttccttccccctcccctccttctcccctccctcctctcttcttcccctttaccgtccttcctccttccttcccctctccctcccccccttccctccttctcccccttaccctcctcttcttcctctctttccttcctcactttatcccccctcacctccttttcctcttctcttctatctccttccttccttcccactctcttcgtctctttccctaccctccttctcccccttcccatctctcctcccttcttaccttctctccctctctactctccccttcctccttcttcccccttctccctccacctccccatctaccctctctctttttcgtcccctccttctcctccacttctcctacctccctttccctccctctttcttctcctctccccttttcctctcaacccatcctctcttctttttccactctcccaatcttttctcccctccttcctcccctctttcctttctcttccctactcctcacctctctactcctcctcctctctttctactactctttttccatccactcactcttctcataatcactctctccctcctctctcctcccccttctactccccccatctcacttcactttttcccctttttcccactcttctccttctctctccgtcctccccttcactcctctcctgtctccctctccttctctcactctcccctcaccc

SEQ ID NO: 74054 - DNA, 852 bp, Triticum aestivum
  Clone ID: PAT_TA_74054
agagagagagagagagagagagagagagagagagagagagagagagagagagagagagagagagagagagagagagagagagagagagagagagagagagagagcgagagagagagagagagagagagagagcacacgcataaacaccatcgcgcgcgtgtaggcggccaccatgaagagcatgcgcaggctcgctcttctgaccttcacggtgaaaaacgcagttgcgcatctggacactatctgtagccagggctacgggcaatgccagcatgagccgcaggctgagatgaacacatgcgctgctctactgcagcagtggcctcagacactatatgtacatacacatatgtggcaggcacgcagctgctatttgatgcgggaacagtggtgtcatctgacacgtctccagtgtatgtacttttggaaacactattgaccttagtgtggactctaactcgcgtgattggaagggaactgatccggactgacgctggtataatcaaaagtgccgtggtgttatgtgtgagcggagataaaagatctggggagggcctgatacttcgcggagaatatttttagaatctttaggggaggccggggaaaagaattcacgctggggggccccccccttgttcacgaaggggggggggcggcccacccttatggggggggcccccgaggggttccccgcccttaactcgcctttgtttatattacccgttgggggggagggaattaaaagagaggaggccctcacgtgttaggaatttgaagcagtggccaagcctttattgttattggggagggtggtaccggggtttttttgggggacccgggggagggaatatt

SEQ ID NO: 74055 - DNA, 781 bp, Triticum aestivum
  unsure (1)..(781): unsure at all n locations
  Clone ID: PAT_TA_74055
gagagagagagagagagagagagagagagagagagagagagagagagagagagagagagagagtgagagatagctggggagagatcgagctagagtgccagtgtgggatagtgtgacatagacatgaagggtccaatatgatgaaggattacaggagctatgtgatgcatctgggatgttgcttccagtatctgagctttcccggtgtctcgcagtacggggctctctgtgctattgtatgcttcatgagagagggggggcactatgaggtagcctgattcgtcatgagtatgcagcgatctttctgaggagtgtgtccttgagtgcatcattcgacctgtggttccgtatgcttgtcgctcgtcgcctcaagcgtcaagagtgggcgtcttgtgccgatctgccatcacacgatatgacgctgcgagatgagttgacatccgtactgtatcgtcggcgaacattttttgatcgcgtcggtgtctcaacgtctagagcgagcacttctgtgtgtctccgctttggcgccactattggcgctgacagatnacgaaaggtatctacctgtatctacggggattaccgctgtgttcccaaaagggatgtctaaagatagaagagtgatattacgtctgatacgagctagcaggggcccgtacatataagctggagtcgagatgcccttcactccggatccggtggttttgaactgggggccaagcttacgaacctggttgttctattgggaggcccctggccctttttggggggttggcgcagc

SEQ ID NO: 74056 - DNA, 799 bp, Triticum aestivum; identical to SEQ ID NO: 65999
  unsure (1)..(799): unsure at all n locations
  Clone ID: PAT_TA_74056

SEQ ID NO: 74057 - DNA, 834 bp, Triticum aestivum
  unsure (1)..(834): unsure at all n locations
  Clone ID: PAT_TA_74057
caaaagtaaaacagctagtttgggcgggtcacacacgacgttgggagacactttattggtcaccgctgcatggacatatccatcgactaaacaccggggatccatctatttatgactagagacctttccttatcagagggcaccaactccggcgccagcgccaaatggcacactagtgcgggctttatacaacggcacattggcacggcccatagctgataggatacggagcgcaagggaagtcatccccttacgctgagctctctgtggcggttgataaacggaaccctgtgccagttgctgatgcggaacgctgcgcccgatttagcatgtgctacggctgctgtggttgaaaccacacatggcccaccactagcggtgctgatgctcacatccaatgaaaccctgaacctgctgttggtcttgaccgatgaggggctgcacattcactcgcattagctaatagcgtcatagtgtgtgaaattgcactaaatgctgcccccattgnaggagcatggatgcgaactgagggaatgcaccattccgggacatacaagactttctgcaaatctgcaatcagtggttggacaatagaagtaaaccggaggctggctttaagtgaatgaaagtttccttgggagctggaaaacggaattccattactttttttggccggggaccgaatggttgcaaaaggttgggccagattggccttccttgggggctaagtcagcccccaccccgaagaaaaatttgtgttcactgaccccggacccggggccattaaaatggctgggcaaaattattgctgggaggtccttcaaagggccaccc

SEQ ID NO: 74058 - DNA, 876 bp, Triticum aestivum
  Clone ID: PAT_TA_74058
tgcatgcacaatgttgccacacctaacaaatttcaataaatttgaatttaaacatttcaaaaatttaactaagaagcatatgatggtgctgatataataacggtaaaggttaaacctatgggcaaattacaaaaagcccacagatcttctcccactacatcgagatcatgccttggcgagagggtgccgttcccaatgacgaggataaaatacagatgctatgatgccctactacaaaggattgaactgcacaattcttccgccctcccttgctcttccatataaaatcaacctcttttttgtccctctcaaacagcggcgcacacagatgttgatctctatgtcgaggtccataaaatgggtcagaacacacacattacacaccatattcatccagagagagagagagaccaactgaatccattgaacattcacttagttatatgtatcaaccgcccattacaaattaactgcagaaaattttccattttcccgcaattaaaggttatgcctacccgataccttccatcccatttgaaggaccttcgtgtatccatattttttctattggcggcctaaacgcacccatccctcactcttcatttttacacccacgcttcccctatctctaaattaccggctcttgcggacggaataatccctccccctccaatttttacacaagcgcgaccactttgttacggttaaaccacacactttggctttcacaacattatcacactatcgccccaaatactcccttttgttggccatctatcggaaacctcctaaatcccaataatactcatatctcttctccaccgtcgcaccaccctctttcttctcttcccttatatcccataaacccttcccgtc

SEQ ID NO: 74059 - DNA, 763 bp, Triticum aestivum
  Clone ID: PAT_TA_74059
agtctctatatggagttagcaatgcccatgttgggaagtactgaaatctactaatgccaatatgaatgtgggacaaggaatgacgcttgggtaatccgaaatgttaatttccgcatgaaaaagttgaggctgggaatttgctagtcgcattcagagagagaaatgatgtatgcctaatggtgattctgcactctagcggacgacgccaggcatttagaaaggcggacagacaatcggtaagctagcataccagtattagatttccctcactcatacaccctaaatccgtccatgcacgacgccctaatctagttttggaataagaattcttggaacttacttctttgatttgcaaactgtggcgttggggatgactttatatcggaaagagctaagatgctgaaagaccttaattctcagatattcgtattggcttaacccgctactctgatattcagagatttgacgagcgcgacatagggttgaatcacatagcttgtattattgccatattcgcattcttcacaatataggaatgttcttacattttgacgttaattctttattccccggttgtgctccgattctttctacttcccgaaattctgcactccagaggaatccaagaaaaaaaaggcggcattggcgaattcgtctacaatttttagaaattgcccctgattaaccatagatctactcatacaaaggggcgaatactcatcggtgcacaattctaaattattgaaagcctaatactgagaac

SEQ ID NO: 74060 - DNA, 642 bp, Triticum aestivum
  Clone ID: PAT_TA_74060
gggggatcaaccaagagcatcagagctgaacagatgttgacgaactttttcaacgttaacgagctctggaagagcattaatccttatgaagctggtgtctaccgagctgccgcgcacgctgcgatcttcagcgatgacggaaacaacaaggtacagaatcttctactgctctatgtgaccccactgactgttgcgctagaaactgctacaagagtcattactgtcttcattagcacatacaccgacatacccacccagaaggcacgagtgatttacacctactcctacaaccatgctggggatgtaattcagcatatgtaagctgagaggactcagaccatggtctactaatctgatagaatagtttgagctctctgagatctcagactgcacccaggggtgttccccacatcacgtggtgctccgacattgatgccaacgttatcctgaatgtctatgctgaagacaagaccactggacagaagaacaagatgaccatcacctacgacaacggcactgctgagcatggacgacatatgacaatatggtcccactacgcataataagtacaagatctgaggaccgaggagccctatgacgacagtttgaccaccaagaactggcctgatagaaactacggcc

SEQ ID NO: 74061 - DNA, 716 bp, Triticum aestivum
  Clone ID: PAT_TA_74061
cccccgtcgaccacaacaacaatttccccagccccagcaaccacaacaaccatttcctcagccccaacaaccccaactaccatttccccaacaaccacaacaaccattcccccagcctcaacaaccccaacaaccatttccccagtcacagcaaccacaacaaccttttccccagccccaacaacaatttccgcaggcccaacaaccacaacaatcattcccccaacaacaacaatggatgattcaggcatttctacaacaacagatgaacccctgcaagaatttcctcttgcagcaaatgcaacctgtgtcattgggggcatctctcgtgggaataattctggcaccaaaaggattggcaccctggtggcaccaacaaatggttggcgaacaactagggacaaatttccttaaacaactcccagaggcgggaggcatttcacaaaggggggggcatttccattcattatggcagccaagaaacaaacaaaccgagggcgtggcagaatccctgccggggcacttattttcagactcgggccaagggtcttggggttttaattccaaaccttatacaaaccaagctctaatttgggaggggggatcaggggcattgtggaattggaaaaactctttccaaaccatgttgcaacgggggatgtgtccaccttgaatggcttcaaccatcaaacggggccattatgcccagcataaat

SEQ ID NO: 74062 - DNA, 653 bp, Triticum aestivum
  unsure (1)..(653): unsure at all n locations
  Clone ID: PAT_TA_74062
cccacctttcccctccagcaaactcacacaacccaccaccgaagctcccaaccccacccgaagcggcagccatggcccccaaggcagacaagaagccggcggccgagaacaaggtggagaaggcggcggagaagacccccgcggggaagaagcccaaggccgagaagcggctgccggcgggcaagacggcgtccaaggaggccggcggcgaggggaagacccggggcaggaagaagggcagcaaggcgaagaagggcgtggagacgtacaagatctacatcttcaaggtgctgaagcaggtgcaccccgacatcggcatctnctccaaggccatgtccatcatgaactccttcatcaacgacatcttcgagaagctcgccggngagtcggccaagctcgcccgctacaacaagaagcccaccatcacctccagggagatccagacctncgtccgcctcgtnctncccggggagctcgccaagcacgccgtctncgagggcaccaaggccgtcaccaaggtcacaatcctctataatggacgcgtgcaagtgggttctgcatctgcatctggactcttgacattgcttatctatctatctgcaagtaaagggggggggaagaaaaccgtgctgggtgaatggccacccttgttt

SEQ ID NO: 74063 - DNA, 666 bp, Triticum aestivum
  Clone ID: PAT_TA_74063
cagaggaattgctaccacccgcaccgtatagccggcgccaccacagctagataagaaaaaaagagagagcagaactcgttgggagtgctcgagatctgggtcgggagagggggaattcttgagatcggaatcggaacaagcgggcgcgctcgggatcggggttaccatacaatttttcccaggaaccttgagtgaatgtgctaatggagtccaagggtggcaaaaagtctagcacgagtaggtccctgatgtacgaagctcccctgcgctacagcattgaagacgttcgacctgctggaaggccccagaagttctctggtggatacttgaactgggcgaaaaaaccctcccgatattcggttttgggatccccctccccggtggttaagagattttaatgcgcaatatatttctgagccgttttttttgtccacacacaatttttattgtggcccgttgttacggcgaatatttccggacccagtttcttcataagcctttacctccccttctggagtccctcctcttgcttcgtgccttttctgggacctcaaaactgtgcaaacaaatgggctgggcccccgcgaccctcttggcaatttcggggttcttgaggggtctacccgaagaaaggcgcccttgcggagaaacaacccttttttcccg

SEQ ID NO: 74064 - DNA, 591 bp, Triticum aestivum
  Clone ID: PAT_TA_74064
aaacatttacccatcctcagcaaacattcccccattaaccacaacaacaggttccccagtctaagtaaccacaacaaccatttctgcatcctcaacaaccattatccctacaaccacaacgaccattcccgctgacttaactgccacaacaaccattgatccatcaaccacatcaaccattctcccagactcaacaacctcaacaaccattttgccatctaccacatcaaccattcgaccagactcaacaaccccaacagccatttgaccagctacagcagccacaacaacctttatggcagccgcaacaacaattgccgatgccccgacagccgcaacaatgattatcacaacatcatcggacattcattgaaccatctctacaacaacagctgaacccatgcaagaatatgctcttgcaacaatgccaacctgcgtcattggtgtcatacctctggtcaataatctgggcacaaagcgattgccaagtgatgcggtaacaatgctgccaacaactagcacagattcctcaacagctccagtgcgcactcatccatagcgtcgcgcattccatcatcatgcagcagcagc

SEQ ID NO: 74065 - DNA, 606 bp, Triticum aestivum
  unsure (1)..(606): unsure at all n locations
  Clone ID: PAT_TA_74065
ctcgacttacacactcgactggtagccactagtaattcacttgcttgggttctcgcgccaccgaactatttctcgccaagatgtggacggtgacacctgcttacctggatcagaggctcggcgccgtcaagcgctgctgcagagaggccgccatggccggagccaaggtcgctgtcgtcgccaccgtcttctgcgcaatccccaccctggcgtgcgtgatgatgctgccgtgggcgatggcgcacctcagaccaaccgtgcaggcgctcatcatgttcatcgtcgacgggatggcctacttcatctggcccgacaagaccatcctgtacatggcccggaaggactacttcgacgacgctgcacagcatcntaagaacacgtgcttgcactaatgagactgcaatgacagatccattagcagcgcgcgaaagctgcgtgcgccagcccgcaatgtctgatgaagatggtgagaacgtcagcactactcgagctngcaacagcatgatgggagactgtctctctcatgcacgactgtctgatcagtatcacatgttgcagcagtatctgactatatacatgcttgaacataaaacaaacactgagcgg

SEQ ID NO: 74066 - DNA, 693 bp, Triticum aestivum
  Clone ID: PAT_TA_74066
gcttctcctccccttccggttcgggttctggttcggttcgggttcggttcgagagagaggccgagtagctagcctagtctagggtttcggtagagaggaagggagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgttccggcggtgggggcggcggcggtggctacagctgccactgcggcggtggcggaagctaccggcggctggcaggtggcggtttaccggcgtgtcatgggctggaggtcgggttcaccgggtcatggtgcgagcaggatgtgcatgtcgttcctgtgccatgggcctggtacgggatgaggccttcttggagctgcgcccctgctctgcttgtgtatgtgtcgtgtgttgtatctccttcctgtagctgcgcgtatctatcgaggtggcgtggatcttcgcaataggtcggatatctccagtgtatgtcgtcgctttgcggccctcc

SEQ ID NO: 74067 - DNA, 829 bp, Triticum aestivum
  Clone ID: PAT_TA_74067
agaaatctcttccctcgcccaaaccctcgccgccgccatggccgccgccacctcccccgccggcgcattctccggagccgccgccgccgccgccgccatgcccaagcccgcccgacagcctctcccgcgccaccagaccgcctagtgccgtgcgctccccgtccgcgtagttaggtgctgcgccgcgcccctctgatgatggcaccttcatcgtgctccccgacaccgaaattcggtcctgggggccgtccgagcccccgaagggcgcctaacagtactttgtggaggacgctcgagcctcccaggcgatcgtccgacgtaattggccccatcccctggtcgggagccgtttcatgggcacgatatcacactaagggggcgtgatcagcggttaggatccctgaggattaaaggcaactcaccctcgtttcccgtccaaccaagcacaggagggaagggcgcattagcgagagtaaaaccaggaataaccgtatccgaagccaatccccgggcctgagctctggcaagacctagcctctaagagctgctcttacatgcccctcggggtgccacaccaatacctcacttatttcacgatacttgcgggtggagtgccctctttactccctgggttgccatctaccgtaagggagcgcgcaatattacctgggtcccagtgagccccccgcgtcctcatagataccgggtcccggatacgccgggttccgcggtagaacaccctcatttgtgagagcgtgtgaacggtcctgtcatcttcttagtggactaactatccttggtgtcctatgatcgtagctagcgaatttcg

SEQ ID NO: 74068 - DNA, 787 bp, Triticum aestivum
  Clone ID: PAT_TA_74068
gctacgttatcactgcgccgaatccgatacctgatctgggattcaccggggcgacacgaccataccgttaggcgatgcccgggacctgctccccgacgcttcaaccatggcaggaatggcaccggaacggttccgaggttgacgctaagaactatgatgctaagatgcacgagctgctgatccaaggcgagactgacgagcacttcaccttctatgatgaagttcatgagagctgggatgacatgtgtctgcaagagaaccttgtgagaggaatggatgctcatgggttggagaagccctatgccatgcatgaaaggggtatcgttgctgtctgcgatgaggctagacgttatgcatgccagcacaaatccggagacacgaagagactcgctactctcaaggatctgggatgaccctgaagcgaaattggacatatcggttaaggtgcagaagtggcccaaaagccgttgggctcgcctttggctttctcaccaacgggtgactcctgtgagaaccagccagagaattgggaagaaatgggtttaatcggacgggtgcaacctatgggggggaacctatcctttggaaggcgggcggataggggctctcaatgggccatgcgtgggttggggaaacgcaaacccttgaaattggcggttgaaaggaacccgaaaagggatatcgttggccatggtgggaggtggccattcgtttgcttgggtggggatcttccctgggaacccggagggttcggacattacttccgttagggccaaacctcttgccg

SEQ ID NO: 74069 - DNA, 750 bp, Triticum aestivum
  unsure (1)..(750): unsure at all n locations
  Clone ID: PAT_TA_74069
accgggcttgcaccgacgtcttgcctaggcggagtacaaccaccgtcaccaccatgaccaagatgggctcgcggtacgaggtggatgtgaccgtggtctccgaccgcgacctgaagaacgtgaactggcgcaacggcggactctatccctacgccgtgctctggatcgacaccagcgcgcgctgctacacccgcgtggacctctacatcggcgacaaccccagctgggacgtgaaggtcgtcgtcccgctgcccctctgcagccggctggaggacgccgtgctctacatcgacgtcgttcacgccaacgccgtcgagggtgtgaagcccgctcctaggatacgcacgggtgactgtgccgagacgtaagttgacgacgaccggcgtcnaggggcgaaggtggttgagagaattttgaaggcttgaagcaggttcatgccgggcgtgtacccatgggcgaaggcattgtacagtcccgtcggtctgcacgtgcaaaaggacgcacgggcgcaacgtgacctaacggaacaagacataccgtcaccattgggatggcataacggncgggcgtcccctcgaacgggattaccgggcttaccttaccccgagttatgtcgtttccgagtgagataacgatatgggttgccggggagaatggcgctcgttacgnggngactgaatgcatggggggctggaatgacttcaaggggctttaccacggttccaaggatgtctttcggtgaacgtaacc

SEQ ID NO: 74070 - DNA, 659 bp, Triticum aestivum
  Clone ID: PAT_TA_74070
cacaactagagcacaagcatcaaatccaagtaagtagtatttaacgaaaatccaccatgaagaccttactcatcctaacaatccttgcgatggcaacaacaatcgccactgccaatatgcaggtcgaccctagcagccgagtacaatggccacaagaacaaccacccccccagtcccaacaaccattctcccagcaaccacaacaaatatttccccaaccccaacaaacattcccccatcaaccacaacaagcatttctccaacctcaacaaacattcccccgtcgaccacaacaacaatttccccagccccagcaaccacaacaaccattttctcagccccaacaaccccaactaccattttcccaacaaacacaacaaccattcccccaggctcaacaaccccaacaaccattttcccagtcacagcaaccacaacaaccttttccccagccccaacaacaatttccgcagccccaacaaccacaacaatcattcccccaacaacaacaatggatgattcagtcatttctacaacaacagatgaacccctgcaagaatttcctcttgcagcaatgcaaccctgtgtcattggtgtcatctctcgtgtcataatcttgcccacgaatgattgccagctgatgcaacaacaatgttgcc

SEQ ID NO: 74071 - DNA, 965 bp, Triticum aestivum
  unsure (1)..(965): unsure at all n locations
  Clone ID: PAT_TA_74071
aaaataataggggaagaatgggtgatatgcatgagtgggtcgagggtagacgagaattattgggaatatttaagtggaagatgatagttgagtgacaggttaataggaggaatattatgttggaaaaatgggtgagagaatatgggggggataatcgtgagtaagagggataatgggggaggaggggggaggatacgttgaataattaggtggaatanagtggaatagtggagatatgcgggaaatagggggaaatggcggataatggggagttagggaggaatagagagatatgagtgatgtgggggatgtgtggaagtgggtaatagagaaatgggagatgggagatagggaatggagaaggaaatggggatgggaatggaaatgggatgggatggaagggatagggaatggaatgagatgggaaggaatgataggatggaatggatggatgggatgaaaggatgggatgatggaatgatggatggatggatggatggatggatgaaggatgaatggaaggatggatggatggaaggatggaaggatggatgaatgaaggatgaaggatgataggttgaagaaagaaggatggaagaaggatgaacgaagaaatgaaggatgaataacgaaaggagatagaatgaatgaatgaagaatggaagaatgaagaaatgaaaatagaatggatggaaggatggatatttgagggaatggatggaaggaaaagagggaaggtaggtagaaaaggtgggagaaggaagaggtggggaaaggtagtgtgtgtggagaggaggatgaaaggaatagagaggagataggagggtgagggagatgagaagtgaatagtgaaagggagaggggatagggaaaggagatgtgggaatgagataggggatggggaaggggatatgggatagaggtatggagataggtgatcggagaatgggagaaggattatggag

SEQ ID NO: 74072 - DNA, 771 bp, Triticum aestivum
  unsure (1)..(771): unsure at all n locations
  Clone ID: PAT_TA_74072
gaaggagtccaccctccacctggttctcaggctccgtggtggtatgcagatatttgtcaagaccctcactggcaagaccatcaccctggaggttgagtcctcagacaccattgacaatgtgaaggccaagatccaggacaaggagggtatcccaccggatcagcagcgtctcatctttgccggcaagcagcttgaggatggccgcacccttgcagactacaacatccagaaggagtccactctccacttggtgctcangctccgtggtggtatgcagatcttcgtcaagaccctcacaggcaagaccatcaccctggaggttgagttctttgacaccatctaccaaccgttatggcgagattcacgaacagggaggggatttctccccggaccctcaaagggtttattatttttcccggcaaggcaaacttgaatgatgggcccgcacccctttgcggattaacaaacaattcaagaagggaaattccacccccttccaccctttgtccctcccgccctttcggtgggtggggcattgcaanaatctttttggtcaaagaaaccctttcaacccgggcaataaaaccaattcaacccccttgggaaggnntttgaagttcccttcaagaacaaccccatttgaacaaattgttggaaaaggccccaaaggattcccagggaacaaaggggaaggggcatatttccccccccggggaacccaaccaaagcgggccctggatatcctttttgcccgggccaaaggccaaaatt

SEQ ID NO: 74073 - DNA, 708 bp, Triticum aestivum
  Clone ID: PAT_TA_74073
caacaaccattctaccagcaaccacaacacacatttccccaaccccaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaacctgtgtcattggtgtcatacctcgtgtaatgatcttgccacgaaatgattgccaggtgatgcagcaacaatgttgccaacaactagcacagattcctcgccagctccagtgtgcagccatccatagcgtcgtgcattccatcgtcatgcagcaaggaacaacaacaagggcttacaggatcccttccggcccaacttgttttcaggcttcggttcaaaggtgcagggggcattcattccataccctttatacaaacccagggctcaaaattatggaagggtggtattcacagggccaattggggtaatttggaggaaaacaccctttttccaaaaaag

SEQ ID NO: 74074 - DNA, 871 bp, Triticum aestivum
  unsure (1)..(871): unsure at all n locations
  Clone ID: PAT_TA_74074
gcgatctccagctccnccgagaactagaaagatgactggcgcaatgtacnaccgaaccggatgaangtggtgacgctgtccatgactgccgaggtgcaggtccaccctgtccggatcgatctgctcctgaagaacgggcgttacgcacagggcgtcgactacggcgcccccatatacctcgactacccgtactcgaagtacactagatcgcctaacagtgctaggtatcattgccgcgcaaaacactggcccagatggaacaaaacagggaaagcaacccagcaaatacattgacgcggcgcccatccctggcctgccctctgacccgattgccgggagacgggaccccaagcgaaggcgtccggggctaatgccgtgggcatacgggcccgagctgtttggaccccaattcggaatctccaacgnagcaagggccctagcattctcccacaaagcaatatctaaacctaaccccgtggcccttgagttcccgcccaacaaaaaaactttccccggcctgttcggaaccgatcccgaaaaaaacgaaaggggctcaacgtttccgcccccaaaggaaagcatgagaacgcatccctaccctagttgcccgcacattttaagcatagcgtgggcacagactgagaggacgtagtaaattcaccgcatagacgatgagccctcatgccagctgtgtgcactgcatgtccatcttctgcatggatcacacacagagcgcngcttgttgagcatttcacaccagtaatggtctgcgcatttcttgtagggatggttaatcatgcgatcatgtcaaatactgttgcccaattgaactaactgtgccggttatactataagcggtgctcactgatat

SEQ ID NO: 74075 - DNA, 827 bp, Triticum aestivum
  unsure (1)..(827): unsure at all n locations
  Clone ID: PAT_TA_74075
aatctatcatcgggcttccccattatctcatatcacgagacaaacaccatcgtgttgtgcctatagtgcccacatgggtccgcataatactgcctctggggatgataggccttgctaccgatgactgaacctgactcatggctccccacgctgttacagacatagacgcacttcttatcctgaagagcgtgcttacatcatcgcaacggcgcattgaagacctcatacccacgtgtggtgatcactggcgcttggttctacatgagcttgacatcgacgccaatgcatggaacgcctaagggtagctcacgtgaacttgtgactgaacactcgtacgccacgagctgcggcacaaactggntccagcctccaacatatctgcggaccattttggatggacaaacacatctttcttcccggaagccgggaccttccattgacagacacatcgtgntttggcgccctttcttaacacatcgctaggaatgganattgcagggaatctcttatcccaccacgatactagacgttacatagccaccgacctcagtatgtcacacacctcttgatgggcaccnctgtgtgctatagcccactagtgactcgtgccatncgcctaatcctttttgcacgaaccacatcgcctgcgcgctgagtgcgagagaccgaagcctttgcatgtgccgccttggcacgttctggtaggtgacaaattcaacattggccggcaagcccatgccagcnttattcggagatcgccgccggtccgccggccttcatcgtgagtacatctcggcattccccgaagcgacggatttaagcttgtg

SEQ ID NO: 74076 - DNA, 669 bp, Triticum aestivum
  unsure (1)..(669): unsure at all n locations
  Clone ID: PAT_TA_74076
aattatagggagatattaaaaaagcactacagagcgggaaagataccgatacagaaatagagagacctccagagatagacagacagagagatataccgacacacagaaacatacagactccgccgagaagtaccaggacccggtgtacaatactattttcttctttctttgcctcagataaaacgngacaacaaacatgctcaacaccctacacccggagcgaattaaccccaatgcccgacacaagggtgaaaatctatgcctcatcataccaataacctgcccaagttaaatccctaatcctgggctcttaatgatatccactctatagaccaagccagaagctcccctcctatgggataagtggtgggatttacaatgctgaagacagtcaacccataactatcgccacgcctcctctatgaccggacccctacttcaacctcataactgttgccactaaacgcccaccagtaaatccttaacattgaaggcagaataacctctgattgccccaagggagagatcttacacctaaagccctcaacctatacccaaatggtatcctctacttggccccgtacaacccctagctccttcgtcagtgaagggatacatagtcgcatttcatcactcccaattcggtcctccctctatacatagagacca

SEQ ID NO: 74077 - DNA, 654 bp, Triticum aestivum
  unsure (1)..(654): unsure at all n locations
  Clone ID: PAT_TA_74077
accaatccaatcccctctccgcgatctcaccgggaaattcctcgaccgattgaaagccaaggccctctcgtcctccttcaagatgcagatcttcgtgaagaccctcaccggcaagaccatcaccctcgaggtcgagtcgtctgacacgatcgataatgtcaaggccaagatccaggacaaggagggaatccctccggaccagcagcgcctcatctttgccggcaagcagctggaggatggccgcaccctggctgactacaacattcagaaggagtccaccctccacctggtgctcaggcttcgtggaggcatgcagattttcgtcaagaccctcaccggcaagaccatcaccttggaggtggagtcctcggacaccatcgacaacgtgaaggcaaagatccaggacaaggagggcatncctccggaccagcagcgcctcatcttcgctggcaagcagcttgaggatggccgcaccctggctgactacaacatccagaaggagtccaccctncacctggtgctcaggcttcgtggaggcatgcagatttttgtcaagacgctcaccggcaagaccatcaccctggaggtggagtcctcggacaccatcgacaatgtgaatgcccagatccaggataggagggcattcccccggac

SEQ ID NO: 74078 - DNA, 662 bp, Triticum aestivum
  unsure (1)..(662): unsure at all n locations
  Clone ID: PAT_TA_74078
cggcaaaccgccaccgcctcctcttcttccatctttgtccttgcttggagcgttatccttgcgtatcgataagactcacatgaacatcgggggcattgtccatgtcgactgtcgcaggtggaacaccactggtcatgtgctctacaagcttggacgtattcacaggcacctgatcgtgcggggcgcgcatgaaccccatgctatgaaccatagggccctgatgcacccctgagggctggactggctgcaggacgatcaccagagcggtataaacagtgataatggcccgtggcaagagtgtaccgcctgatcctaccggacccgactcgatgcccgtggtgaccgtgattgcttctagcacatgattactgcttgctctcacaatgaccgcgctgtgcttatgagtgacgacaccactggtggatgccattgctggcttatccaatgctggccaacaccactgttgcacaccgctacgtgcttgtcactcttgcagggagagcatatgatctgatagccccaacatgattcttgctccacaccctcaagtaactctgacggccgatatgattgaatacgtgacggcagggcctgaattcctgaanagcgcaggttgcaagcatgacaaggcttgcttttgcctcatgtcaggtgtgccgttt

SEQ ID NO: 74079 - DNA, 746 bp, Triticum aestivum
  unsure (1)..(746): unsure at all n locations
  Clone ID: PAT_TA_74079
tagcgccggcgcctccacttctctgctccctcctctcctcgcgcgcagggcccggcgaaagggaagcaagatgtacaccgccaggaagaagatccagaaggacaagggcgtcgagccctccgagttcgaagacaccgtcgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgtggtctttgttgcaacaagaaagattgtgaggccacccaagaagggttctgctgttcagcgccctcgcaccaggacccctgacagctggttcatggatggggtatcttggnagggaattgtcggtgtaccccaagcttgaaggattgggtggggggaaaagcgttgtcaagaataacccgttttggggatgggtggcccaaagggntcatccanagaaaatctacntntggggacnccaaaaagggtagcccgcataacaaaccacttgggaataacaaagccttggnagtaccctttcttcttgcaaggtctaaccccgcaaggncttttggtggggaaaagaaacgttggtcttttggagtaacccctgttgacctgaaaacccgccttgtaagaat

SEQ ID NO: 74080 - DNA, 549 bp, Triticum aestivum
  unsure (1)..(549): unsure at all n locations
  Clone ID: PAT_TA_74080
cctaaccccaggggattctccaatcccccgcaaaaaaaggcgccagtgcatccgctcccgttcctgcagcatccgtccaccaagcggagattatactctctcgttacttgtagtcacacacattactggcgttgggctgtgcctcgtgacctggcttgtggcgcgttccttcaaacatgaagctgtgattcaccatgcgctggggcttacatctctgtctcacccgggctggagcgagcctaccgcgtaggcgactacgccggcttcccatcttgtcgccttctttcccgccctgcgcttcctcctcgaccggttccgtcttcgagatattagcaagaaagggcttatatttggaaaagggatatngacaaggcttggctgaaaccagaccgaaagggggaaaagaaaatcaaataaaatttaaaggagtcccgcctgggaaatttgttttattttctttctgcaaaaggtccctttcattatctgaaacatacaatgaacccatggtttacaaacaaccagatacttctgggtaggggcctggtgaac

SEQ ID NO: 74081 - DNA, 572 bp, Triticum aestivum
  Clone ID: PAT_TA_74081
cctgtgcccacaaaaccctagccggcgcctcacagctcgccgccgacacaacgagctcttcctccaccgccgcaaccatggcgacccatatcagcaagaagaagaagtttgtgagcgatggcgtcttctacgccgagctgaacgagatgctgacccgggagcttgccgaggacggatactccggcgcggaggtacgcgtgacgccgatgcgcacggagatcatcatgagggccacgcggacgcataacgtgctcggtgagaagggccgcacgatcagggagctcacctacgtcgtgcagaagcgctacaacttcccggagaacagcgtcgaactttacgccgagaacgtcgtcaaccgtggcctgtgcgccatcgaccacgccgagtcacttcgctacaagctcctcggtggccttgccgttcgcagggcatgctatgctgatcttcgctctgttatggggagtggtgctaagggttgtgaggacattgtgagcggcacgctcacggcccagagagcgcagatgatgaagctcaaggactggtacatgatctcatgtcgtcagccacgtaac

SEQ ID NO: 74082 - DNA, 406 bp, Triticum aestivum
  unsure (1)..(406): unsure at all n locations
  Clone ID: PAT_TA_74082
cccccaacaaatttcccccgctggctttcttcttcgggggagccaaccgacaaccctaaccgcccgaagaacgccaagaatcccaaagcccgcgaacattgcgcgttcgtccgcggagagctcgggctttgtcacaaccagcgcgccgagagagctgtccgcagcgttcctccgcgttcacagtcgacacgggggcaccttaccgacttcctccgcgttcgactgctcctcaaaaagaacgtgcggtatgactaagtgcactaaagaacctgttaccctgtctccgcggaatgcttgttcagacgggtggtggtcgttttgaggctaacgccagcgtccagacgggagcagtgaaagaaccaatgcgcactgtttgtatatacccgcgntgtgctcctatcttgac

SEQ ID NO: 74083 - DNA, 640 bp, Triticum aestivum
  unsure (1)..(640): unsure at all n locations
  Clone ID: PAT_TA_74083
cttcccttcccttccctttcctttccccgccttgtcctcttcttccacctcgggcgaatgcctttgcccaaaccagacaccggccgaaatggagggaggggctgnngccacggaccctggcgaccactgccgcggggcccgccgccgcggccgccgggcagccggctctgaaccttcggactcttaactggcgagaggacacggncgccggccgccgggtcaccctcacctcgccatgcaggccgaccgccgggcctcctcctcgccgccctcctccagcgccgccgtcgctgccgccgccgcgcggacgctgctcgacatcattcgcgaagaccagcccgcttcccccgccttggacgccgtggtcttcgaaacgggcgggggcgacccgttcgtcccccccgcggtgtccctgccgggcccgggccccgcgttgactagacccgtggccgcgccggtgacaccttcggaagcgttgccgcctcaaccgccgaccgatcaggccgcggaagaagaggaggaaccgggggaaccggtggtcccttaaggggctggtggaacaaaccggaaagcaatggaccgcccgggcgacggcacagcaggaacatggagcaggaccccgcggtcgccccgtcggaac

SEQ ID NO: 74084 - DNA, 893 bp, Triticum aestivum
  unsure (1)..(893): unsure at all n locations
  Clone ID: PAT_TA_74084
gagagagagagagagagagagagagagagagagagagagagagagagagagagagagagagagagagagagagtgcgtgctggccttcatagcttttatttcgctttttgttacttgtgcanggggaattgtagtgttgctatcgcggatgggacctagctttctggtacgacgagataggttacgcttgtggctctagtcatcggagttctgttctcggagcgtcggacagtggtggctttgaggtttctagctgttttaattcctgcggccgtgtgagtggggctatggttgtcagtgtgtctgtgtagactcggtaattcactgtcatgtttgccaagaagatctaatgtctcatagtctggtgtgagactgtctataccgcgggtctctagatgggcctccctgtctagtctagggtagtcgctgttagggagtatcgttggcttgcgcagtgggtttccataatgtgtgctacgttcttctactgtggatatcgacttatgtgtctactccacatgacgtgtgtttccatagagcgcatttaattgtttgttggtgtgataattatgtgcccggccccacctgaggcaatggtactggttgcattcccattggttatttctgcatgcttccccctccatatgtcgaatggttgtgatgctttagatgacctatctgtttgatgcctttcgtctaaatcgtcgtctcgtggcgcgtttctgatctatgtgtgttgctctactcgtatacaggtgcatatctcttgtgcctcaatatgactcgtagtagtgcttgtttgtgcaccatccaagttgtctctaatgtttttcggtccctcttctatgatatttgcttcttacgtgttgtcacccgttatatatcctgtttcg

SEQ ID NO: 74085 - DNA, 581 bp, Triticum aestivum
  Clone ID: PAT_TA_74085
gtgcctgtcacaccgtccgcagccgcagatgtagaagccgtggcaataacttcatgttgcaacgccagcagaacacctggctcaggtttcagttccggtaagtcgccggcgacgcatcgcacgccgttctttatgctgcggctgacagtgcggagccttctgccgggagggggcagcttgcactagctggtgagaggctaccaagccttcctctccaggctttttagcgggaggatcgccaagacgtcactcctccccagagtggaccacgccctggcgggctgagagcacgtctccgacaagacgccggcctatgcatatgccgacgacgacgacaacaaaactgggatgcaccggtcgcagtgcctcccgatgaacatgacgaaattcatctccgtcgagagcatcgacaggatgaactcgctcggtggcatgttccacgtgatccactacagaccgcgagcccccgtcgagacctgtaatgacgagccggacatagtccccacatgaaccagatgccggacatgatggagacgaccacagtgatgacatagcagacgatggatgcgtcatatctgatt

SEQ ID NO: 74086 - DNA, 575 bp, Triticum aestivum
  unsure (1)..(575): unsure at all n locations
  Clone ID: PAT_TA_74086
gcccccctcacaccccaccccaccacaccctcgaatcaccaccaccagcagcacccatggcacccaaggcggcggagaagaagccggtggccacggccgagaagacgacggcggggaagaagcccaaggcggagaagcgggcgccggcgtccaaggaggccggcggcgaggggaagacgaggggcaggaagaagggcagcaaggccaagaagagcgtggagacgtacaagatctacatcttcaaggtgctgaagcaggtgcacccagacgtgggcatctcctccaaggccatgtccatcatgaactccttcatcaacgacatcttcgagaagctcgccggggagtcggccaagctcgcccgctacaacaagaagcccaccatcacgtcccgggagatccagacctctgtgcgcctcgtcctccccggggagctcgccaagcacgccgtctccgagggcaccaaggccgtcaccaagttcacctcctcctagacaacttaagcttgatcctcgtcgcttcatgccgtctgtatgtaccgtagttgcagtatgaatgtacaatctttgtaaggatng

SEQ ID NO: 74087 - DNA, 372 bp, Triticum aestivum
  unsure (1)..(372): unsure at all n locations
  Clone ID: PAT_TA_74087
cagcgatctaccatcgctccaccccgtctncccccacacacacctncgcccccaccccgctcgcgccttcccgccgcccagatgagccccgctccctccctctgccgatcggccacgccgccgtctccgcgcgcgccgagacgccgagcacacagcgcgccccaatacagagagcaccatgagttgggttatcacacagagttattgcaggggtactttatgacttcatctagctgggtgatcatatcgccgctgatttctggcaagaaaatatatggcttgacgtgacaaagtagctgagggtttggacttataagggagattagactactgcaataatggtcaccttgggattgtaggcaccactttgaa

SEQ ID NO: 74088 - DNA, 559 bp, Triticum aestivum
  Clone ID: PAT_TA_74088
ctaaagcgcaaccggctaccccaccgagcggtaccgaatatgcaccatacgctgcgcgcgccgaccactgcggcggcgacaatgggtgtctgggacgccatgtaccgcctggcgatgcgccggaacggtacgtacgtaaccttcctcggactccgcgccttcggtggctagccgctcgcgcactacggcgtatataaggtctggcagatgaacaacggcgaaaaactatatcaagacatatatgctctaaggcaaaggccgcgtgaggaacgaacacatagcaacacacatttcccatgaattttgaagtgaaactaggcaacaaataaaaattcatgtcgcgacatacttctttcgcacactaatatttgtaaacacatttgctagtggtcatgcactccgctctgagactaagcgatgaatatgcaacacagaatagtgatggctatcactggtacctgaggaacaaaggtgatactatgcaaataatgaatcggacatgctttctaatgtatcatatgtaaaaaagaagaaagaacaaaacctggacgaagcctac

SEQ ID NO: 74089 - DNA, 519 bp, Triticum aestivum
  Clone ID: PAT_TA_74089
ggacttcctcgatataatccaattgctttcaaaaccctctttttgattgcaaggcctgttgcaatcaataaaagcggccctcctgaccacaagctgtttgggttatcctacctccggctgtggaacaaattggcgggggaacaaaactatgtcaatttcaagaccttggttgacagaacgcttgccaacactcctcatgacccatgtgtgcatccaccggcggctttgcaaacatcactgccagaacttgggactgaaatgatcctactatcagcgcagggccaactggagtgatttccctttgaagagcacacagacccgccagttcaaagggctgggtggcttcggaggggatgttgaaagccccactgctggcttggaatgggaggttcaagaccaaactgattatcatgcgtggggaagctccctgtccaccggctaatgggaacctttatgaatttacaggaccaccctttttgttggctgggggccatgacaaaacaattttcttttgggctt

SEQ ID NO: 74090 - DNA, 567 bp, Triticum aestivum
  Clone ID: PAT_TA_74090
aatcatcaaatggcagtgagtcatagttaacataaatccaccatgaagaccttactcatcctgacaatcattgcggtggcactaactaccaccaccgccaatatacaggtcgaccctagtggccaagtacaatgggcacaacaacaacaaccattcccccagccccaacaaccattatcccaacaaccacaacaaattttttcccaaccccaacaaacattcccccatcaaccacaacaagcgattccccaaccccaacaaacattcccccatcaaccacaacaacaatttccccagccccagcaaccacaacagccagttgcccagcaaccacaacaacaattttcccagccccaacaaccacaacaaccatttgcccagcaaccacaacaacaatgtccccagccccaacaaccacaacaaccattttcccagccccaacaaccccaactaccatttccgcaacaaccacaacaaccatgtccccagccttaacaaccccaacaaccattttcccaggtacagcaaccacaacaacctttaccccaacccccacaacccgaacag

SEQ ID NO: 74091 - DNA, 540 bp, Triticum aestivum
  Clone ID: PAT_TA_74091
atcaaaaccaagcaatactagttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccatgttcacagcaccaacaaccttttccacagcaccaccaaccaatttttttactgcacaatcaacaattttcgaacaacaacaaccagttctgccgcaacagcaaccagttattatactgcaacaaccaccattttcgcagcaacaacaaccagttctaccacaacaaccaccattttcacaacaacaacaacaacaacaacaacaacaaccaccatttttggagcaacaacaaccaggtgtaccacaacaaccaccatttttacaaaacaacaaccaccatttttgcaggaggaaccaccatattacaacaacccctttttcacaaaacaccacaagtttccaacaacaaaaacctggtggtaaacat

SEQ ID NO: 74092 - DNA, 423 bp, Triticum aestivum
  Clone ID: PAT_TA_74092
gagagagagagagagagagagagagagagagagagagagagagagagagagagagagagagagagagagagagagagatagtgtgagagtgtgagtgagacatcgacggttttagcctggtttcgaacgtagttactgctgtcaacttcttttactttcttgtccatatcttggcgggtttcatggtctattccttcgcctaatgcctactgtgttgcgtacgtgtcagtgccatggtgtccttggcctgcctgactgtctgtagttcctcgccagtccctaattcccagaatcctgtatgtgtcattctgctgctcatctgatactggctacctgtgttttattccgacctgttgcgctggggtcggtgctttgagacatccatgttctcatcttgtgcactcccccattcttacggttagt

SEQ ID NO: 74093 - DNA, 524 bp, Triticum aestivum
  Clone ID: PAT_TA_74093
gagagagagagagagagagagagagagagagagagagagagagagagagagagagagagagagagagagagagagagagagagagagagagagagagagagagagagagacagagagagagagagctgtcgagtctgaggtaggctgagcggtcggcgtgggcgtgctcaccctgtcgcccgcgactttgacgatgtcatcgtcaatcaccccttgctgctcgcggaaggctacgctccatggggtggacgctgcatgagctgggcacatcgtgatgaaataggcgtcgctctgttggacgtacacaacctgatggtcagctctcacctatggtcgtcgccttcgtatagcaagaggtggccgcttgctgaccaatcacaagctcaagattgtcctagcttcaggatattcccacactgaggataacacgtccctgtattgcgagcacccatggacagcttttgccctttgctcaatactttggacaagcaggatggaaacaactttcatgggtgctcaagggc

SEQ ID NO: 74094 - DNA, 511 bp, Triticum aestivum
  Clone ID: PAT_TA_74094
cctcaccggggagctgaacgcctggccgggcgccaacaaacttgacggaatcaaccgaacatatgcgtcccagatcacaagtgagctgcccgcctggcgaatagattttgccggctttttatcggacaaaacggccaccgctggggcaccctgatactttggccacgctggccaatacacctgcaccaaatccacgggctctgcgggagggtcttcattgaggctccccttgggtctctttcttgcgcccgaataattagaatcctttcctgtgcacaatggatgggcctgaatagtcgctctcaaacttttcaatccacatctcatggaaggggctgagaaatccccagatggttcctccgggcaggcacttggcttcctttcacgaggagcaacacccctaattttcctgctgctacgagccaacgcactgctctgcttgctcttcctattggagattccagcggacatagtggccaccccacttagaacaatgttgccggtctgacct

SEQ ID NO: 74095 - DNA, 511 bp, Triticum aestivum
  Clone ID: PAT_TA_74095
ctgcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgtggaggtaacgtgaagtggagggctctccgtctggacactggtaacttctcatggggtagtgaggcggtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgacgttgctgctgctgccacaaagga

SEQ ID NO: 74096 - DNA, 693 bp, Triticum aestivum
  Clone ID: PAT_TA_74096
caccttggaaaggcacaaaagctgggcaaagacgcggggcgggggctctagaagagaggatgccccggaatgatgaatccggggggaggaaaaatgagggaagaacgaggaaggaagaatgagaggcggagctgaaaagggagaacggaggaaggaggaaggggaggagggatagggggggcggggaagaggggggaaaagaacgtcgaggataccgaaaaagaggagggagcacaaacgttgcgagggaggagaaggaaatcgcggagaggtcgacggaaagaagaaaggaggaaaagaggggggggaagagaagagagagggggggcgggaaggaggaggacgccgagacaagaaaaggggacgaagagagggggacgaaggggggagaacgagcggaagaagaaggaagcagggaaaaaatggagggggggggagaaaaaaaaagaggaccgaggagaaggaaaaacgggaccggggacactgggcgaatagcaaagcgcgagagcttaagaagaatggagacgtagactagggtcaggcggggagggggaaaagaaaaggatgaggaaagagatggaggaagggggaggaggaatagggttgaggaaacgaaaaaaaaagaaagaaataggggaggggaaaaaatgggtggggagagagatggaatgccaaggatagggaaggagagac

SEQ ID NO: 74097 - DNA, 508 bp, Triticum aestivum
  Clone ID: PAT_TA_74097
gcaagaaccctagcctccggatccatgcatacgcccctcgctgacgctgcatatcgtatccagcaccccactggctgcgggacccatgtggatggccagagatggaacacacccatgagcaccattggtagtccaaggacgactccggaccctgctatacctaccctcagcggggcggtgccatacacacgggtggacacattgccatcaaagcccatacgtgccaggttgtcgaggcctgcacctacaagactgccaaacatggtcacgcaatgtgcgactttgttgccattgacatctttaataggaagaagctagacgatatcgttccttgatgccacaactgtgaccttccccatgttgtccgcctagataatcacctgattgacataactgaagatggatatgcgagcctactaactgagagtggccacactaacgatgacctgcaacttcccactgatgatgctgtgcttggccaaatcagagaatggatgtgctgatggat

SEQ ID NO: 74098 - DNA, 328 bp, Triticum aestivum
  unsure (1)..(328): unsure at all n locations
  Clone ID: PAT_TA_74098
tnttggccgacttaatatcaccaaagcaagttcggtgcccctgaaacagcatctcttctgctaggacagcatgccctgcatatgtcggtcttgagcatttttaatgatttgataacacaggcgttctgaagctcaacctttgagttatttgcgacacgatcatgtgcggacatgtcagcgtccaaattgtcttgcgcaggagatttcttttaggacaaggaattgctctaaacagaaatccatcgcagtggttacatggaggtaacctctttgttattatttaacatgtcacacagcaacattgccactttcggtcacaacaatactg

SEQ ID NO: 74099 - DNA, 505 bp, Triticum aestivum
  unsure (1)..(505): unsure at all n locations
  Clone ID: PAT_TA_74099
caccgttctccagtcgatcacgcacgctctcctcgccgccgagatgttcgggttcgggcaccaccacaaggaccaggcgccgccggcgtcgggccccaaccagatcttcaagatctactgccgcgcctccgaggactactgcctcgccgtccgcaacggagaggtggtgctcgcccccgtcaaccccaaggacgagacccagcactggctcaaggacatgcgcttcagcaccaccgtcaaggacgaggagggcatgccggccttcgcgctcgtcaacaaggccaccggcctcgccgtaaagcacttcatcgggcagtcccaccccgagaagctgccgccgaaaaccgcggcctacgacgactcgtggtgctgtcgacggagagcaaaaacttgancaaggcctcccgatgcattcggttgagcaacaacacccgcgcttggttcgcctcactgaacggagagacggaccagggttgcgtgcacgaccgcaccaccgttgtggtgg

SEQ ID NO: 74100 - DNA, 633 bp, Triticum aestivum
  unsure (1)..(633): unsure at all n locations
  Clone ID: PAT_TA_74100
ccccgctccacttcaaaacacccgagcagcctctccgatctcccatcccagcgcccccagcaccccccgcgatggcccgcacgaagcagacggcgcgcaagtccaccggcggcaaggccccgcggaagcagctggcgaccaaggcggcgcgcaagtcggccccggcgaccggcggcgtgaagaagccgcaccgcttccgcccgggcaccgtggcgctgcgcgagatccgcaagtaccagaagagcacggagctgctcatccgcaagctgcccttccagcgcctggtccgcgagatcgcgcaggacttcaagaccgacctccgcttccagagctccgccgtctccgccctgcaggaggccgccgaggcctacctcgtcggcctcttcgaggacaccaacctctgcgccatccacgccaagcgcgtcaccatcatgcccaaaggacatcncagctcgccccgccgcaatccgcgggggagccgcgccctaggcggcctcggcttcggncgcaacttggntagggtggtttttaaggcctccccctggttcccccgtcgtggtttcccatggtggtgccggtccgcnttccttatgtgaaacttggggcttggtttgcttgtggccttccgaatgg

SEQ ID NO: 74101 - DNA, 614 bp, Triticum aestivum
  Clone ID: PAT_TA_74101
cctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccggcacaaagtatcttcttagcaagcttaagggcctctaagtctttgtgttgccaaaccttccttaaaaatgccgccttgggtgtccgcctactacaaggaggggagctgggaaccaactttcctgcactttgcacatggcctgaaagaggtcaagtgctaatcgcactgtatgcctaaatctatgctgtcttcagaatt

SEQ ID NO: 74102 - DNA, 515 bp, Triticum aestivum
  Clone ID: PAT_TA_74102
agcaaaactagtttgcaccaatgcattatgaagaccttgctcgtgtttgcccttctagccgctgcggcgacatctgccattgcacagatggagactagctgcatccctggtttggagagaccatggcagcaacaaccattacaacaaagagagacatttgcacaactaccaccatcttcacaacaacaacaaccattttctcaacaaccacgcattgttgcagcagcaaccttcattttcgcagcaaccactattttgacagaaacagcaaccaggtctaccacagcaaccagcattttcgcagcagcaacaaacaggtctaccgcaacaaccagcattgtcgcagcaacaacaccaacagcttgtgcaacaacaaatgcgtattgttcatccatccattgtgcagcagctagacccgtgcaaggtattcctccagcagcagtgcatccctgtggcaatgccacaacatcttgctaggtcgcagatgtggccacagagcagttgcgatgtgatgc

SEQ ID NO: 74103 - DNA, 617 bp, Triticum aestivum
  Clone ID: PAT_TA_74103
ggaaaggcgtcttcgtactcgcctctctccgcgcaaccgagccttccgcccacctgctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggggacaagaccgtggggggaggtgatgatgctttcaacaccttcttcagcgagactggggctgggaagcacgtcccccgtgctgtcttcgtagatctcgagcccactgtgattgatgaggtgaggactggcgcttaccgccagctcgttcaccctgagcagcttatcagtggcaaggaggatgctgccaacaacttctaccgtggtcattacaccattggcaaggagattgctgatctgtgcctcgaccgtatcaggaagctttcagacaactgcactggtctacagggattccttgccttcaacgctgttggaggtggaacatgctatggccttggttctcttctgctggagcgcctctctgctgactatggaaagaagtcccaagctgggttcacagg

SEQ ID NO: 74104 - DNA, 560 bp, Triticum aestivum
  Clone ID: PAT_TA_74104
ggcgggagggccaactcttgatcccttccgaacaggtatggtggccgaggacaccgtgctggtgtctctaggcatacagagtgtcgtgctctggttactggactaccttcttctgcatcatggcgagatctaccggatcctctgagacaggctggtgatgtttgttactatgcagtgtatcgggagggtggtcggactattggcatcgccgactatacatactatgttgacctgaactacgctattacgaagctagatgatactgcatctataaatgcattctctacagcgcctatcacggcgaccgagtatgctggtacaagcagacgctcatattcatgcagccgtagtagacgccgacgtggccatacagcagagtcacgagtcacagaacctacatcacgccgctacgcgatagatgtggcgagatcagctctttcattcaggtcccgaccatggcgtctacatttatcccagcagtgacgctgctgagtgcttccacatgatggtggacatgccatacgtgcacgaatgctcatcctgctgtgtgcgacagaaca

SEQ ID NO: 74105 - DNA, 638 bp, Triticum aestivum
  Clone ID: PAT_TA_74105
gaaagcacaagcatgaaattgaccctggtagtctttaactaaattgcagcatgaagaccgtactcatcctaacaatccttgcgatggcaacaacaatcggcactggcaatatgcaagctgaccgtagcagccaactacaatggccacaagaacaaccacccgtccagtcccaacaaccattttcctcgccaccacaacaaatattttgtcaaccccaacaaaaattctcggataaaccacaataatcatttgtccaacctcaactaatattgccccgttgtccacatcaacaagatgacaagtcctagctgccacaagaaccatttgatcactcgcaacaacctgaactaccatttccgcatctaccacgacaaccattacgcgatcctcatcaaccacaacaaccatttccctagtgacaagaaccacatcaaccttttgcttaatgctgacaacaattaccggaggctcaacaaccacagctatcattcccgcaacaacaacaattgatgattcaatcatttctacaacaacagatgaaccccttgcagaatatcatcttgcagcaatgcaaccctgtgtcattggtgtcatctctcgtggcaatgatcttgccacgaagtgattgccactgatgc

SEQ ID NO: 74106 - DNA, 646 bp, Triticum aestivum
  unsure (1)..(646): unsure at all n locations
  Clone ID: PAT_TA_74106
caacaacaacaacaagaacaacaaatccttcaacaaattttgcaacaacaactgattccatgcatggatgttgtattgcagcaacacaacatagcgcgtggaagatcacaagttttgcaacaaagtacttaccagctgttgcaagaattgtgttgtcagcacctatggcagatccctgagaagttgcagtgccaggccatccacaatgttgttcatgctattattctgcatcaacaacaaaaacaacaacaacaactatcgagccaggtctccttccaacagcctcagcaacaatatccattaggccagggctccttccggccatctcagcaaaacccacatgcccaggggctctgtccagcctcaacaactgccccagttcgaggaaataaggaacctagcgctacagacgttacctgcaatgtgcaatgtctacatccctccatattgcaccatcgcgccatttggcatcttcggtactaattgagaagaaaataactctagtactagatatatgaaacaccgttttcttagtccatggtttggtcattgtagcggtgaaaaaataatgtgacatgcactatcatgtaagaacccgaactatactagttcaaacttgggaataaaagacaaacacnagtcttgn

SEQ ID NO: 74107 - DNA, 532 bp, Triticum aestivum
  Clone ID: PAT_TA_74107
ggcatgcctcattctctgtcccgttgcccatcgcctacgatgctaccaactacattatcaaccccatcgtccttgcgtacaactatacctacccggtcacatactggggtgccacacgtgctatcagcctctgagcaagtctccagatgttgagcatattcagggagcatatccccttgacctctattctggacaactttgccttctattagaacccccatatgatgccgcaactcaagacaatagaacttcctaccatcccatatcaggtgtgggacatcagggctccgaaccctgttgcttgagagaaacaacatgaagttcaccacgctaagctaagagtatgtgtaccaaacggtgttcttcgagacaaacagcaggatgcttgcagtgatgaagcaaactcgcctgtagcgatacggcgtacggttatgcacagtttcgcagataattcggtccactgttgtctcactctgcctctcgggaatgtcctcagattgtcaatagctgagatccaaatctggtgcacgtt

SEQ ID NO: 74108 - DNA, 558 bp, Triticum aestivum
  unsure (1)..(558): unsure at all n locations
  Clone ID: PAT_TA_74108
agcaacactagttaacaccaatccaccatgaagaccttcctcgtctttgccctcctcaccgttgcggcgacaagtgcaattgcgcagatggagactagatgcatccctggtttggagagaccatggcagcagcaaccattaccaccacaacagacatttccacaacaaccactattttcacaacaacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttntacctccacaacaatcaccttttccacaacaacaacaacaacaccaacagctggtgcaacaacaaatccctgggtgtcagccatcccattttgcagcaacttaaacccattgcagggtatttctncagcagcagtgcagccctgtggcaatgccacaacgtcttgctaggtcgcaaatgttgcagcagagc

SEQ ID NO: 74109 - DNA, 644 bp, Triticum aestivum
  unsure (1)..(644): unsure at all n locations
  Clone ID: PAT_TA_74109
cacttgatggcgtcggaccgatcctcaaaaccgccgcggcggccaccgtatcgttcgctattgccgccgccgccacgcgatgcacttgtggatctgcttggtgcgaccacaagcggtccttctacttcttggcctgcctggtctgcccgcgccgtcgcacatgaagaaggccaagctccccaccgtctactgctgctccgtcgatcacaccagtcgtagcctactgtgtgttcctcgcacacccgagggctccacgcagaaaaccccagcgctctctgatccagatccctctgatcccatcgccggcacccacgcctgcgctagcgcctcactctatacgatgcaaaggctagaatgggtgcaaccaagatgcgatggatgtcgcgtagaattcnagatcgaatgatggctccatatatttgacgtgataccgatggacatagaccacaaggccattgaggttccaagacggtcagagatcttatcgctgtgaagtgaagtgcagacatacacagaggtgaatacaaagagttgggagatcacactggtgcaagagggacaactgatggagatgatgtgcaaactgtggtggacgatactgatgctacccttggaagatgggataataggaggggctcataaat

SEQ ID NO: 74110 - DNA, 640 bp, Triticum aestivum
  Clone ID: PAT_TA_74110
tcgccacctgggtcaacatggtcgcctactgccccatcatggagaacgcctgcggcatcgccgagatctcccagatgccggacgaggtcctcctgcgcacgaacgcactgtacaacaacgataacagcaccgtcgacgtcaacctaggggtcgcgatctactcgaccgagctagggaagctcgctctgctcaatgcctacaagagccccgcgcagatgctgatccataacgagctacgccctaaggagtacttgccgatcactggattggccgatgctaactagttgagtgctgagattatcttgcgtgccgacaggactgctattcatgaaaatagggtaggtacagcgcagggcttatcacgaactggctccctacgagtgggaggcgaatatcttgcactgcactaccatgaacgcactatctacatacgccagcctaactgggagaatgacccaaaagtcgttactatagctgacctgactgctaggagttaccgtgactatgatcctgcaactcgcggactggatttccaaggacctttagaagacctcagatcaagtacctcagcgcaatgaactgcttcatgcatgtgcacatcaaactaactgtgtcgacccaaccttggacaatgggaaca

SEQ ID NO: 74111 - DNA, 616 bp, Triticum aestivum
  unsure (1)..(616): unsure at all n locations
  Clone ID: PAT_TA_74111
cccaaaccttctcctccttctgaacctcccggcgcatctncgactccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcaccgagctgctcattcgcaagctccccttncagcgcctcgtcccggagatcgcccaggacttcaagaccgacctccgctttncagatgctccgaccgtcttcccgcccctggcaggagggggccgccgagggccctacannttggtgggggggctctttccnaaggaacaccccaaaacccttcttgtggcccattcccaacgcncccaaagcgcccgtttcacccattncaatggccccccaaaggggaaccattcnccaaggcttnncggcaaacggnccccgccnaattctccgnnttgggccggaaaggaaggggggcccctganaaagnccttctttacccgcccggtnccggtncccggttcctttttaagccccccacggatatggtg

SEQ ID NO: 74112 - DNA, 634 bp, Triticum aestivum
  Clone ID: PAT_TA_74112
ggcacaaccagctgtggtgcatcaacaaccaccgggtcttccgctacaacacataccatatgtgctgtcatgtatattgccgccactaatgccatgcgaggtattgctccagcagcagtgcacccctgtggctatgccacacagtctcgctaggtcgcaaatgtggtggaacagcagctgtcatgtgatgcagcaccaatgttgccagcagatgccccgtatccccagacaatcacgctatgatgcaatccgcgctatcatctactcgatcgttctacaagaacaacatcatggtctgggtgtcaaccaaccttagcacacacaacccctatagacggtccgaggcgtctgcctaaccacaacaactacagaagctgataggacagtgttctttacaacgacctacaccacaacaaccgggtccatggcctacaccaccaccggcacctcatggtacattgtttgagacacaccaaatagcttagcttgagttgatgactcacattgcactccgtacgctgtgcatgatgcgcagtgtgaacctgccggcgtacgggacgacgactaatgtgccatgtcgcgatgtgtcgcaaattggtgcctacttgataagacatgatcttcgcaatgtatt

SEQ ID NO: 74113 - DNA, 587 bp, Triticum aestivum
  Clone ID: PAT_TA_74113
cactgctctatgtgatagacgattgcagccgctgcttgcataaggtacaaacgttctgacccgatggagagtgccatcgccgatcaaaacagagtcttcgagccctgaagaggacgcgctgctggtggccctagttctgcaacgttgcgcgcgaccgaagagcgtgataagcaccagggtcccctggcgcgcagacaactgatgcctgctgcaggagtacaaccagttgaaccatgtcgcgcagcatcggcctttcatatgacaggagagaacgcttatgatcgccacgcaagcacgctacgggaacataggggccgacatagaccgaatactctctgatcgtacagacaaattggtaaagaaccactggaactccaacctacggaggtgccatcgccaggccgaagtcatgtgcgctgacacaggcgcacagtagtttcgacgtactactcaggaagtgagatcagctgcgagagcgaacatacacacacgaggaacgaagtcatggatgatgaaacaagtgcgacatcagaacaattgggcattggtgcaagttacatgctggatattgaatgaccctgatgccc

SEQ ID NO: 74114 - DNA, 647 bp, Triticum aestivum
  unsure (1)..(647): unsure at all n locations
  Clone ID: PAT_TA_74114
cagcaatcctctcttcgcgcccacgaagcaagctccacactcccgatggcccgcacgaagcagacggcgaggaagtccaccggcggcaaggcgccgcgcaagcagctggcgaccaaggcggcgcgcaagtccgccccggccaccggcggcgtgaagaagccccaccgcttccgccccggcaccgtcgcgctccgggagatccgcaagtaccagaagagcaccgagctgctcattcgcaagctccccttccagcgcctggtgcgggagatcgcgcaggactttaagaccgacctccgcttncagagctccgccgtctccgcgctgcaggaggccgccgaggcctacctcgtcgggctcttcgaggacaccaacctctgcgccatccacgccaagcgcgtnaccatcatgcccaaggacatncaagctcgccgccgcatncntggcgagagggcctangctgcttnctagaatcctaaggtctgatctggggctcgaggtggaaaggatggcggtactaagtttctttatataacccctttgtctggggggaagaaaaggtttccttcaacagagtggggttaattggggggggagggaccccggaattgtggaaggggaacccatatcttggtttttcaatccaaaaa

SEQ ID NO: 74115 - DNA, 479 bp, Triticum aestivum
  unsure (1)..(479): unsure at all n locations
  Clone ID: PAT_TA_74115
cgataactctatgttacactacaatgcaataatgatcttccttgagtctacacttgtagacttagaagctgcgactgccgactctctctttttacagattcaacagcttccatcattgtctcagaaagcaacactcaccattcccgaacaacaacaatcaccatttgtcattccacaaccagcatccatagttgagcatctacaacatccaccgcagtcataacagattcttgttgtgactgggcataacctccatgctgtggtgttcaacctctacctcttgaacatgatcaagtaccatcatcttgtgatgacggagaagcaacattgtcgacaagcactaactactatttntctgcaaagcgcaagcgctcctatccatcggacttccctctacattgttgtaggaaaaaagaacaaccacaatttagctctgatctccaaccatcggtgtcacaacagccacagatctgtcaggg

SEQ ID NO: 74116 - DNA, 704 bp, Triticum aestivum
  unsure (1)..(704): unsure at all n locations
  Clone ID: PAT_TA_74116
gtttggtggttgcaactggtctttggttctccatatgtttcttttatacgggccaactaaccgtccggttgagatgggggcaaaggtggtggttgtttgggggaaagggtcccgccggggccggggaggatctggcgccttttgccgcttctcgtcggagctggacgctgcgtgctcggcggcgggacttggccgtgcagcgacggctgaatggggatagtatcgactccccaccccgtcaaagcacacccacgtggccgcgcgacttgaaggaaccggggcggcagagggttcagaggaatctgaagcggccggccaagccgcagggcagaagtaccgtcatgaccggtacgggaggacgggatctgtctataagttntggagtccaaggaccctgggcagcagccattctcttttaacatatggtactcgggtcaggtaatcaacagggatgggggatgtangggggagtcatggggccattgcacattttnggngttgaangntncggcccccggtcccttaccggtttgctacccccccaagaactttatccggcctttaaatgggggatttcccggggtggggccttttttttcccaagcnccctttgggggggaaaaattttgaaaaaaccccccaaaaaactcttcccgggggggcctctgagatttaatttttttctcagaagaaaaaactccgaa

SEQ ID NO: 74117 - DNA, 536 bp, Triticum aestivum
  unsure (1)..(536): unsure at all n locations
  Clone ID: PAT_TA_74117
cgaaaacccaccgacatctcccggncagtgcacagcggatcatggccccaagcggagaaaaagccggtggcggagaaagccgagaagaccacggcggcgaagaagaccaaagccgagaagcgaccgccggcgtccaatgagggcggcgagaagaaggggaagaagaagtccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgcccgctacaacaagaagcccaccatcaagtncaggagatccagacgtncgtncggctgtcctcccgcgagctggcaagcacgccgctcgaggcaccaagcgcacaatcactctctaatggtggcctgctgggtgagaactttgattgtatgtcgactgattgactaagtgtgggctccacgtatatgaaaaacagcgtatgttgagtagtagga

SEQ ID NO: 74118 - DNA, 487 bp, Triticum aestivum
  Clone ID: PAT_TA_74118
gagcaatacgtacgttttatagatggaagccttgccagcggcgccagctccatgggacactaaaacagatggaactcacaccccaagaactacagaccgcgatcaacggtttgccgtgtgtgcggctactcgtatgggctgatccgatagtacgctctgttgtgactgacccattgcttccgcacgaacactacggacattgcgtttatctagtaccggtaataatggacatctcagacgaagcaatgactatgaacttattcaccgaactgtggcgcttcatcgaggctgatctttatgctataagcgatgctatgcatctgctatgatgattgaactcctggagactgatccgtgaaacacaattagtgactgctgtttgatcatgagaaaccgataacttctgtactctatgagcgatctggatagagacgtgatgtgcatccttatatccatatgatcctgcgaaagccacagaagatggccc

SEQ ID NO: 74119 - DNA, 636 bp, Triticum aestivum
  Clone ID: PAT_TA_74119
aacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccatagtgtcgtgcattccatcatcatgcagcaagaacaacgacaaggcgtgcagatccggcggccactgtttcagctcgttcagggtcagggcatcatccaacctcaacaaccagctcaattggaggtgatcaggtcattggtattgagaactcttccaaccatgtgcaacgtgtatgtctcacctgactgctccaccatcaacgcac

SEQ ID NO: 74120 - DNA, 554 bp, Triticum aestivum
  Clone ID: PAT_TA_74120
ccaagtcataaacccaagtcggactcgccttcctcctccccaactactcctctcctccgcgcatcgcatcgcaccgggggtcacctgagatcacatacacaatggtgaaggctgtggctgcgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccagaagatgaaatccgccatgctggtgatcttggaaactgggacaacttgagcggatggtgttgctaacatcaatgttactgactgccatatccgccttactggaccaaattcaattgttggccgtgctgttgtcgtccacggtgacgctgatgatcttggcacgggtggacatgagcgtagcaagagcactggaaacgctggtgcgcgtgtggcttgcgcaattatcggctcaag

SEQ ID NO: 74121 - DNA, 497 bp, Triticum aestivum
  Clone ID: PAT_TA_74121
atatggagtccaacatgattaccactgctgcttcattctacacagcagctagtgccgtcacatctgacttgtcttgtccactgaacaatttatcaaacatattcacacgacacgctagctctgctgatgctattgcatgtgacaccccagatcttattataaatcctactgcaactgacgctcttgttaatacaggaaatacatctaatgatgatcgaacagtggcacttgcaattcacgattacatacatgctgtgacagatacgctcaatatggcggctgcccgaaaccatcttagccttagcttataaagatagtgaacatctagaagccactgtctctcactgtgaccacacgctcatgctgcgtctgctatgcagagtacgtgcacctctcatcttacaaggttggactgcacaaagaactatgtcggagtgacaatataactgccaaacagtatgtgcgacacaacttatgcttgtctctagatctaatcc

SEQ ID NO: 74122 - DNA, 487 bp, Triticum aestivum
  Clone ID: PAT_TA_74122
caacaaccatttgcccagcaaccacaacaaccattcccccagactcaacaaccacaacaaccatttccccagcaaccacaacaaccattgccccagactcaacaaccacaacaaccatttccccagttgcagcaaccacaccaaccttttcaccagccccaacaacaattgccgcagccccaacaaccgcaacaatcattcccccagcaacaacgaccgttcattcaagcatctgtacaacaacgtttgaacccatgcaagaatattctcttgcaacaatggcaacctgccgcaattgtgtcatcccctctggtcgataatctggccacaaagcgattgccaagtgatgcagcaacaatgctgccaagaactagcacagattcctcagcagctccagtgcgcagccattcatagcgtcgtgcattccatcatcgtgcagcagcgacaaccacaacaacaacaacaacgacaacaacgacaacaaggc

SEQ ID NO: 74123 - DNA, 556 bp, Triticum aestivum
  unsure (1)..(556): unsure at all n locations
  Clone ID: PAT_TA_74123
ccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctaccacaacaggtggacccatggcagaattatctttttgcaacattgcaaacttgcgcattggtgtcantcctctggtcataatctgggcacaagcgattgccaagtgatgcgggcaacatgctgccaacaactagcacagattcctcaacagctccagtgcgcagccatccatagcgtcgtgcattccatcatcatgcagcagcagcagcaacaacaacaacaacc

SEQ ID NO: 74124 - DNA, 414 bp, Triticum aestivum
  Clone ID: PAT_TA_74124
aaccaatccaccaagcaaacccgatggcccgcacgaagcaaacggcgaggaaatccaccggcggcaaggcgccgcggaagcagctggcaccaagcgggcgcaagtggcccggcacggcgggtgaaaaccgaccgttcgccggcccgggcgctcgagatcgcagaccaaaagcacggagctgtatcgaagctgccttcagcgctgtaggagacgcgcagattaagaccgactgagtcagtctccgcggtcgggctgcagagccgcgaggctactcggggccttcaggacacaactctgcgcatcacgccagcgcgtaccattatgccaaggacatcagctgcaagggcatcagggcgagagggctagattatctgctttttcgagtgctggcgctgatcttagtgtaagggttgt

SEQ ID NO: 74125 - DNA, 384 bp, Triticum aestivum
  Clone ID: PAT_TA_74125
gccgccgacatgctccggctccgacgcggcgtcctcacccaggtcctattgtctctatacgcctcttccgtatcccctctacaccggctaatgtacacgaccgcccggctctcccaacctacttcccgggggagtacctgctcactgcgctaccgaccagcctaggctcgcagcttccactcagtcccgcaacccgacccggctcgccttctcgcggctggcttctgacgccgatgtgcgcctgtgcaagaccgagtcttgccaggggagagacctgggccgcgtgtcgcttctggctcgctatgcgtcgactgccgcctgctgtctccgtcagatccgtgagtcatcgttcactcagactcatgcttcttggtcttgaatatc

SEQ ID NO: 74126 - DNA, 481 bp, Triticum aestivum
  Clone ID: PAT_TA_74126
cccgtcccgttccgtccccagccaaccttccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgaagaagccagttaccgtcttcggcgtcaggaaccctgaggagatcccgtggggtgaggctggtgccgattacgttgtggagtccaccggggtcttcactgacaaggacaaggccgctgctcactttgagggtggtgccaagaaggtggtcatctctgtcccagcaaagatgccctatgtttggggtggtgta

SEQ ID NO: 74127 - DNA, 488 bp, Triticum aestivum
  unsure (1)..(488): unsure at all n locations
  Clone ID: PAT_TA_74127
gcccgcgccgccgacgcctcctccatccgcaggagctccctcctcgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatatcgtgatggccgctgcttactcccatgagttgcctcgctatggtcttgaagttggcctcaccaactatgctgcagcctactgcactggtctgcttttggcccgtcgtgtgctcaagaaccgtgatcttgatgaggagtatgaacgcaatgttgaggccactggcgaggacttctctgttgagccttctgatgagaggaggcctttccgtgcgctntt

SEQ ID NO: 74128 - DNA, 694 bp, Triticum aestivum
  unsure (1)..(694): unsure at all n locations
  Clone ID: PAT_TA_74128
cggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttncattcccaagacttgtgagaactacaagcctcttttatgacaccaangggtcgctttccggcttcactctgttcaagggattgaagatagctctagtgtcaaagcgtctgtcaaaagggcaaaagtgcttgtggccacaatgtcgcgggccacaagaagggggcccttattcccccctttaacccttggaaaccaaaccccttaatttgatatggggccccgggaacccccattttccccggtttttccccccaaaagaaaccccccaacttttacattttcaaaagggggccccaaatagtggcaaccacccccttttccaaaaaaggcccttgcgagaacctccgtggggggaaacaacccccaacccc

SEQ ID NO: 74129 - DNA, 677 bp, Triticum aestivum
  unsure (1)..(677): unsure at all n locations
  Clone ID: PAT_TA_74129
ctcgcgtncgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgacgctgatggcaatggcaccattgacttcccagagttcctcaacctgatggcccgcaagatgaaggacaccgactcagaggaggagctcaaggaggccttcagggtgttcgacaaggaccaaaacggcttcatctctgctgctgagctccgccacgtcatgacgaacctcggcgagaagctcaccgacgaggaggtggacgagatgatccgtgaagccgacgtcgacggtgatggccagatcnaactatgaggagtttgtcaaggtcatgatgggcccaaatgaacacccncaccggggctccccaagaccagggaggagaaattggtgccatttggcttaataagtttttaaggatggcaaccttctttaattttgaaacgaaatttcccaggtttaaggcatttcctaccc

SEQ ID NO: 74130 - DNA, 483 bp, Triticum aestivum
  unsure (1)..(483): unsure at all n locations
  Clone ID: PAT_TA_74130
agagagagagagagagagagagagagagagagagagagagagagagagagagagagagagacactcccgtttttttttttttttttttgtagatcatagtctcaatccgcataagttcgactttcatgcgggatatcgaatacatagtacttagatagccgcggcgcccacaccgaacataaaattcatgccacttctgagcaacactcgcgcggtaaaacatgtgctcctcacctacccctcgttagcatacttcctcatggggaagcacttctcgcgcttcttctccctctccgtcttcanagagagctggtgctttgngaaccccctgctgttggcgcggctcttcttggtgctgaggtcgagcgccacactcttgttcttgtacgcctccctcatcccccacttattgttctgcgagatcaccgagagcaccctcgctatcgaggtgcgcaccaccttgatcttggagagcttcttggg

SEQ ID NO: 74131 - DNA, 500 bp, Triticum aestivum
  Clone ID: PAT_TA_74131
ggatcacacattctataagaccaaaggaccgtgaagaagatactatggcttgggctcagagatgtaggagggaacaccagagctgaacaaacgttctatgcatggcggactgatgaacaacaaaacctttcatcatactgagactattgatgagatacggaggaacatgaacttaccgggtacacatgaatggtagtgcccttagctggatggcctactacaacctagaggatatccgtgtacatgtgatgatgcgagacatgtggagcacatatacatgatgatatgtcatacaggtgaatcaatgggggatgcccacatgaacagagcttgcctctatgacactcagtagcttactactttctgttttaggattcaggacacgaggtctaacagtagtgtactgacaccaacaggacagaagagatggatgtctgagagaatatagtgtgcacagttaacatcgctgcacttaggtcttgccatacggtgccgtatga

SEQ ID NO: 74132 - DNA, 558 bp, Triticum aestivum
  Clone ID: PAT_TA_74132
cataattgcacccgtcgcaaataatggtggccctcggcgctctctaacctggctcgtccgtggaggtgcccccatcatcgcagcaccctgtagtagaggggtagcggaagaacccacgcccgtcctgtggcctcgcccagcttgcgcaggccaccattatttgcgacgcctgcgaacgtgggtttccctaatgctgcgtccacctctttggtacacttatgcgccagcctccaccaccaccgatgcccagacgtgtgcaggtgcggcggtctccggttgcgctgaccatcgactggctgggcaagatgggttaaattttgttcaaaaatgtgatgctagtagtgtgggtgatgaaattgtgctttcatcaaaggagccaacccctgatgctgatactactttctgtgcggaagcgtcatcttcaacagcagtcaagccaacaaaattgctcgcgtggtagcgtgggctcactttctgagatatctacgatgcctgttacaggaagaaactctcatatcctgcggcggactaagaaaaacatggcgatcgcctgagctg

SEQ ID NO: 74133 - DNA, 492 bp, Triticum aestivum
  Clone ID: PAT_TA_74133
gttaacaccaatccaccatgaagaccttcctcgtgtttggcctcctcaccgctgcggcgacaagtgcaattgcgcagatggagactagatgcattcctggtttggagagaccatggcagcagcaaccattaccaccacaacagacattttcacaacaaccactattttgacaacaacaacaacaacaactattttcttaacaaccatcattttggcagcaacaaccaccattttggcagcaacaaccaccattttctcatgaacaaccaattgtaccacagcaaccaccattttcgcaggaacaacaactatgttgtaccgcgacaaccaccattttgacatggacaacaaccagttttaccttcacaacaattaacttttgcacaacaacaacaacaacaccaacaggtggtgcgacaacaaattcctgttgttcagccattcattttgcagcagctgaacccatgcaaggtgtttcttcagcagcagtgc

SEQ ID NO: 74134 - DNA, 485 bp, Triticum aestivum
  Clone ID: PAT_TA_74134
gttatcaccaataggccatgaacaccctcctcttctctgtcctgattatccgtgacgggacaagcacgttcccgcacatggagacgatatgcatgactgcgttggagataggatggtagcagcgaccattaccaccacagcagacatttatacatcataccagtattttgacaacaacaacaacaacgactatttcctcaagaaccattatttggggatgatcaacctccattatgggcactacaaccaccattttctgagcaacgaccaattctaccatagcatccaccattgtagcagctacacaactagttctaccgcaacaaccatcattttcacatgcacaacaaccagctttacctccacaacaatcatcttttacacagcaacagccgctgcaacaacagttggtgcatcaacacatacgtgttgttcaaccatgcattttgctgcagattagcccatgcgaggtatttctgcagcat

SEQ ID NO: 74135 - DNA, 503 bp, Triticum aestivum
  unsure (1)..(503): unsure at all n locations
  Clone ID: PAT_TA_74135
cagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaacaacaacaacaacaacaacaaatccttcaacaaattttgcaacaacaactgattccatgcatggatgttgtattgcaggaacacaacatagcgcatggaagatcacaagttttgcaacaaagtacttaccagctgttgcaagaattgtgttgtcagcacctatggcaaatccctgagcagtcgcagtgccaggccatccacaatgttgttcatgctattattctgcatcaacaacaaaaacaacaacaacaacaaccatcgagccatgtctnctttccatttaagccaagggctcccttccgggccatcttcaggaaaaccccaacagggcccaggggcctctggttcaaggcttc

SEQ ID NO: 74136 - DNA, 483 bp, Triticum aestivum
  Clone ID: PAT_TA_74136
gtgctttaccgcagcttacatattgcatgtcatttccccccatagcttctcgatgcctgggcgcgctgacctttacgtggacggttccaggccccagcgtattgcattgccggagcagatgaatcgcctgaactagctgcgctcacgaacgatgagcaggcgcagcggtcgtaccatctacttgggcctaatttccgaggacatccgcgagatggaaatgaacgatctctagtacaagtacggagctattgtccatacgagctgaagatcctccaatgaccgctgctgatacgtacgtcgagtacgaacacccacgccatgctcatgatgtctagtatggccgtgatggataccattataatcgctaccaattgctgcactagttatttcttggtggcaattggcccttatctcgaccgaccaatgattcgatacgagctgtgtacgcttgtgatgcacattatgtgtactgatgacacgagt

SEQ ID NO: 74137 - DNA, 618 bp, Triticum aestivum
  unsure (1)..(618): unsure at all n locations
  Clone ID: PAT_TA_74137
ctagagcacaagcatcaaatccaagtaggtagtagttaacgcaaatccaccatgaagaccttactcatcctgacaatccttgcgatggcaataaccatcgccaccgccaatatgcaggtcgaccctagcggccaagtacaatggccgcaacaacaaccattcctgcagcctcaccaaccattctcccagcaaccacaacaaatatttccccaaccccaacaaacattcccccatcaaccacaacaacaatttccccagcctcagcaaccacaacaacaatttctccagccccgacaaccattcccccaacaaccacaacaaccatatncccagcaaccacaagaacccggtcccccagactcaacaaccccaacaaccatttccccagtccaagcaaccacaacaaccttttccccagccccaacaaccgcaacaatcattcccccaacaacaaccatcgttgattcaacaatctctacaacaacagttgaacccatgcaagaatttcctcttgcagcaatgcaaacctgtgtccttggtgtcatccctctggtcaatcatcttgccaccaagcgattgccaagtgatgcggcaacaatgttgtcaacaactagcaca

SEQ ID NO: 74138 - DNA, 531 bp, Triticum aestivum
  unsure (1)..(531): unsure at all n locations
  Clone ID: PAT_TA_74138
gtcatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggngaggtagtgacaataaataacaataccgggcgcattagtgtctggtaattggaatgagtacaatctaaatcccttaaccgagatccattgg

SEQ ID NO: 74139 - DNA, 533 bp, Triticum aestivum
  unsure (1)..(533): unsure at all n locations
  Clone ID: PAT_TA_74139
gcaccctcttccgtcgccgtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttccagcgcctggtccgcgagatcgcgcaggacttcaagacggacctccgcttccagtcccacgccgtgctggccctccaggaggcggccgaggcgtacctcgtcgggctgttcgaggacaccaacctgtgcgccatccacgccaagcgcgtcaccatcatgcccaaggacatncagctcgcccgccgcatccgtggcgagagggcctaagctgtcctctccgtgaacgacggtagtggatcggggatgagtgattccggttgt

SEQ ID NO: 74140 - DNA, 485 bp, Triticum aestivum
  Clone ID: PAT_TA_74140
cgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactg

SEQ ID NO: 74141 - DNA, 545 bp, Triticum aestivum
  unsure (1)..(545): unsure at all n locations
  Clone ID: PAT_TA_74141
agcgcatcatttaagccaagcaagcgggggtcaataaaaatccaccatgaagacctttctcatcctagccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaacaacaacaacaaatccttcaacaaattctgcaacaacaactgattccatgcagggatgttgtcttgcaacaacacaacatagcgcatgcaagctcacaagtattgcaacaaagtagttaccaacagttgn

SEQ ID NO: 74142 - DNA, 521 bp, Triticum aestivum
  Clone ID: PAT_TA_74142
gttgcacaagaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgac

SEQ ID NO: 74143 - DNA, 613 bp, Triticum aestivum
  unsure (1)..(613): unsure at all n locations
  Clone ID: PAT_TA_74143
gtcatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacagntgacggagaattagggttcgatttgcgagcaggaggctcagatacgggtaccacatcgtgcggaggcgtgcgcgcgcgcattataccatattctgcagcgggaggtcgaccagtatacacacctgcggcactatatagctgccatggatgagacattcaactcctcacgaggattcttggaggcaaagtagtgcattagcaacgtaattcagttcatagcgatattaagtgtggcagtaaagctcgtattgactttggccgttcggccgtccct

SEQ ID NO: 74144 - DNA, 821 bp, Triticum aestivum
  unsure (1)..(821): unsure at all n locations
  Clone ID: PAT_TA_74144
aatcggcgcaggctttatgactcggtaaatagaaactgcccgacgacttgctcctcctctgcctcacttccctcccccggcctccccccatcttggaccgttgcacaccgatctcgcccggcgcccaaatcgccggcgaggtccgcctccgtctccagccgcgccgatctgctcgcaagattcgtaggccggaggaggaggaggaggaggaggagggaggaggangaantnnnnttcttgttggtttttttcgcgggagccgaccggacatgccaacaaccccccgggagcagaaacccaggctggaccccccggtcttggaatcttgtcaaggcatggacttctggtgaacacatgacgccaagccctaaatttcgtaaggaaagatccgcggggggcttggccgcccctcactggtcatggtggcattaccttgttgtttggaaaacaaactttccctgggggttttggggggggacttatccgcggtgttttcttttcacccttttgaaaaatcggggggggtggaatcttaaattggggcctggggtggaacctggaaagagggcctttgggaaatacaatttgggggtttcaacaaatggcatacttattttggggtttttccctttaaccgggcacaaaaccatccccgggagtttaccccaagttgggggggtagaaccctttctcaaggtaagggcaccaattgggggagctctcggaataaccaatttttcaagaggggcttggttttccaaaacacccttgnggaagggttttaagatataattataccccctgggtttttaggcgatacc

SEQ ID NO: 74145 - DNA, 770 bp, Triticum aestivum
  unsure (1)..(770): unsure at all n locations
  Clone ID: PAT_TA_74145
cacaacaacaatttccccagccccagcaaccacaacaaccatttcctcagccccaacaaccccaactaccatttccccaacaaccacaacaaccattcccccagcctcaacaaccccaacaaccatttccccagtcacagcaaccacaacaaccttttccccagccccaacaacaatttccgcagccccaacaaccacaacaatcattcccccaacaacaacaatggatgattcagtcatttctacaacaacagatgaacccctgcaagaatttcctcttgcagcaatgcaaccctgtgtcattggtgtcatctctcgtgtcaataatcttgccacgaagtgattgccagctgatgcagcaacaatgttgccaacaactagcacaanatcctcaacaactncagtgcgcagccatccacaaacgtcgcgcaatcccatcattcatgcagccaggaacaaancaacgagggcggggcaagatncctgcgggnncacctatttttcaagcttcgccccaaggggttcttgggggtattccaattccaaacacctcccaacctaacccaggggtttaactctgggnagggggggagtccaaggttccaatttggccaatttggaagaaaacctcgttttacttatcccaatggttgcaattcgacggggtttttttttcaacaccttgggttggcaagcttaaaaaaaaaaggcttgggggggggtttggaacccttttggggcccccgggttccgggccccggggtcccggc

SEQ ID NO: 74146 - DNA, 594 bp, Triticum aestivum
  unsure (1)..(594): unsure at all n locations
  Clone ID: PAT_TA_74146
ccgaactccaaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtaccttcgcttcctccgcaagaagaataacaccaaggccttccacgggcccaatcaatttccggcccccggccagaatcttttgcgcaacaatccgggtattgattccgacaagaaccggaggggccaaggcgcgcttcgcaggcttcaggcgtacganggcgtgccngcgcgtacgacagaccagcgctgtcatcccgacgcctcaggtctgagctgcagctggacagtctgctcctngcagtctcaggagtcgatgactcgcnacacatcaggactgaggaaagagaggaaanngcaggctctacacagagaagcactggcagcttcggttaggccaaaagcacncagagaagtggaactcactgagatc

SEQ ID NO: 74147 - DNA, 631 bp, Triticum aestivum
  unsure (1)..(631): unsure at all n locations
  Clone ID: PAT_TA_74147
ataatgcccgaacagagatatattgccaagccgctcaggacaagcagccatgtcggtgcgcgccaagggctgaaaggggctaggcaagggcggaacgaaaatccaccgcaaggtcctgcgcgacaacataaaaggcatcaccaagcctgctatccagaggatggccctgaggggccgcgtcaatcgcattttggggcttatctacgatgagacccacggcgtgctcaagatcatcctcgagagataatggtttgttctacacagatgatggacatttattctattgttgaacaaacgaaacggccccaaccttttgttattcataacaagggacttaaccaatccgaaggacaaactcaaaccagagggtctccaccgttaatcatttcaacacacaactgacccgctcaaacaaacatacacacttttttgcgtttacaccatctaaaaagactttcacccaaatgccacgtatttaaaattacgcggccccgggggtcaacaaaataaccactgttggcttcaagattatgaacaacacccctgggtgtaaaaaaccagttggcttaaattcccctttaccacacccggaaaacccgtattttaaaaaccataaatcttggggccgccn

SEQ ID NO: 74148 - DNA, 675 bp, Triticum aestivum
  unsure (1)..(675): unsure at all n locations
  Clone ID: PAT_TA_74148
gccgtgcccagacaaccttccatattcgtgttgcgtggcggcgggaggttcacttcctctccatgggccagaataagaacggaatcaaccgtttccgaaagatccggaaggttgtctcccaggtgggccttcacaacgacaaatttgaacttgttggcgtgaacaaaccctttattaacaaccgggtccttgacctccttgttcaggtccaaaaccgttaacggccattggaggcccagggacttcaagctcaaggacgacaagactttgttctttggcgagaaaccagttaccgtcttcggcgtcaggaaccctgaggagatcccgtggggtgaggctggtgccgattactttgtggagtccaccggtgtcttcactgacaaggacaaggccgctgctcacttgaagggtggtgccaaaaaggtggtcatttttgccccaagcaaaaatgcccctatgtttgtgggtggggtcaacgaggacaagtacacccttanacgttaaacattgttcaaatgcttgctgaaccactaactgccttgctccccttgttaggatcattaatgaccacttcggtattatttgaaggttggatgaccactgttcatgccatcactggcacacaaaaaaccgtgatgggccctttgagcaaggacctggaaaggtggcaggccc

SEQ ID NO: 74149 - DNA, 665 bp, Triticum aestivum
  unsure (1)..(665): unsure at all n locations
  Clone ID: PAT_TA_74149
aactagagcacaagcatcaaatccaagtaggtagtagttaacgcaaatccaccatgaagaccttacttattctgaccattcttgcgatggcaataaccatcggcacccgccaatatgcaggtcgaccttagcggccaagtcacagggcgcgaccaccaccaattcctgcagcctaaccaaccattctcccagcaaccacaacaaatatttccccaaccccaacaaacattcccccatcaaccacaacaacaatttccccagcctcagcaaccacaacaacaatttctccagccccgacaaccattcccccaacaaccacaacaaccatatccccagcaaccacagcaaccgttcccccagactcaacaaccccaacaaccatttccccagtccaagcaaccacaacaaccttttccccagccccaacaacccgaacaatcattcccccaaacacaaaccatcgtgattcaacaatctctacaacaacaagtgaaaccatgcaagaanttnctcttgcagcaatgcanacctgtgtncttgtgtcatccntctgtcaatcatcttgcaccaagcgattgcangtgatgcgccacaaatgtgtcaacactagcacaaattctcagcactncgtgttgcancancatagcgtgtgcattcataatatg

SEQ ID NO: 74150 - DNA, 826 bp, Triticum aestivum
  Clone ID: PAT_TA_74150
gagagagagagagagagagagagagagagagagagagagagagagagagagagagagagagagtgcgagagagcgcgcgcgagcgcgagcgcccgcgccagcgcccgctcgccagagttcttgccacccctttcgacagcatgcgtaagacaccctgtgtgcgagctgagcgcaagctcacgaccccccgctcgagccctatgtgggctgcctgggcatcctttgacagccatttgtataacccctggtccttacccttccgcgggttatgtatcgcccgggacatcccttttggcgccctattcggtattggtttccctttcggctctcttcttctggccatccccgtaaggtgttgcttcttcgtgtcacggtttgttgaagcaccgggcttgcccttctattgtcccggactttccggttcccccttttaatctcccttgcccctcggacctttcctttcgaggggttaccttgacccttggtgtccttattcgcctactatttcccgttccctttagtggaaccatgccttgtccgggcagatattttcacccagtggttccgggtttcccagggttccttctaaggggcgtgcaaccttgtcttccctcttgctttggcccctttctttttttccaggcccctaaggggattaatcccccaggggggtttaatatttccccccgttgcccttgggtttttaaaccgcgtttttcgtcggggccccttttaaactcctttttccccttggacttggtccccctgttgggttttgaccagcccccttcccctaaggcggtttacccttcctcctttccccttg

SEQ ID NO: 74151 - DNA, 596 bp, Triticum aestivum
  unsure (1)..(596): unsure at all n locations
  Clone ID: PAT_TA_74151
ccgccgtcgtttgcaagggcgagggtgccgcgccggccagcctcctcaagtccggtgctcccgtggccttccgctcggtcgactcccccgccgtcaccggcgaccgccgcccgtacaacaccaaggccaaggaggtcagccgctacgacgacgacgacgacgactacagcgcccgcgacctcgtcacccccagcttcttctcgcaggacgtgatcgactcgctcggnccgccgaccagcatggcccgtctgctgtctctgatgaagggccggctctactncactgctgctggggcttggggcgtcgctgctccgacgctnggtggccaaagaggacgacgacccggggtacctaaaggggccattgccgggcttgacaagagcacgttgaggttgcggcggacaataccatctgtgatcatggcgaggcgagagccgtcttggacgcgacacgagactcgcgttgcgagtacaccgcgatcgagtgccgtgtgcgcgtcagatgacagatcatgcaatgagatgcagctctgtcacctgtcaggcangagagaccgacgacgtttcacgtagtcatatgctatgagatgccgccaa

SEQ ID NO: 74152 - DNA, 516 bp, Triticum aestivum
  unsure (1)..(516): unsure at all n locations
  Clone ID: PAT_TA_74152
cgaacacccgccgcgaaatcccaaatcaccaaccaaatcccctcccctcctctcccgcgtcccgacgagcaccagccatcagacatggacgcctcagccaccggagcgggagcgaaggcgaagaagggcgcggccgggcgcaaggccggcggccccaggaagaagtcggtgacgaggtccgtcaaggccgggctccagttccccgtcggccgcatcgggcgctacctcaagaatggccgctacgcgaagcgcgtcggcacgggcgcccccgtctacctcgccgccgtcctggagtacctcgccgccgagctgctggagctcgccgggaacgccgccaaggacaacaagaagtcccgcatcgtgcccaggcacctgctgctcgccgtccggaacgaccaggagctcgggaggctgctggctggcgtgaccatcgcgcacggcggcgtgctgcccaacatcaacccggtgctgctgcccaagaggacggcggagaaggagcccaaggagggcaagtcn

SEQ ID NO: 74153 - DNA, 854 bp, Triticum aestivum
  unsure (1)..(854): unsure at all n locations
  Clone ID: PAT_TA_74153
gccacctcccacctccatgccggtagactcgcccttcactggcagccgtcgacccaccccaggcctgccctggccttccactgccgctccgacgatgatgccaccccgctgccccacttcctcctacctatcatccccatcccgagctcaaacgccactggatcagcgtcggtccgacgccccacaacctccgcctcgcgctggcagttctggagccccgccccgttccgccgctggcgnccagcccaggcaccaacggatctggctgcatccccatcaccagtcccacaatctncaacggtgcagtggagcaccaccaccacaatggccatggacaatgcgagggggaatgccgaagctaatgccgcccatggccttggaagcttgttccctctttcccccacgccgggggaccttcgggccgacccggcaaaaagncccaagcttaaccttaacnggatttccccaacccgggattccccccaccccggcttaggggcaaacgggcccaaccccttnccttggtttggccagagtcccctttcccccttcccccccgggttgggccaaggggaccaaagggccctattctttcggggggcctttggggtagatgggccggttccggggggccaccggcccgatatggtggggtttttggggcaaccaccggtgggggcccgtggccaagggtggccatttaacggccccccgggcccccccaaaccaaaaccaccgaagccaggccaagtggccgttctggggccaagtgaaaccaccacaatccgaagtaccccctntntttcctcttgggtccccttttccccagagccggacaattcattgggaggggn

SEQ ID NO: 74154 - DNA, 591 bp, Triticum aestivum
  unsure (1)..(591): unsure at all n locations
  Clone ID: PAT_TA_74154
tggcaattcgcggtagtgtggagaggagcggagcgcgagataaataggtgggtgtctttctttggggttttgctttgtggtgatgggagcagagcaacctgcggccggggggagagaatgagacgacagtattgtggaagatgcgcgacccttgacagaattaggttgctgtgagagaccactagtgccgccctatactcccttggtttttatttttgggtagcatgggttctcttcgtaagtgtaaaagccatttgtgtaggtgagtgttactgttgcatcagttactatttcaaattacgaaaaaaccttcatgtataagaaatacaattggacccgaatattcagcgaatgtcagatttttaggcatggcaaatcaaacattttttatgtcaaattatgttagccgaggatggaaaattcgctttagttcattntttgctagaaaattgctgggctcaccaactaaatttgtcctccacgcgccaatacaagttgccatgagaaatgttcgatttgccatgccaaaaaatctgacatcagatttagcattttcatagacttgtgagtaactttntccgataagaggaa

SEQ ID NO: 74155 - DNA, 757 bp, Triticum aestivum
  unsure (1)..(757): unsure at all n locations
  Clone ID: PAT_TA_74155
gctggggtctccttcgcctttgtaccttcgcgctctctgtcgagcgcaggcgacacatcgtgggggactcctgctttaccttggattacagtctggacatggctgtaccccaacttgagggaagtgaactcacaaattcttagttattgttcttccagttagtctagtaccggtggaccattctcatacctactaaccgactggacgattctttacagattccttttacacgtgctgcagcctacccattctacgggagctcatatatatgctgctagtagctcattgactactaacaacatgatgctggtattctcttccgttgcacctataccacaggttgggtaccgtaattattgagtgatgaaatctcccatcgtacttaatctaaaatggcctcgctgtggtctgggctttgatttgaccaattgtgcacaccgtgtatggattcaaacttcattggattcgtcatactttcccgactcggttttggaactcaacctattactcctttgaatgccacgatcgctcgtgatccatcnttaacaatatggatcttataactaccatcgctaacctttgctctaataatacccctcactcttatgtaataagcatttaataaatatacacactttgggattattctactagaatgttacgaccgctatcggtgtggtctttattaaatgggtaactcaagaccttgtaaagaccagtactttcatttatatatacgcgttccatatcataattg

SEQ ID NO: 74156 - DNA, 806 bp, Triticum aestivum
  unsure (1)..(806): unsure at all n locations
  Clone ID: PAT_TA_74156
gcctcccctccgttcgttcttcttcttcgagttgggtagtttagctctacccaccagccatgggtaaggagaagactcacatcaacatcgtggtcattggccacgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctggaagtttgagaccaccaagtactactgcaccgtcatttgatgccccctggtcacccggggacttcattcaagaacattgatcacccggtaacccttccccaggctgactggggccttgttctcaatcattcgacctcccacccacttgggtggggtttttgaaggcgtgggtattcttcccaaaggaacgggnccaagaacaaccgttgaggccatggcccccttcctttgctttttcaacttcttttggaggtggaaaacccaaaaaggaaaacctggctgggttgggcaaccaaaggaaatgggcccccccacccacctttcccccagaggtacttccccaaaagacgcccgcctctttgtaaagaaaaaaaatttttcaaagggggggggggggcttttttctaacccccccccataaaaagggggggggtttttctacacacccttggccaaaagggggttccccctttggggcccccccatttttattgggggtttttgaagggggggg

SEQ ID NO: 74157 - DNA, 817 bp, Triticum aestivum
  unsure (1)..(817): unsure at all n locations
  Clone ID: PAT_TA_74157
ataagaagccgcatagctggcagaccttctttttgctttccatatgattcgcacgcggaagccttgacaaagaagcccaatcagggcgcatggtcatacctgacggaggcgacctgcctatggcgcagagctatgcccagaacaccaccaagaagcaccacgccgcctacgtggtctaagccaacaaggaggtcaggctgataaagccgcaaggttaaagtaaactcaagcttgtaaataggcctccagagcgccaaacaagggctaaatggatgggggctttctaattgaacggccaacccattactttaagacgaaccagctcgctttaattgttcgcgaactcgaaaatgggcacccccgctgcggggcaaggtcaacctctccatggggccatgaacaacgggaataagattaacgcctctgaacgggaggccaacctcgtgtttgcgatgccgcccctgcaacaaattctgaaggaaaacccccctcgggcagaaatgggggcccccaccacactaattaagccaaccattgggcggagtgtgtttacttatacacttggggccttcacaccaaaggaacacaagggatgcccttccctggagggccggggaggtattcacatttgtaccatgcaantgcttgaaagggggaggaaccancaagggccccgttttggaagcttccacaggacatggtacccccatcctttggcgaatggccataacaacgccggcgggggaccaaagccgtaaattgcaggataaacatatggaaccgccctccccattaacaaagtaaaataggccgcccg

SEQ ID NO: 74158 - DNA, 591 bp, Triticum aestivum
  unsure (1)..(591): unsure at all n locations
  Clone ID: PAT_TA_74158
ccaaaccaaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaagggcaagaggctgaggntgctgctgctgccacagaggaagcaaagaagagcaacaatgtccaaaggaagcctgagaagcgccagcagggacgtacactggactcgcc

SEQ ID NO: 74159 - DNA, 673 bp, Triticum aestivum
  unsure (1)..(673): unsure at all n locations
  Clone ID: PAT_TA_74159
gtcgtgtgtacgtgcccaaaattcatttgattctcagctgcaatcatcagatgctaactgctgacatttttaagctgtggaatgttcgaacatgctgttgactttgtgtaattttgttcagtacgagtaacatttacctcctgactctctcaggcaatggaggaatgccttgatcagcagcagcagcagcagaagaagagcaacaatgggcagctccagaggcttgagggcatcgaggaggaaggcggccaggccccggcggagaagtggcctccgacgacggtgcgggcgccggagaccccgacggagaccatggagtttctcgcaaggtcctggagcctttccggcgcggagatatccaaggcgctcaaagtgctgagcaacaagggcgtctgcgacattcctgaacatcggcgtcgtcgcgggcgcaaggtaaagaacagaggaccggcgccggncgncaacactttgaccccgacaattgccgcgggcgcangccangaagaagaagtgccaagcccgccggtctcttccaaggccggcaagattggacgcgccagttctttcgggcccggcgccgcccgngggagggccaggggcggcaagaacacaatgggcgcctggttcaaggaccanaaggagagaaacgcgccaaggccggtcccgaacgggc

SEQ ID NO: 74160 - DNA, 590 bp, Triticum aestivum
  unsure (1)..(590): unsure at all n locations
  Clone ID: PAT_TA_74160
gagagaactagtctgagnnntttttttttttttttttttttttttttttttttttttttttttttttttttttttttttttttttttgggcccaaaccaaaagcaacaaactttttgggcaaaattaatccaaacaaaggtttttggcatacataaaaaacttgttttggcaaaacttttttttaaccaaatttactttgaagcttttccccaaaacttttgtccttttaaagggaaggggggtaacccagcgttgcttaccccttgttttttccagggattaaaaagtttcttggccccaaatgatgggcccgttcatgggctgcttgctttattgggactttagaccctaaccaaagccggtgggcgcagtttgtcctcctccttttgggggtggatggtacaaagtccgccacggggtggagggccaacttgccttgggtcccatnagcatattttcacttgtaccaaacgcctgtttaagaactgctactgacatatgctcgttacgctgacaagaatctacccgctgactatgatttgtttgcctgctgcgtaaagactcaacttacccttctacaggaacactt

SEQ ID NO: 74161 - DNA, 486 bp, Triticum aestivum
  Clone ID: PAT_TA_74161
cacaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacacacatttccccaaccccaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatcta

SEQ ID NO: 74162 - DNA, 677 bp, Triticum aestivum
  unsure (1)..(677): unsure at all n locations
  Clone ID: PAT_TA_74162
tcgagcccgacgggggatcaatacaacgagcggggaaagacctctggaatatggtcctgtgatgcggcagccggttatatccctaaagccgctgatttcccctacgaaatctgaccacactgggggggtttataccaccaatgggaagccagagtgccacgactctaagaatcagccgactgggccaaaatgcccggctaccggcaagaagatccaaagggttgcaaacctgaggcctattgtgtactggaggaccagattgtcgtcgagcaggatgactgcgaaccctccttataagtttgttatagctgccgctgcgaggcgctacgatactatcaagcgttttttggcgcagagcacatgtatacctaaagtgcgctaatgatgctgaaaacccacgaaaagatctgccagagtgcgccaccgcgacgctatgggactcaggcagattttttgtgggtcccttagaccgtgcaaaagtggtagctcacaacacaaatgttctgatccctggtgccagaaatcggcaacatctttgtttggggatggtattaaaattagaattcatcttgcaatttttggaataaagcggtggccttgttagaaattatcaataagccattgtgggcggtagcaatgctcctccaatattttggaagctattcgtaggcgggttn

SEQ ID NO: 74163 - DNA, 693 bp, Triticum aestivum
  Clone ID: PAT_TA_74163
cctggagctcattgtaggctcggttaccaccacagcctcctaaccctttactgcattccatactgcttgcgatccataccatccatcatctccaaagcatcaaccatctacacaaccacaagaacaactcaattccacatataaaagcttgaacccatatcaagataccctcctacaacactgtaccccaattactgatatgtccttactaccgtcacagctggtgcaacatagcatctcctacgtaatgttgcaacaatgttttcatcaactaaaagccatccccaaacaatcaacatatgaggccatccacaacttcatgcacgccatcattgtttaacaacaacaacaattagtacaatgtatttacacccaaccttaactcttacaacatcaaaggcaacaacaaaaggtcaatgttttactcagccactacacagactcaatctaatcatggtttgattgcggtgatacgaacattggtaatttacaacattacggcaattttcgacttacattatccaccatactgctacaccaccatatttttttctcatatcgacagtaaacaaaacattccattccttcataccttctacattgccaaacaacgttgcctggataaaaggattttttatgtacgaaataatttcttgtggtaaaaattaaaattccctgccattatccatttcc

SEQ ID NO: 74164 - DNA, 616 bp, Triticum aestivum
  unsure (1)..(616): unsure at all n locations
  Clone ID: PAT_TA_74164
tccccctctgcgttccccaaaccttccaagcgaagctgcttctaaggttttccccgccgccgcccatggccgcctgcccggaccgtgccaatgacgacctccgccgccgcctcgacgtagacacgcctgcaccgccccagatcgccaaagagaagcaaggcctggatactggcatgcccctttctcctcagtggcttatgaaggagcccagttcacagggttcacgctcagatgctacaaagacatcaggtaatggtgaagacatggactccagtgcgaagaaaaaggatgtcttcagggcttctgtgcttgatggcgaaactgcgcgtcgtgaccattggcgtgatgatgagcgggaaccaaattcaggccctcggtgggttcgctggagggagacacacaaggaacaagctgatgcacgcaaggtggaaaaatggtcagatgactcgtccaagttttctgtggatggccgtcgtgctccacacgaacgttggggtgattccagtaacaaggagggcagctatgaccaacgccgtgaaggcacgtggattactcgttggggttccaatgataacgagtctgacaattggcgtgatcgctggagtgattctggcan

SEQ ID NO: 74165 - DNA, 657 bp, Triticum aestivum
  unsure (1)..(657): unsure at all n locations
  Clone ID: PAT_TA_74165
ctgagnnnnnnntttttttttttttttttttttttttttaaaacaaggacaaatgctttttttgatgcaaaaatgcttagttcatgccaattcaattggcatttttcaaaactaccactcccttcattcagaattacttgtcacagaactaaaataattttggacagagggagtttttgacatggaatggatagcagagcatacattttattgtggaagcagcataccgcattcaatgttgcacaaataacatttaacaaaactgaacattagaaaaacacttttatgagtgtaagtcagcactatcgccgccgagtgatttggccaaactatttcgtaacagggatggtttagaacatgcagggtgcccattcgcatacaaggttttgacttccttcaggcgatgattagcctatccggcttagccatttgcaggctttcgactaaagtttcagaaaatctccaaggttccgaccttcagggttatgtgttcaagaaacatttgcatcagttctttttatgagatccgcatcagatttcaaactaagaatctcatgatcattccacgctgagcagagccttactcacagtgacggatcnacgcttaggcttcngcgccgagtcnccgcttacgangcccagaacggagcacgaatc

SEQ ID NO: 74166 - DNA, 641 bp, Triticum aestivum
  unsure (1)..(641): unsure at all n locations
  Clone ID: PAT_TA_74166
aaaatatccaacaaggactgaagcgtggtatgcgtactgaagtcacgaagcattctccatcgttgcaacgcgatgctattcatataaatgaggcatacataaatcagttaccaagatatctaacagtacgactaccgaggttagattggcaaaatacagcacaaagccccatcaagattttccagaaagtcgaatttccaactgaactggatatgcatgacttatgctctattgaactaaagcaaaagattcaagcttctatacaggctctggaacattccagcatggatgttgatcatgttgattcttcaaaacctgagaaagcattaactgcgatatacgatttagtggctgtcctgacacatcagggccggagcgcactttttgggcactatgttgcctgggtcaagcaccaaagtggacgctggatacagttcaatgatcatgttacatcgctacatgacgaaagtgaggntctgagcctatgtggtggcagcgatcaagacaagcacacggcctatatctgtgtttacaaagctcgcttagtttgaatcatggttgatacaaagctcgccacaatttgcaagaacttgagggagggatggaggcancaggntcagtggctgaatctgataccggca

SEQ ID NO: 74167 - DNA, 752 bp, Triticum aestivum
  unsure (1)..(752): unsure at all n locations
  Clone ID: PAT_TA_74167
gccatccccacccctgcctccacccccgtcccgctctcggtctccgcgctctgattccggcgcgcctcgccgggtcggaggccgccatccccacccctgcctccacccgcatcccgctcacgttccccgcgctctgacgccggtgcgcctcgccgggtcggagaccgccatccccacccctgccttcacccgcatcccgctctcggatcccgcgctctgacgccgcgcgcctcgccggaatcggaggcttagggagggaagcttgtccgcgtggcgttcgttcctgcggttgtctcgttactcgccgacggtccaagtagggcggcggcgagcgacaggacgacgcangcgtacgccgaccaccatncccctccgacctttctctncgncatccccgcccctttcttcagccaccccgcccttggtcgccgcgcggttcgcgggattaggggcacaggaggggagggagcgcgtncctctcgcgggatccaagggcagggtcacaggggattgactggaacgggtgattaagagaaagggngtttnnccaaagtgggcagccttatgaaagtacaaatgtggccaaaagccgttggcttaggggtaatttgctaactaaactggcttaggtcctcccaantgggaatggggttttgaaaagtggggccaaccaaggccccggtcccaggaatcaggtccccttttccacaaggtcttaaaaaacccggaactttttgggaccaaggaaggag

SEQ ID NO: 74168 - DNA, 718 bp, Triticum aestivum
  unsure (1)..(718): unsure at all n locations
  Clone ID: PAT_TA_74168
acggggcagcagaaaccggcgccgaccccgggcgaccganaagcaacctgcggcagcgccaacgcggcacgaaagaacaagggaccaacaccatcgttgatacttgaaggaatacatgaccagagattctggcctcatatgaaggacaagctgattgcgcctttgccgaaccagcaaaagactgacctggactcaggagggccacgccttaatgcaactgatgaaaaaggtacattcgaagtatcagaagatgctcttaattacaaagagggtattaaatggtgagcttaagctcctcaagaagaggagggaaaagaaccaatccaacatgaacgggtgtggcaggatcaatagtgcgcgtgcaactatcctagacgtgccgggattccttaagccagtagagtcagaataggggataagcatcatcattggaggggctgggaccacagggaaacataaggccatacgtgcccgggaatatggacaaaagaagctgaaagtcagggatttaaaagaaaacccggtgcgaaaaataagggacaaaaatctttcgtaggcgactaagaatcccaaaaagcgttggaaaaatctgatgggattggttaaactttccaactgtgctcactaggtagggaaaaaggccaaatgggggtatatggggcaaacacaccaaaaacgaattcggaattcgaagggggctgtgcctcaataaaaattc

SEQ ID NO: 74169 - DNA, 665 bp, Triticum aestivum
  unsure (1)..(665): unsure at all n locations
  Clone ID: PAT_TA_74169
cgaccgtctggagcggaggcatcgagtggatctgctaccgccccgtatcgtcgtcgcggcctccaggaggtccgccggcgtgaaaggaggagagcggcaagcctgagttgggctgaagcttctgtcacagctatggccccgcgcccgtcccagattgcggcttctcccgtcgcaagaccggctccccgtcttgattcgtcctcgcgctaaaggccaggtcttggagttgctagcagccatggtggagctcgggtcgggatagtggaggtggtggtggtggctgttgtgccgccattgaagaccacggcggcggtggcagggcagaggccgcggcgagcgacgagggcggccgccatccagcgggtcttcggggccccgacaccattcacgcagctgccgacctcgcctgctgcgcgccatggatgagcccacaattcaactaagtgaacaaactactccttagatcgatgcatgcaaagtcatatggttggattgatcctcgtccaggtgacaatggcgctccattaccatagtcatcgactactggtctgtttgtcagcagaggaaatggtgcaactagttcaacaagaaggacanngacaatgaanagaggagataaagaagaatacgagtccgatttctacttttggtcctgaaatccattg

SEQ ID NO: 74170 - DNA, 710 bp, Triticum aestivum
  unsure (1)..(710): unsure at all n locations
  Clone ID: PAT_TA_74170
tccaaccccagggatgctactaataaaacctcaatgttacgcaataccgaccacgacgaccacccaaaaccaaaatattctttcaacccccttacatcctaaaattttgccccatgccaagtctaaacaacacaccacctttctgactggatacacactattataccaagctacacccataacactttcaccaccatgacaaagctatggcccttgactaatcctcacctaattaccatcctacaacccccttttcgatccaccaccaatataaccactctacgggccatacaccgatccaacatctatatcaccaccattatatgccaagtcgcccttacctaacacattctaaaactgtttttaacctagaactatttcttacaaaaccctcgaattgtataccctattgaccaatatacctctttaatatagccgagaacgcacataaatcctactcttgcgtaactacccttaactcaatcttaaccaaccaacatggacaaactctattagacccaccagtcactcctacacatatctagggtctcaaaccacaatacactcttatccatatgtacatacccagacatacactacacatatattttttaaccattatacccaaaaccaatacacatttatattgtctcaatctccttgacccactatctcaantccaaaatcacattaatcacaactcactcacc

SEQ ID NO: 74171 - DNA, 792 bp, Triticum aestivum
  Clone ID: PAT_TA_74171
gagagagagagtgagagagagagagagagagagagagagagagagagagagagagagagagagagagagagagagagagagagagagagagagagcgagacagagtagagagacggtgagcgagtcgcttcatgagatccacaaatgccggttgagcccgcgcttgctgttccgcacgctttcctctcagctcctgcgacgtctgattgttctttaatgtctagatagacctcctgttgtctttcctctcgtccgggctccttctttttattgagtgcctcctttggctcttccctttctccgatcctattttcttggtacaccgtgatccttttgtcgtttcttgaccacttctcagagtctccctttttccccatgatatgttccccattcggtacgctttttattgtttctggatccagcctctctaatgtccctctgtctggagtctgcaagctcttcttagccgcgtgtgactccatggactctcagctttcctacccctcctgtccagtttctctctggtcggtcgtgttccctattttttaggggccctttgtcgctgccgttattgttgctgtccatcgttgtaatgtctgttttcgagcccggctggccctgctttactaaaccttgtttaatgtttggggtctcgcctggaattccactccttgggtgcgttttttggaaccaattgggtatgggattggattctaattcaatttggcccctgtctttttttcgcttgtggtcggtttctggcattgttgtgggttctggtttcgcattgct

SEQ ID NO: 74172 - DNA, 651 bp, Triticum aestivum
  unsure (1)..(651): unsure at all n locations
  Clone ID: PAT_TA_74172
catgctgtgcgatccgagccttcttttccacctcgggcttccgatctgcccgggagcttgacaggatctcttaatctctgtactattactaccaatctcgcaacggactgccacggtaacaacccaccatgaggaacatgggctcatctctgttgtctctccgctccaccactgattggtttgggtgcgcatatatccctcctccggagcgcactggtaagccgatatatggctgatgagataccggacgagatggtacaacttcctcccatcgttcatctggcggcgtttgcgtactgtatacactcagatgctcgctggctagagcgccatgggtgcgggctttctactttacatactgctcctgggcactgatgagatgatccgcacaatgtccagccttattgacgcctggaaggagctttacatggccaaacgtaagtacagcactcgtattcgcagcgtgctattnacactgttcgactgcttatttggctcttcatggcactgccgattgcaagctatcttgcgatcgcgttccagtcgtgctcatatgaaccatcgatgactcgcagagatcgacgatggcgattgcacgttggtactgatattgtgagtctgctccatgagcgtacgtgaccgacctcaaan

SEQ ID NO: 74173 - DNA, 614 bp, Triticum aestivum
  Clone ID: PAT_TA_74173
accagggatttctacctaacaccaatccaccatcaagaccttcctcatctttgctctccttgccattgcaccgacaaatgccattgcacaaatggaaactagccacgtccctgatttggatattccatggctgccacaaccattaccaccacaacaacaaccaccatgataacaccaacaacaaccatttccacagtaacaacaaccaattattatactgacacaatcaccattttcctagcaacaacaaccagctctgacgcctcacaaccagtcttatactccaacaaccaccattttcaacggcccaacacacaccatactacaacacccaccattccaacaacttcaacaacaaccacaaccacaacaaccaccatctttgcagcaacaacaaccagttttaccacaacaaccaccatttttacaccaacaaccatccactattttccccagtcaccaaccaacccatattcacaaacaacccacctttttccacagccaaccaccaactggtttcctacaacaactaaatcccctctcagctgaaccatttcgctcatattgctgccttaacctctaccaaggcgattcctgccctcactcaaaagtcg

SEQ ID NO: 74174 - DNA, 644 bp, Triticum aestivum
  unsure (1)..(644): unsure at all n locations
  Clone ID: PAT_TA_74174
tcgggattaaccacaacaacaacttccccagccttagtcaccactgcatcttttttttcaaccccaacaaccattcccccaactataacaacaacaatatccccaatgaccatttcttttatatcaacaaactcaacaaccttttcttctttttcctcaaangcaacaaccacaacgccnnnntttcacaaccccaacaacaattcccgcagccccaacaaccgcaacaatcattcccccaacaacaaccaccgttcattcagccatctctacaacaacaggtgaacccatgcaagaatttactcttgcagcaatgcaaacctgtgtcactggtgtcatccctctggtcaatgatctggccacaaagcgattgccaagtgatgccgccacacatctatcaaacaactagtacagtttccttcaaaaaaccttcaatgtgcaggtccttccttaccaatcaatacatttccaatcattcatgccccccaggaaccaaccaaggaaccaacaaacaagnggcattgccatattccctggcttgaacaaaactatgaaacaaaccattccagtaaagataaaagggtacctaacagatgcaagggcccagtttcatatattcccaaacctccaccaaaacacagatt

SEQ ID NO: 74175 - DNA, 679 bp, Triticum aestivum
  unsure (1)..(679): unsure at all n locations
  Clone ID: PAT_TA_74175
aaaaaatcaatgatttttccacccccccccccccccccacacacaaacatgtataaccccgtcattaatatacacaaatgttttacttaaaaaacacatacttcaattttctgcaaaaaaaaggcaagtccaaaattctagcacaaatcgtgtgtggaaccataatacaataccgtcatccgtctccactaaatgaatatttttgcttctaaatgtaaaacacgtaagatctctttcaaactcaggagcatccaaatatctaagtgcgacaaccttgtgaaacaagatacaatgtcatatgcttaaaactaaacacgtcatgtcatccatcaaccttaaaatgcgaataagcacatcagattcttaaaaccttgattttgtaatggacggcttatagttgaaggcatagtacctacgtattagattaggacaaaagccagtatatataaaatgtatttcactaaaaagtaagatcaaacatgtcacgccagccatcagccttaaaatgccaacaagcacaccaggttcttggaaccttgattttgtaatagacggcttatagttgaaggcgtagtaccttcgtattagactaggacaaaagccgggtatantaaatgtattcactaaaaagtaaaatcaaacacgtcacgccagccatcagtcttaaaataccaacaan

SEQ ID NO: 74176 - DNA, 612 bp, Triticum aestivum
  unsure (1)..(612): unsure at all n locations
  Clone ID: PAT_TA_74176
gttttgtcactccgtcccgtcccgtcggagaggagagatccgggcgtcgatggaggcgagctcggggcctcgccggagttccgcccaggaccagatggccccagcgacgggacggaccctattaacttccttccccaccaagtggttcttctcgtnctcgcccgccttccctgcgccggcgacgccggccttacgggagtcctttcccgccggtggctcggcctttgggctggccttcgccagatcgtctttcgcggcgtggcccttccgtcgctcgaagcggcgcttgggcgcgttgctaccaccccgcccgcgggtttccttcttaagattcgcgttccgatcaaaccacagcgtggacccgtcctcatggagcaccggacaaacagcgccggcgttcccatcaactcgttgttccgcgccgncgcgcgggtcgatccggagaagatcgacttccgccttcccttcggcttaatcgatcgttccctcgctgtcgatctgccttgcttncaccgcgccaccttcatcgngctggacctttnccccatcaccctggccgtgcccggcggcgccgatttcccgcactcgagacgctgtccctggcgcgttgca

SEQ ID NO: 74177 - DNA, 787 bp, Triticum aestivum
  unsure (1)..(787): unsure at all n locations
  Clone ID: PAT_TA_74177
tacaaccctttattcacctgagggaggaagcatcacccaccactccgacatccaggctcgactgatggcgcggaaggcgacagaagcgcgggaaaagatgcctagggcgcaaccagatccctaagaggaacgacctcggtgcaagtctgctaacacaaacttctgctactacaacacctatactaagtctcaccctcgatacttgtccaaggcctgaccccattcctggaccgatggtgggtgcctccgtaacatcgccatcactagcggctgccgtaaacccaagccctcagggacctccgacgccaacgatcttcgggtggactccttatcagaacacactgactgtcatncatcccttggaagcttcgccatggaataaactttttgcaatgagcgcccccgaaattaaatagtcgactggatctgggaggattctcaaataaagtcctttttcactgaaccaagcgttttagaatccatccgtggtggcattccgaacaccgaaacggcttgggcaaaagggcgcccctcggtaccgggaaccaacatgtcctctttttatcataacgctgttcctgaatagagtgtggataacagaggtagggagctttccttggctctgtgccacacctttctgttctaacaaacaatatgggtctgacctatctcaataagattggggtcttagnatttccaggaccttttgacggatattccggaatggacgccgcgcggcaggcggtcctgcgatttctcggattgtacccccgttcccaatgagccg

SEQ ID NO: 74178 - DNA, 667 bp, Triticum aestivum
  unsure (1)..(667): unsure at all n locations
  Clone ID: PAT_TA_74178
atctcggccggccctatggcgtcccaaagcagcccggccggagcgccgcccggtttccctaaacctacgaactaccttcccgccgtcgatcttccccgtgccctcggacgctgccgcatgctgctggacaggctgctgcaacatgaggacgggtgggtgttcgccaagccggtggatacatacgaactcggactccgcgactactactccatcatcgccgaacccatggatctcggcactgtcagccgccgccttgaattgcgtcgctacccgaacctgctctgctttgccaaggatgtccggcgtaccttcagcaacgccatgacctacaacaacaagggagacgatgtgtatgagagtgctgctaagctctctcgcatctttgagtcagggtgggcctccattttggcggcgctcccgtcgccgccgccggtcgccgtgcgcagggcaaggctcaaggatgagttgccgcggctgccggtggacttgcaggacaaagcggccatcattatgacagacataggcgggtggatccaggaggtggatgggagggntgaggntgatttggacaaggccgacgaggcgactcttgacaagctcgagtggctgctcgctctcgccaccatgaggaaggaggcangagcgctggataatcaaatttgatgtg

SEQ ID NO: 74179 - DNA, 498 bp, Triticum aestivum
  Clone ID: PAT_TA_74179
attgcacggcgcccaggaggggcgcacgaggggggcactaaaaaaccgagcacaccccccacgaacgacgaacggaggacaaaaacccccagaagaggacaagaccccccagacccacagaggcccgacgcccccaaaaggcaacgccccaggccagcgagccccgcccaaccccggcaccaaaagcggaacaaaggcccggccccaaggagccccccaagggacaaggggggggaagggggccaccggaaaccgacccccaaacaggggcaacacaccgccaggcccacactcagggaacccgaaggcggacacaccgggccccaagggacaacaaagaatttggagaagcacaagaaacggcaagacccgggccccaagacacttggaaagccccccccgaataacccggaaacgagttgtgaaatgggctggccaaccaaaaaaaaaaaaaaataaaaaaaatttttccaaaaggcccattgggggcctccccaa

SEQ ID NO: 74180 - DNA, 799 bp, Triticum aestivum
  unsure (1)..(799): unsure at all n locations
  Clone ID: PAT_TA_74180
gcgtagaacaggagaaggagcaagcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacaccaagggtcgcttccgccttcactctgtcagggatgaggatgctaagttcaagctctgcaagggtcagggtcttgtccaagtccgcccaggaagggcattccccctaacctgaaacaccctattgattgggccccgcacccattccccgcttaaccccaggacccccaccttgcattcaaaggggccccaaatggaaccnacccaanccaaaagccttccgaaaccccttggggaaggaacccaaaaaccaaagggaattnttggtnttggaaactttttccaaattcaaaaagttttttttgaaccggtttccgggggccaaaaatggttggggggncccaatgggggtgttnaaactgggggtggggggggcccggccaaaacccaacttttgggggtgccggtgg

SEQ ID NO: 74181 - DNA, 774 bp, Triticum aestivum
  Clone ID: PAT_TA_74181
gagtggaggtcccactaaagaggatataaattaaacattattcattacatatctcattaacaatgaaagaagaagaaagaatactaaccataaagtcacattcatgctaaaacaaacttacatcaatatttaaatcaaaaatacacattatcataacaagaattaatcacaattaaccgataaccacataataacaacaaaaatcttaaataatatgatcaaacaaactatcatcaaaaaaatatcataaaaaaaacaatctaaatatctaatacaaaaatatcactaattactaaatacaaaaaattaaacaaatatctaataaagattaaaaatcaccacaatttcctaaaaaaagatcgaagaaacacataataaacaataacaaaaattaaactcataaaataaaactaagataatcaaaatataattcaataataaacctaataaatacacacatcaacactcaaaaaaattcaaaaacttaatcaaatcaccaacaattacacaattcaatccaatataaatactcaattaaataaatgattaaaaaaaacgaatatttacaatgaaaaaataaaataaaaacaaaacttaagttaaaaaaaaaacatggaaccaaaaatacaacgactcacaaactacacctgaaacccaatacgaaacaccataaaaatatatatactaaaaatataatattaacaacaactccacaatacttttaactacaaactattaatccataattcacgatccacaaaataaacaatcaca

SEQ ID NO: 74182 - DNA, 619 bp, Triticum aestivum
  Clone ID: PAT_TA_74182
cttgggcgggtataaccctatattcttccccttattccccaataggagcaagcaagcgaccatggaccgcagcaagctgaataaagtggtcgggaagaagttcggcgggccgaggaaaaagtcagtgaccaaattcatcaaggccgggctccaattccccttttgccgcatcgggcgctacctcaagaagggccgctacgcccagcgcgtcggctccggcgcccccgtctacctcaccgccattcttgagtacctcgccgatgaagtgctggatcttgccgggaacgccgccaaggacatcaagaagaccctcatcgtgccgaagcacctggttttgtccatccgcaacgaccaggaactcgggaggctgctgtccggcgtcaccatctgccaccgcggcgtgatccccaacatcaacccggtgcttctccccaaaaaggccgtccagaaagctgataaggccggcacccctcccaaatttcccaataaggccctccaattcccccaaggaaggccccccacacgcccttaaatcctcaattgacttcttgcgagtaaaaccacaatgggttccaattttgggaataagaattttaatccgccttgttttccacctctt

SEQ ID NO: 74183 - DNA, 232 bp, Triticum aestivum
  Clone ID: PAT_TA_74183
ctcggcattgatggttccgccaattgctaatagctacaagtggctggctactcgtgtgccgacgcgtgcatggaggaacactgtgcaggttacattgttcactttgagttgggcactccgtgcaagcccgtctggtcgatggacaaatagaataaaagttttcatggcatccgcataatgtggtctatttgtccgatgcaactaataaaatcgaaccattttccccttcaaa

SEQ ID NO: 74184 - DNA, 644 bp, Triticum aestivum
  unsure (1)..(644): unsure at all n locations
  Clone ID: PAT_TA_74184
ccactggtggttttgaggctggtatctccaaggatggccagacccgtgagcatgccctccttgctttcactcttggagtgaagcagatgatctgctgctgtaacaagatggacgccaccactcccaagtactcaaaggcccgttatgaggaaattgtcaaggaagtctcttcgtacctgaagaaggtcggctacaaccctgacaaggttccctttgttcccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgntacctttggtcccactggtctgacaactgaggtcaaggtccgtgagatgcaccacgagtccctnctggaggcgctnnctgtgacaatgttggcttcaacgtgaaaaacgttgcttgtaaggatctgaagcgtgggtttggtgcattcaaactcaagatgaccctgccaagaagcggccaacttaacctccaggtcattatat

SEQ ID NO: 74185 - DNA, 585 bp, Triticum aestivum
  unsure (1)..(585): unsure at all n locations
  Clone ID: PAT_TA_74185
agaagcgacacaactcctatatcgtacgactgtagtatcgatggggtagctgaggttctactgctggtgatacaaaggccttatccacggggacactgatgtgcttatgtgatatcatgctgactgtagcgggtgcccagtcggctgacaaatgtcatggtgatcgataagccatgactacggagtgtgctacgtctcaaagctggtcaacataccgaggactcaatgcgtagggcgcatgctgcgctgggccacacaaagcgagcatcccatgcctatctgctggtgtcaccaaggacaaacagaagatggcgtatggcatgcgtaggctacgctgccacttactgcaggatgtcattcgcacacagttacaactgcggaagtgacacatttcctcctctgacagatgattgtagtttatgcgcangaggagaccataggctatacattatggagcgtggactcacaagagctatacttacacattagtaacacgngaggtgctactcataatagtatatgttaagtactctgtatgagacccaatgcgatactaagacatgctgatcctcacattaatagata

SEQ ID NO: 74186 - DNA, 590 bp, Triticum aestivum
  Clone ID: PAT_TA_74186
ggttaatatgcattttgaccagcctgattagaagcacgcaacacaaagattactgatctgctgaataaaccggaacgtccgaacacccatcctagacaccatctcaaccagatgaccgaagggctacacccaggactgaagtatcagcagtaagtttataaggaacattgtgcacgcaaactcataggaacgaatcgcaatactaccgtgcgcgtcaatggtatccacttactatgcatattgacggaggacaccactttattgacggacgtcacaaaaactgacattgatccgaggcgctgcttacaagataaagagctagcatactcctgttgtatatttatcgtacctgacgatctctcattgcctatcaaagatggacatatatagaccatatacattagcatcaaacatgttattcagaggactgttaaatagtgaaccgcttttccatataatgggtgaagcagcgccttggtccccaagcatagttaatacttgggggttgccttcccaatttcttgagagcgttgaatacatgtggggaaccattggtataggaaactgtgtaacataagacttgattacgc

SEQ ID NO: 74187 - DNA, 631 bp, Triticum aestivum
  unsure (1)..(631): unsure at all n locations
  Clone ID: PAT_TA_74187
gtgaagagaaagttggagctatttcgtgcaacaaaggaccaattaagaagcctgttttgaggtattcagatgatgatctagaatttatgacccgtagagagcacattaagagaccaaaggcataaatttgtggacctgacataagcttttttattatttatttgaatatatccgncattttcaagttactcaacaccgtcatttttttattcgacgacgagggctccatactctccctcgggaagctctaccatgacatgagcacggcgggcgggcttgtagagcaagtgcagaaacacacactcagactttgcgaggatgagggccgtgggctgaaacaattatncggggagggaggaaaaaaccaggtggaaaataatttctggtagcgtttttttttgtaggggccgcataattaactttctttggggggggcgccccctttttattatgggagttggggggggaggtttctttttggggaggaatccgtagggctttatttttttttttttcgggcgcgtaaacaacaaggaagagcttttacgttcccccccccggatttattttccttggcctttcnccaggggggggggaaaaaaacaacccccgggaaatttttgtattcgcn

SEQ ID NO: 74188 - DNA, 549 bp, Triticum aestivum
  Clone ID: PAT_TA_74188
ggcaagtacaagctgctgaagggagccaaaggagagatcatgttccttaaagctgagctcgagagcatgcgagcattcctggagaggatgtcggaggcggaggaggagcccgacaagcaagccaagttatgggcgaaggaggtgtgtgatttgtcgtacgacatcgaggacagtgttgacgagttcatagtcctggtggaatgtgagtcggactgcgagccgcatggatttaagggattcattcataggagcatgaacttgttgacgacgatgaacactcggcatagggtcgccaaggagttcagaggcctcaatagccgtgtcgtggaggtgagcgagcggcgcatgaagtacaagattgatgatgctgtctcaaagcaaaacaagacaaccattgtactttaccttctggcactctacgcagacactgggggccttgtgggtatcgacgggccgagggatgaattaattcaactgatggcgggtgaagaggggggttttgcgcaactgacgaaggtcctctctatagtggggtttggaaggcttggg

SEQ ID NO: 74189 - DNA, 614 bp, Triticum aestivum
  unsure (1)..(614): unsure at all n locations
  Clone ID: PAT_TA_74189
ggcctgcgtgatcctcctcctgacaccatcactctcactctcactctcacacgccatgagcagcagcagagccgcgatgcttcgtagactaataacccatcgccaccgcagcatcgtcagcgtctgcgacggcatcggatcaccccagcgccagctgacccgccaccgttattctaatccccaccagggttattctaatcccacccccgatctcgccggggcgcgcgcgtttacttctttactatccacgccatggccatgccgcccgcgcgcgtccctgtcgtcgctctccttcttctccagcctggctggaaggggcgaggatcaggaggtggaagggctggacatggacgccggcacggtgcgctgcgcggncaactacgcgccgctcacgccgctcagcttcatcgagcgcgccgcggccgtgtacggcgaccgccccgccgtggtgtacggggagggcccgcggcgcacgtggagggaggtgcgggagcgctgcgtccgcgtgggcgnncgccttgncgnacgcttnggcgtngcccgcggtgacgtggtggctgtgctcagcccgaacgtgcctgcgatgtacgagctgcactttggcgtgcccatgg

SEQ ID NO: 74190 - DNA, 644 bp, Triticum aestivum
  unsure (1)..(644): unsure at all n locations
  Clone ID: PAT_TA_74190
tgtaggcatgctcttcatggcctcaatggaagataatgaggctatagaaattgtcggtgcggaaaggttctcacagtatatggggtatggctcctcattccgctttgtcggtgattatttagatacgaagccccttgatgcaatgggtcgacgaaaaactaggattgtagcaattgatgccttggactgtccaactaagttacagtatgaaactagtggtcttttaagggaagtgaacaaagcatttgttggttttttggatcaatcaaagcatcagttcgatgtgaagcctttgcaggattctaattccaaggataatcatccaagtgtcaactcagttgactgtataggagtttcaaccggaaactggggttgtggggcttntggtggaaaccctgaaattaagagcatgattcagtggcttgctgcatcacaggcgcaccgactntttgttaattactatacttttgaggatgcgtcacttagaagactagaagaggtgatgcagtgggtattacgccacggatggactgtcggcgagttgtggcacattgatgttgagtattcatcccagaggctcaagagagaaactnttgacggccttttgactggttacttncagaggacaaacgtcatatgatgcg

SEQ ID NO: 74191 - DNA, 760 bp, Triticum aestivum
  Clone ID: PAT_TA_74191
gggctagcggcggtgctcctcggccggtgtcggtgtggcccgtcggcggtgatgccgcgtgcctcggtggtgcttgacgcggcggtgcggccgttggccgtggggcggcacggtggcgctagtggctggcggcgcccgccaagcccagatctgggcccttttgggccccatatgggtttgggtgggccggtggctcgatgttccgcggcgtcgtttcctggtgatggcatggtggcagcggtctcgggtggtgaggatttcgtcggtcggcgagctgcagcgtggcgacaggattgtctgggtccaagtggacccagccgggccgtcgaggcccggcaaatcctcgtcgccgggtccggtcggcttccgctgcggcggtgggaggtttgtcccccttccctcgtttcgagttgtgcgtcgctttccgtgggccggggttctcctttgccccgagctagggccctcgtggttggccagcttccaaaagagggccggcagggaatcaagtggttccgggtaaacccgtggggtgggcaacaagggccttggttggggcccggctttgtttgtggggtggggtggccaatcctttcgaaaagtggcccttcgggggttgaatatggtggggttggtttttttgggatatctgggggaagaaaaaaatccttttgttccgggcctttttttcccggggaaaaccccaaaccgcgggggtggaaccccctttttgcggggggccgccccaatttgggggaacccc

SEQ ID NO: 74192 - DNA, 620 bp, Triticum aestivum
  unsure (1)..(620): unsure at all n locations
  Clone ID: PAT_TA_74192
cccgcttaataacggcaccattggcccgtctgaccatatgtcccgttgctggcggctgctctaaaccactgtgcctatgcccgtgttcagaagctaccccccggctacaatggcggcgaacgaaccgatgcgcgagctcgtcaccggcgccgcacgacatatcggatatgctcttgttgcatgattgccagcggagttatgctcggtgcataccatgctgttattctgcatatgctggatatagaatttgctgctgaagctcttaaaggtgtcaagatgagagtgattgatgccgcatttcactttcagggagtgctgaacaactgatgttgttgaggcctgcacttgtgtgaatgttgcggatatggttggtggattcccacgaaagaaggatggacaggaacgatgttatgacgaacaatgtttcaatctacaaagctcaagcatctgctgttgaagctcatgcagnccccaattgcaagggtctcggtgttggcaacccagcaaacaccaatgctctcatacttgaaggagttgctccatctatccctgagaagaacatcagtgtttgaccctgctagaccacaacaggggcactcgtcagatttctgagagacttg

SEQ ID NO: 74193 - DNA, 715 bp, Triticum aestivum
  Clone ID: PAT_TA_74193
ggggagtttttttgaacaaaaaaactaccgttgtctcacatatgcctctttgctaaagacatcaccgtcatgcgaaagagtataagataccatgggactcgcttcacacatctgtaataatatcttcataccgcctacagaaacaagcgtacttgcatgcggtatcgaaggggcctgctagaaccattctacaaaatactagatatatttctgaaagaacatcactctaaattcaagttagttctagttaaggcacttcaacatattaatatcaacgggaaagttccaagagctcatcatgttgccagctcatcaattcagacgcagcataaaccatacttgatgggtaaaatgacactcctgcaaatggaccctgaaagggactgaaaattgcaaagttctgaacgagcacatggtaactaaaccacccgcaacgagtgagggctaaggcttggagaccaaatcgtggcctaatgataatggccgtactgtggcttacagcgcaaacttgtaatcttcaaccttttaaaaccgtttcgtatattgacaccaaaaaccaatggtggaaatggaaacccaaattttcattttaacctgactttgtttcacccgttttcttttaaaggattcccaattccgcttcataaacctttaaaccttgacagggcgctaaaatactttgccccgccagggaaacctccaatttttatgcctt

SEQ ID NO: 74194 - DNA, 765 bp, Triticum aestivum
  unsure (1)..(765): unsure at all n locations
  Clone ID: PAT_TA_74194
gaccgatcgcccgtcgaccccaccaccaccgccacccccgcgccggcgccgatggactacgaattccgcagccggtcgggctccggctcgtacggcggagccggcgggggcgggggcnanngctnntnnatcctatacctccacactcgccagtctacccaatgtgccacctggccaccggctggagtgatcgctctataccttcaaccgactgatgctatttactttgactcttgttgcttactggagggctgtgtttttcgatcgtatgtttatatgctgctgagaattatttcagccccttgcttttctggttcacttatattcgtatatcttggttagcttctaattatttagctgaacatgtgcgctccctgaaaatggcgtactaacttttatcgaatttgcttggttcattacttatgcctacgcttctaatgtatgtttttccctcatttactcgtggtttgtacttattctggtctaacttccatatcatctgtttagtaatattcgtctatatttacgttgaagtctttgatagtactatatataatgttctgctatatccgtataccttcgactctgttcgcttctaactacttcgtatgtactttattcgtcactatttgatacggatatctctcaagattataattctttcgtttatctatttcaacggggtgtcgagagtgtagacacacccccccnctctgtgaattagagtgttttgtgggtcgtcatactcgaattcaatatgtgttg

SEQ ID NO: 74195 - DNA, 619 bp, Triticum aestivum
  unsure (1)..(619): unsure at all n locations
  Clone ID: PAT_TA_74195
cacccacccaatgcgcccgtgagtgtgaaatcccactcttatcgcagcgcactgccgccgcgccgtcccgcagcagagcggcgccgccgacgcctcgttccccggctcctccgcctccccacctctcgcgcgagtcgccgccccccttctacctcgtcgcgtccctgctgtctccgcaaccctgggaattgggttttgaggcgtttgaggtggttcatctaagccatagggcgtccactttgtttgttaatttctaagcacgcttctgacacaaaatggcattgctttttcgcttcagtcaactgaggaacagcatatggagtagttgtcctgccaggttgcgtatgcaacatactggattgtcacctggaacactgcttgatccaaaaagctatgagaagcgccttttctcaacaagggttcaagagacagctagtttgcacagaactgatcttggtccgtgtatttctggaattcagccattaaagtttcagcagacttctgaacatgagcaatctgcgcctcttcttatctttgatattgagaccactggttntttccagaagaccactggtaatttccagaagggtaatagaatcactgagtttgcagtccgtgn

SEQ ID NO: 74196 - DNA, 924 bp, Triticum aestivum
  unsure (1)..(924): unsure at all n locations
  Clone ID: PAT_TA_74196
ttatattccaacttctgatcaatgagaaatcttataacgcaacactttcataacaacctacatctcacaattcataacacccctcccatcaaataacacaaccaaacccccatagcatccacagaatcatctataccacatgcctctctatatgtaaccactcccatctcaaccaattcaatacatagcaccaaccaatcaacaaataaatcaacaccttcccttctaatatacgcattaacaaacaaccaataacaaaccaaccataaacatccaaatcaacatcgatcaacattctattacccatgcactttagaactacagactgatgatctaataaatcaaaataatcaccccaactcatccacaaccgcctcatacacaatataatatcgatctcgttcctcctctacacaatgcttataaccaattccaaacccgatattaatatccataatattagtcctcgaaactccaatattaaacactccaattcgacgaatctctaatcttaataaatcctcaaatctctaacgtccccgcttttcaatattgcaaactcatcacgcaaccccgatatacatactccaaaatccaatcccaattccacatccctcataaactatatctcaactactcccgtcttcgtacattccgaatactcacatcttcgtgtacttgnacttcccaatatatccaaatagcactcattctcatacatcatatggtcatatattataaacaaactactcttacttgtcgcaaatcgttattacatataccccaatcaatatatacctctctatccataatcaaataatcgaactctaaacatgacatatcttatatccgtactccctctgaaaaatctattctccatataaaatatacatacccaaataataatatacaatgcggtggccg

SEQ ID NO: 74197 - DNA, 617 bp, Triticum aestivum
  unsure (1)..(617): unsure at all n locations
  Clone ID: PAT_TA_74197
tcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgctgccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctggtgactatgngaagaaagtccaagctgggttcacagtgtacccatc

SEQ ID NO: 74198 - DNA, 645 bp, Triticum aestivum
  unsure (1)..(645): unsure at all n locations
  Clone ID: PAT_TA_74198
aagcaacactagttaacaccaatccaccatgaagaccttcctcgtctttgccctcctcaccgttgcggcgacaagtgcaattgcgcagatggagactagatgcatccctggtttggagagaccatggcagcagcaaccattaccaccacaacagacatttccacaacaaccactattttcacaacaacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttncacaacaacaacaacaacaccaacagctggtgcaacaacaaatccctgttgttcagccatccattttgcagcagctaaacccatgcaaggtattcctccagcagcagtgcagccctgtggcaatgccacaacgtcttgctaggtcgcaaatgttgcagcagagcagttgccatgtgatgcaacaacaatgttgccagcagttgccgcanatcccncagcaatcccgctatgaggcaatccgtgctatcatctc

SEQ ID NO: 74199 - DNA, 552 bp, Triticum aestivum
  Clone ID: PAT_TA_74199
gtgagagcgagcgcagcgtgacagagagagagagagagcgcgtgagagagagactgagagagagagacttcgacatcgtcaccttccccaccgacttgggcgggaccctcttggatccgccctaacacccccccctcctgctcttgtaggccctcgtttcttttctctcccccaagctggacggggccggccaccgtggctaccccgccccctatcccccgggctttcggccttcctttcacctccctcctccctggaagacgggcagcctgcccacttctgctcttcggcgtgcgtgccggacggccagcattcgcccccgttgctggccgagctgccttcattgatgcgggccatccatgcccccctgtatatttccgcccccgtcccgcgtggttctgcgcgcttttagctctggtgggtgcctcctggccgcgctctccctctgggtgtcagccttgcattgcgccgttggtcgggctaactgctcacccatcccccccccctggtgcctttgcgtgggttcccaggacgctctcttccagtgctccc

SEQ ID NO: 74200 - DNA, 615 bp, Triticum aestivum
  unsure (1)..(615): unsure at all n locations
  Clone ID: PAT_TA_74200
ggagaatatacgagctgagcttatggagtcgaaaaggactcttgcttgacacatgttaattcatgcggtcggacactccattcataggtgtcgaagccngcaggaaccatgtttgacgagccccgattgccgaaacgctacttgtctaagaggttgcacaaagtcttaaggagatgacaatgtgcgtgtgtgctgtaagatcacatgcgtcatctcagaatcttatggactgatcgaatgggtgcaaagctgctctcgcttatttgaggaggctccacgatttgatgtgaggcgaggttaaaccactcttttcaattattgggcagatgactgcaggggagggccggcctccaatcaatggtgtgtcgagggctatgacacttcattgggcgtatatggacactgattggttgggacatcaatgccgcatcctaatgcatcgccaggaccgatatgcgtcttcagcctacggcgtgcatactgatcagaccctggcatgaagcccttaccaacaattgcgcatcccactgagactgtgtgagatggtactcggggatatacttggatggacagtgttgataatggtcgcactgctcatcggtgactcgactgacg

SEQ ID NO: 74201 - DNA, 626 bp, Triticum aestivum
  unsure (1)..(626): unsure at all n locations
  Clone ID: PAT_TA_74201
accaaaccctagctccccacccgcccagatcggcgccgcgccgcgccgtcctcctcggctccagccccggccccggccgccccctaccgtcctcggcgcctcggctccccgccccgcccgccgccgccggctccaatcttgccgcgctccgtcgaccgatcgtgaccgggatggctgacatgaccctcctgccggccgccggcgacggcgcggaggccgccaggcccaggaagaagaagaccatgaagtcgctctacctcgccttcttcgacaccgccgccgacggccgctcccgcgcctgccgcctctgcggcaagtcctactgcctcaccaccgccaccggcaatctggggaagcacctgaacaaccggcacccgggctacgaccagctcgccgatcaccacctgcatctgcagggcgaaaaccctgcccagagtgccatctccggcatgtttgccaggagcaagaagccgcaggccccggtgcgagctcacccgcaacctcagcctcagccgcaagcacaggttcaggttcagtctgttcaggctcaagcgaaagcgcgggccgtccgcgctcagcccagcgcaaagccggcggtcgacgtcgactacgtcaactggttgctn

SEQ ID NO: 74202 - DNA, 654 bp, Triticum aestivum
  unsure (1)..(654): unsure at all n locations
  Clone ID: PAT_TA_74202
ccaaaccaaagctgtggtggcgcgcacgcgaatcagcagcggagccaagcaaccgacgccaccatgggtatctcgcgtgactccatgcacaagcgccgggccaccggtgggaagcagaaggcttggaggaagaagcgaaagtatgagctcggtcgacagccagccaacactaagcttttgagcaacatgacagtgaggagggtccgtgttcgcggatgtaacgcgaagtggagggctctccgtcttgacactggtaacttctcatggggtagtgaggctgtgacccgcaagacccgtctcctggatgtggtttacaattcgccgaacaatgagcttgtgaggactcagacccttgtcaagaatgccattgtgcaagttgatgcactcgctttcaaacagtggcacctgactcattatggagttgaaatcggcaggaagaagaaagctgctgcagctgacaagaaggaagctgctgatggacaagacgctgaggttgatgctgctgccacagatgaagcaaagaagagcaacaatgtccagaggaagcttgagaagcgccagcatggacgtacactggactcgcacattgaggagcagctcactggtggaaggctgctgggctgcatttcgtatcgccctgtacagtgtggcagn

SEQ ID NO: 74203 - DNA, 584 bp, Triticum aestivum
  Clone ID: PAT_TA_74203
cttcggcaccagcacgaggcatgccatgaccgtacgtcttacttaacgcacatcgaccatgaagaccttactcatgctgacgatccttgtgaatgcaataaccatcaccaccgactatatgcaacggcgaccctcatggtcaattacaatgatcacgtcttcttctatttccccaaccccaacagccattatcccagcaaccgcgacacgcatttccccaaccccaacaaacatggcctcattaaccacaacagcaagttccccagactcaataatcacaagaaccatttctgcaggcccaacaagcattgccccaacaaccacaacaaccattccgttagactcaaatagcacagctgccatttttcccagcaaacacaacaacccgtttccccaacatccgacgggcctaaccccccttttcggcataaacctgttccaccatttcgggcggaacccagccttcttttacgacaaacttgagggcacttaacaaacccattttcccctagaaaaccaccaacaaccgatttccctccaggaatttaaaaaaaccactaaacaacccatttttcctccagttg

SEQ ID NO: 74204 - DNA, 647 bp, Triticum aestivum
  Clone ID: PAT_TA_74204
ctgtactgacgcgcacgcggaatcaggatgcggatccagacaaccgacaccaccatgggtatatcgcgagactccatgcacaatctcctgaccagcactgggaagcagagcgcttgctagatgaatcaagagtctcaactagatcgacagccaaccaactcttagcttttacgcaacatgacacagaggatggtacgagcattcggatgtaacgcgatgtggtgggctctgcgacttgacactgatagctgctcatggtgtagcgaggatgggaccctcaggacccgtctactgcatgtggattgccatccgcctcacactgagcgtgcgacgactcataactcttgacaagaatgccagtgtgcatgcctgatgcacctcgatttcagacagtggcacctgactcattatggagctgaaattgaacagaagaagagagatgctgcagctgaccagaatgatgctgctgatggacaagaggctgaggttgatgctgctgccactgttgtagcagagaagagcaaccatggccagatgcagcttgagatgcgccggctgggacgtacactggactcgcacattgaagagcagctcactggtggaaggctgctagcctgcatctctgatcgccctggacagcgaagaag

SEQ ID NO: 74205 - DNA, 617 bp, Triticum aestivum
  Clone ID: PAT_TA_74205
cttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtagcggaagctacagcggcggcggcggtggctacagcggccagggcggtggcggctacggccagggcggtggtgggctactgcggccagcgcgggggcggcggctacagcggcggaggcggcgggtacggtggcttgcgtggtggctacggtgggcagcattggggcggtgacttccgtcggccgtgtagaaactgagtcgtgggct

SEQ ID NO: 74206 - DNA, 555 bp, Triticum aestivum
  unsure (1)..(555): unsure at all n locations
  Clone ID: PAT_TA_74206
tttcgttgtccttccccgtcccattccctccgctccccactccgcagcagttccgcaccgacgccctcgccctcaccctccccaaagccctaaccgctcgcccgctccgccgccatgaggtccaaggccaacggagacaccgcgttcaaggcctccggcaagaacaagacggccaccggcggcgtcgccaagccgaagcgcgcccccacccccttcttcgccttcctggctgagttcaggccacagtacatggagaagcaccccgaggcaaagggcgtcgcggccgtcaccaaggcggctggggagaagtggcgcagcatgtcggatgaggagaaggcaaagtatggcggcaagaaggcagatgccccagcaagcaaggcggtgaacaagaaggagagcactagctccaagaaggccaagactgacgctgacgaagaaggttctgacgttgaggatgatggcgaggaggacgaggagtaaatagtagatgagggaacagcagtggtgcaaatcagcgtttgctgcttatggtttagcttgccatgtcgatgtccn

SEQ ID NO: 74207 - DNA, 555 bp, Triticum aestivum
  Clone ID: PAT_TA_74207
cgaactttggctaactttaatcaaccatgaagaaattcctcggccttgccctcattgttgtcgcggcgaccaccacggacgccgaaccctttactgcattccgtactgcttgggagccgcaccatccatcatctccagagcagcaaccaactccacagacacaagaacaaccagttccacatcaaaagttgaacccatgcagggatgccctcctacaacagtgtagcccaaatgctgatatgtcgttcctccggtcacaggtggtgcaacatatcagctgcttggtaatgtgggagcagtgttgtcagccactaaaagcgatccccaagcagtcaaaatgtgaagccatccacaacgtcgtgcacaccattagtttgcaacagcaacaacaattggtacaagggatttgcacccaacctcagcaacaacaacaacaaggtcaaccacaacaaggtcaggggtatagccagccacaacaacaaacacaaccggatcagggttggaatgcagtgatagggacaggggtgaattagaccaattccgcaatgtgcaacc

SEQ ID NO: 74208 - DNA, 215 bp, Triticum aestivum
  Clone ID: PAT_TA_74208
cgaattaaaaggaagataagaaataaggtgtacgaaacgcaatacggtatttaataagaatatagagaatttgttcgtaatgggttagataatgttaagttaggagaaatgaagaacggtaaaatctgcaatgaattaaaggatagtaatttattagattatatatgttagacatataatttgaaggatgtcttaagataaactaatgcataatt

SEQ ID NO: 74209 - DNA, 695 bp, Triticum aestivum
  unsure (1)..(695): unsure at all n locations
  Clone ID: PAT_TA_74209
cccatccccgccgccgcctccgctcggttccttctccttcctccgagcttcagccatgggcaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgacgcccctggtcaccgtgacttcatcaagaacatgattactggtacctcccaggctgattgtgctgtgctcaataatggacttaccactggtggttttgaggctggtatctccaaggatggccagacccgtgagcacgccctccttgctttcactcttggagtgaagcagatgatctgctgctgcaacaagatggacgccaccactcccaagtactcaaaagcccgttacgaggaaaattgtcaagganagtctcatccgtaccctgaagaagggttggctaccaaccctgaaaaaggttcccttttgttcccaatctctggggtttgaggggtgacaaccatgattgaaaaggtccaaccaaccttgn

SEQ ID NO: 74210 - DNA, 730 bp, Triticum aestivum
  Clone ID: PAT_TA_74210
ctggtggagacgggagccgagcgtggaggcggatcggggaggaggaaggcggcagcgggcagatccggcggggcgcggcgtggctcgcgagaaggttggtgggaggttggtggaggaggaaggaaggggatggagcggaaggcggtggtggtgttctccctcctctacttcctcggcgtactcttcgccgcgctcggcttctccgaacggggcacacgctgacaaagttctagatgttcaaaccaacctcttttccatgtgaatgcattatactccacgaagccctgcattatgccttgggttgatgtactagtagttcgctcctcatcgtcgtacctgcgcttataattaaataacagttgtttggtagaatacggttgtgtaaaaagagcaatactcggttgccttttgtgtaccccttatacctatgcaagtggtcgatcctactgtgacttattcctatttctattctgcgttatccgactgtggggactaaatcactttaactaaacatttatccacctcttcagcaattatttaaccccgttgagatcaattcactggacacaattacattggcgagaattttactcagtatatgactcgtagatctcgaagtacattccgttgtatatccttctcctctgatatatcacatgatctgtattgttgtcgtattctattacgagtactatttataagcctgcgcattaatacccgttgtgtagtt

SEQ ID NO: 74211 - DNA, 723 bp, Triticum aestivum
  Clone ID: PAT_TA_74211
aaatttttcaacaataaaaaacaaacaagaagaatacaacacaaatccaccatgaagaccttactgatacaaacaatactagcgaaggcaacaactgaagccaccgcgaatatgcagggcgatccaaacggccaagtacaaaggtcaaaaaaaaccaaccaactcaagaaaaacaccaacaaagcgattctaaccaacaagagcaccaaacacgacattttggccccaaactcccaaacaaaaccatgtgaccaccgatgcatacacacgagacagaacaagtgttaccgccaaggcacgcccaagggaggcccaaatcaatcaataacaaatttacctccgacagagactgcaaaagcaaacccaactacaccaaacaaaaatgtttatcccacagaacccgccaaaacgaagtagcgccgaaaattacaaaatatggtcgccgaaagacaaacccaaccaaacaaaccaagtgatacaccacaaaccatttaaactacagcccaaaaacaaaaacaaatggcgcctcactgcgaacaaataacccaacaaacaaaacgttttgaaccaaagacgccccaaaaaacccggaaacaaataaattgcgcgccaaaaaacaaagcaaacggtgggaatcaagccaataatgtaacaaaaaacaagattgaaaaccgtgacaaaaaaaggaaacaattacagacaaagaacaacagtggggaaatg

SEQ ID NO: 74212 - DNA, 931 bp, Triticum aestivum
  unsure (1)..(931): unsure at all n locations
  Clone ID: PAT_TA_74212
tggggaggattttataaaactccctacccccctatccctaccacatcttccaagcattgcgaccttctagttatctcttcgtccatctattatccttaatatcccatcccttttcactcacgtacccctctattatcataaatgttaggacgaacatttacccatataaaaaataccgaagaaacgtgacgattacaacattcatcacctaaggcatcgatcagcacagaatttattctgccctttacatttgtagtcttgacacaccctgtaacccacattatcgnctgtaatgaacctacttatcagattatttcagtactctaactacttataaataaccctatatgatagaccatatgcacctcttaattttccaaaactcttagataacctctcttatctttcactatatcgaaactaaccgtagtgtgtattatatacgtacctcctctcttaaaatgccattgacttcctgacatcacatagctcttctctcatctagaaatccttctacactacataatagagagagtggatacccaatctctaaagagatggatctttcttctactcactcaacctatatagatatggtactgacttctacctcaataaaactaagactcatcttcctgttcactgttcgcctgtcgctcataaaagtcttctacttccctcatgcagatcacagatggtatgcacttaacgtagacgcccctctaaactatcaattctcccatcttacaactaccatctgatatcatattgcgtctctatcaaatatatgaggctctatattgctctacgtaagataaatattcctctatctattcgactaatcttatactttagtgataatccgatatgaatgagcattattctcactagtccacctctaatttgacagtgttacatttactaattttct

SEQ ID NO: 74213 - DNA, 541 bp, Triticum aestivum
  unsure (1)..(541): unsure at all n locations
  Clone ID: PAT_TA_74213
gttgaccacaagagtccctcagagaaaaaaagagttgacaaccagagaccggtggccaggctttgcagatggagaggattgacggagcagggctgggtgcgcgtgggtctgcgggggcgatgctgggcatggagatgcatctcgtccaccagccgcagccgcagatgcacgcggcctcctcgttccagcagccgccggagcacctccaccacggcaacggcggcgacggcggcttccaggtccagcaccaccaggccatgccggtgaggcagcagcacccacagccaccgtacgcggcttacgtggcgccgccgtcgagggtggtcaaggcgcatgaagaggaggagatgggcaacggcgtcgggaatggcggcggcgtnctgcancanccggnggcggnggcggcggngtgcccgtggtcccggatgaagtggacggacgcgatggtgcgtctgctcatcgctgtggtatacaacgccggggacgacggcgagggcgtgtctgcaggaggcaaggcggcggcgtcgcactcgcacgggan

SEQ ID NO: 74214 - DNA, 943 bp, Triticum aestivum
  unsure (1)..(943): unsure at all n locations
  Clone ID: PAT_TA_74214
gagaattataaatataaaattagaggattttacaggataaaagaatntaggggagaaggggtgattatataaaagaaaagtaaaataataaaagtatatagataaattgtgaaaattaggtgaataaatagaaaatatttatttaataaaatgaaaaaggaagaatggttaagatatatagaaaattgtgtatattgaaatgaaaggaaaaaagtatgaaataatatgaaatattaaatgataaatagagagagaaaataaggaaagtgatgatttaagaatataatggaatntattaaattaaaagatattaggtaaatattttgaaataaaggagagaagaaaataagagattgaaaaaatagagagaataatgtaaaagataaaaaaaagtgatgtaagaggaaaaataaatgntaataattaatgaaaaaagtgggaaataaaaatattataatgaataaataaagtaggaataaaaattaaagaaatataatattagatgaaattggataagaaaagagagaattataaggaatgaatttaggaggtataaagagtaagaaatgttgtaaaaaaatagaaaaataaatgagaatatatagatataataatataagaaataaggaggagcatgataaaaagaaattgggataaaatatgaaaaataaggggaattaaaaatgaaatatatgacgattaattgattaaaaaaatatgagagaatatggggaataaaagtgaagaatattaatcgaaaaatattggtttaaaatggagatataaatatgatttattgggggtaaatgtaaagtataaaaagaaaaaaaatgaggtaaaaaaataaattactttttctaaaaaaaagcaaataaacacgaatatatcacatatataaaaataacaaagacgcaaataaaattgcgaaataacacagcataag

SEQ ID NO: 74215 - DNA, 727 bp, Triticum aestivum
  Clone ID: PAT_TA_74215
aatattttttaaaaaattattaaagagagaggaaattaggggggttatttgaaaaaagaaaagtaaaacaatacataatttaaaatataaaatatattgacaagaggcaagacaatggaagagaccacagtaacaataggacacggctctagctgctcatacccgagacgaagctgaaaataaataactgggaacgaacaaaccaggaaatcaccgaccgcaaactagatcgaacgctgcatcgagagaagtaacactataacaaactaacacacggacgatagagcataacaaaagagagacaaaaacacgttctagacgttcaaacaaaccgaataacaatcgcaggaaggctggtacgaacgaaaatcatagattataccgaaaatcaaaagaagcaagagagtgacgcaacactacaacgagaacacacataactgtgacacgaacttgacccttacttctgcacacacggagggaaggatcgacgactgcttcctagagacaacaacaccacttgtaaactatacgacgaggccgatacacactgcaaccggaacttaacaagacgaaatgcaccaaaaaacgaagatgccctaaaacggtgtacttacttgcaccgattcaagaaaaagaaacacttaaaagctcttggattcacaacataacaagtaacagaacacagcaccttgtcgtgacaggaccaagacttgccagacgacatgag

SEQ ID NO: 74216 - DNA, 556 bp, Triticum aestivum
  Clone ID: PAT_TA_74216
ccgaggtggcaacctacagagccgatcacacacgctctcctcgccgccaagatgttcgggttcgggcaccaccacaaggaccaggcgccggcggcgtcgggccccaaccagatcttcaagatctactgccgggcctcggaggactactgcctcgccgtccgcgacggcgaggtggtgctcgcccccgtcaaccccaaggacgagacccagcactggctcaaggacatgcgcttcagcaccaccgtcaaggacgaggagggcatgccggccttggcgctcgtcaacaaagacaccggtctcgacgtcaagcactccatcggacaggcccaccccgtgaagctggtgcccgtcaacccggcgtacgaagacgccttggtgctgtggacggagagcaatgacgtgggccagggcttccgctgaatccgtatggtcaacaacacccgcctccacttttacgcccttaacggcgacaaggaccacggaggcgtgcacgaagggacccaccgtccgtgcttttgggagttggtgcaaaggggggacaaccaagtgctggaag

SEQ ID NO: 74217 - DNA, 875 bp, Triticum aestivum
  unsure (1)..(875): unsure at all n locations
  Clone ID: PAT_TA_74217
ggaaatccaccacagaacaacagacacgccaaacacccaacacacccacaaagnccacaaaagaagaaagcacaaccacggaagagacggaaacccccacacccagaaccgccacaaccgcgacaccgacaaaaacaaccaccaagaacccgcaaacaccaccaacacacccgagacgccaaaaacaacagccgaccgagaaacaaggaagaaccagaaaaagcggaaaaaacacacaacccggcgagcaaaggcaggacacaagccgcccaacgcccaaaagaaggcaaaaaagcaacaggccaaaacgaacgccacgcaaancacaacggcgacaacaancaacacganancagaaacacagaggaccaccaacgaaaccccacacccgaacacaccacaaccgngaacaacgcgaggaacagcacccacgaccagncgcaacacacagaacaaaagcgacgacagacagcaaacaccaagacagcagcaccacacacgcacacacacacaagggacggcaaaacaaccagcaagcaganacacgccgcacacaacaggagccggaacgaaccagacaccacagaacncacacgcccaccagcaggcacgaacaacaagacaagacggaccagacacacacaacgaggcgaaccgcgcaacacaaaaaaccaaaaaaacgaggccgaacaccncaacagaacaacaccgaaaaaacagcaaaaagacgcacaagaacaagagagaaccacccacggacacgaggaaaaaaagcacaacgacgacacaacagaaaacacaaccgcaaagcaaaaaaagaaccccgagcaaacaaggcaaagaaaccccaaacaaaaaaaaaaaaagagaacccc

SEQ ID NO: 74218 - DNA, 581 bp, Triticum aestivum
  unsure (1)..(581): unsure at all n locations
  Clone ID: PAT_TA_74218
gcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggccgtttcagctgctgcccctgctgctggaggtgctgctgcccctgcagctgagtcaaagaaagaagagaaagtcgtggagaaagaagagagtgatgatgacatgggcttcagtctgttcgactaagttggggggcaccttgtgtctgaaagtatctatcctttggccaggaaacctagagggcaaggatggttttagccctttattttaacctgaagttggggaaacacctgggcaaggaccaaaggttttggatattggtaaattcaaacccccttggnttggttgggttggattttt

SEQ ID NO: 74219 - DNA, 718 bp, Triticum aestivum
  Clone ID: PAT_TA_74219
gcacaacaaccatatctgcaggtgccaccattagcgcagacgtaactaccatatacgcagacgcaacttccatattcgcagacggaactaccatatgcgcagccagaacgcttgagaccacaacaaccatattcacaatcgctaccacagtgttaccaaccaccacaaccaattgcgcagcagcagcagtatacaacaacaacaacttcgaaaacgactaccactacagccatgcccccagcctctacaacgccaacaaccatttccgcactcactggagccacaagaacctttttcgcagacccaacaaccggaacaattgattccccagcaccaacaaccgttgtttcagccgtatatacaacagcagatgaacactggcacgattaccttttacggagccgaaacctggggttttggggaaagcggtgaatgaaagaaaaggccaccaatgattgcccaaagatgcatctttatagccctcagcagctaccacagatgtcctccccaggttcaatgtgcaccgcatttataaacgcaatgcatttcgatcattgtggcaagaagaaccaaaattcaggggcttacaagatccctccgggcaatggattggagctcgctccattgtgcggggcaaaaattcaaccctcatcaacgagatccaatttgatgtgaacagggccattggggaattaagaaaacctttccaaacttgagc

SEQ ID NO: 74220 - DNA, 806 bp, Triticum aestivum
  unsure (1)..(806): unsure at all n locations
  Clone ID: PAT_TA_74220
cacgcgggggaacagggaaacacggatgcccaactggagaggggaaaccaggatcacgagccaccccgggtagcaccgggaaacagaacggagcgctacccaccggagatgaagctgctatcggtgggcgacccgagaccggtgttattccgccgggagtggggccgcacctggcccttgatcagcgggttcgacgtcacgggggccctcatcaccaagaagaccgccggcttcaccgaggaggacctcaagaactccaagatcggccaggcgcgcaaaaaggaacatcaccgacccgcccaggccgcgccagaaaccaggatcaaaacggggcttaccaaagtggaacaaacaaccgaacggagtgtgtccacttgagaaccgaacgaaacaccacagtggcctacagccccatacagagtaacattgcgagaaatgtgagaccacccccaaacaggaccttagcgccgtctgtttaataaaaccccaacactggccatgtggcagatctatccggcgtggggggcaccaggggtatgcggaaaaaagggccaaataaaaggccgcaacacggtattcgaaacgaaaacggccgtggtaaattcccaaaggcaataacataacaatagcggcacctcgagtggtttgaaaacaaagagagaaccgtagccccaaggagaggggagacctgccgggccttacctgtgcaaactcgagggaaactgaatgcggccaagaggttggggaaataccgnttnaccaccaaaaaacctcaagagttaccctccggggggggggggggaaan

SEQ ID NO: 74221 - DNA, 723 bp, Triticum aestivum
  unsure (1)..(723): unsure at all n locations
  Clone ID: PAT_TA_74221
atcccaggcaaacttttctctcgccctcgaagcagcagccgccgcagcatccatggcacccaaggccgccgagaagaagccggtggagaagacccccgcgggcaagaagcccaaggcggagaagaaggtgccggcgtccaaggagggcggcgacaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctcgcgaggtacaacaagaagcccaccatcacgtcccgcgagatccagacctccgtccgcctcgttctccccggcgagctcgccaagcatgtccgtctccgaggggcaccaagggccggcaaccaagttcaacctcgtccctaaggcttcctcgtggcgtttgaagtccttgtnggttttctttttcttcctttccctccgtctggaagggaaacctcttgtangggtaagactggtgggtgtttttttctggacaagtggtcaatggttgttaaacaaatgggtgcctggcttgaaataaaaatagngtcattgtttgcctggctttggaaaaaaantatacctccnnnnaaacctccgaggggggggggccccgggtaccccaaatttcggcccctaat

SEQ ID NO: 74222 - DNA, 910 bp, Triticum aestivum
  Clone ID: PAT_TA_74222
gctgcaggaattcggcaccaggcccagtgtccttatcgccgccgccgccactgcaccgatgccgacgacgagatgggtcgcgtgatccgcgctcagcgtaagggtgcgggctacgtctttaagtcccacacccaccaccgcaagggccccgaccgggtcaagtcgctcgacttcggggagcgcaacgggtacctcaagggccgtgtcaccgatggtatccacgacccggggcgtggagcgccgctggacaaagtgaacttgcgtcacccggacaggtacaagcaccagaaggaagctctttcgtcaccgccgaaggtattgtatcacccggacatgttctgtttactggaggaacgcctgagaccactcctttttccggtgggtgaatacgtacttacacgcttcccagatctggttccattggaggggaatggccgttcacttctggctaacaggtaccaagtccaccccaacagttacgtgaggaacacacgccgagtgggtcttctttggcccaagggggcgaaatcaccggggttggaaactatacgcggccaataccgcttccatttataaggtccacacaaatatccgccccgaaacaaaaaacgggggtaacccttcgtaaaagggtaaatcaagaatgcctttccccctctatatatgggttggcccccaaggaaaaaggatatctgggtcccaacatgaccatagatttggccgcgtggccacactggaaaatttaactccagaggctatccaacttggttggggatagccctaggggaaacttgaaataaaagccaccaatgggctctctaagagggcgtggggggaaaaaagcctctgacactaacaaaagtgaacccggggggtggtaagagaagggttcatttctgtgtgggccccg

SEQ ID NO: 74223 - DNA, 607 bp, Triticum aestivum
  Clone ID: PAT_TA_74223
cctattctgaaactttaaataggctggacggcacggctgctccggcgagccgtgccacggaatcggcagctccaagggggccattgttggtaggcagaactggcgatgcgggacgaaccggaagccgggatacggtgccgaactgcgcgctaacgtagaacccacaaagggaggtggacgattaagactctacatcgcgagcggccgctctagaggatccaagcttacgtacgccggcatgcgacgtcatagcgcttctatagcgtaacctaaattcaatgcactggccgccggtttacaaccggccgactggaaaaacacgcccgcggaggacaggggcaacagggacggcgccgggcgcgggaggggcggccgcgtagcgggggcggtgccaggaccggcccgcggggggactccggcgacgcggacgccaaccgggggttcgagggcgggggcgggagcggctgctatccggcgccctgcctgggggacggtaggggaaccaggcgaaagggggcgcgggccgcgcccacccttaccgcggagggggcggccgccgcggggcttactcgaccggctgaaccgggcgatttgggctcccggcccg

SEQ ID NO: 74224 - DNA, 785 bp, Triticum aestivum
  Clone ID: PAT_TA_74224
gcaggccggcatggccacctccagcggcgaccagtcgtcgccccgcgcggcctccgacctcgccgtcccccccttctaccccgagatgatcgtggagggcatcgggtttctccaggagcctaacgggttccatctaggccgcatttcgcccccctatttaggcgtggccaccgggtccgtgagggaacccttctgatgtagataaccccccgcttttttgcccggccacctcttcccccaagtgagatgcggacccactagaatcgcatttccttctgactggtgggctatagtaaactgcttcttcccctagatccccttcttaaaatctcctcttcggtcggaggtgagggatgggaacaattggcaaaggcccggatttgtatgggcgaggtatatggaaagcgatcccaaacagaaaatatctcccttgtaccgtatcaagatattggtctgcccccctgagtttgagtatatgcctttttccccgattgccctcatctcgactctcttattcctcctatctctatattcgcatgccgtgtcctccctcttatgatatccgggtgatcaccctcgtaacaagtggagggcccgtcctccccgtcctagtgagcttacttttaacccaccgctggaggggtgggtttctcccggtccatattaatcgtggcattacatcttccttaaaccgtcccggatataagctcctctctccctttcctcgctttttcaccactctgtttctgtatctccgtgacgtgtgacaacacccaaatcacact

SEQ ID NO: 74225 - DNA, 608 bp, Triticum aestivum
  unsure (1)..(608): unsure at all n locations
  Clone ID: PAT_TA_74225
gtgggtaccagcgacggcgagagggaccggatgtcccggagcccctctccagatccttcccgactacccagccggcgcaccagcgagcctcgcgggaacacaacgccgccagcaacggtggcaccgaacacctcgctgtcgacaccgagccccctaccggcggcaggcgcacccgtgatggcgccaaacccggagcgtggcagctaccctttccggccttccgcggccgaaagcgaggcgccaagaatccccgagcatcggcggcatcaagcgggcctcctccgggaggcgaacatcctcgtcgtcggcgatgtcggcccagagcgggacgtgcggcacccaggccggaggagcagatggcagggaagccggagccattgtccacccggccaccacgatgtncatggncgcgcggaggcngagggaaccatcatgtcgccggtattcccttgctacgtcatccagattcaggctggggtcggataccctgaccgcgacgttgtttcggttcgtgttcgcgtgcgataggcagagcaggagactatccgtgtgagctaaaacacgtgtgggtcacgattttacttactagatagtgagagacacaatat

SEQ ID NO: 74226 - DNA, 607 bp, Triticum aestivum
  Clone ID: PAT_TA_74226
gacatttgcagatttttaaagatagagacagagagcgagagagcccgagaccgacagacagagagagaccgagacacacacatagagagagacagagagagagacagagagagtgagagagagagcctctctcccccccttccacaatacccacgcttcgcacggtgaatctacagatccagagcccttcttacagaaccagcccacccgccattgaaaactccgcgaggcaagaaccccacttccttgccgagctctttctcacgccccgtaacccggactctttcccctgtggcgaacctggcggttcggcccctctacctcagaaccccaaaccgctaacaacctccatggtcttccttgaagaaggccaagcagccctcttccatttacgagaaggcgagtgttccccctgattttaacccccaaccaaaaccctgtgatccaccctcccccgggcccctaaaatgaacctagaaaatagcgcctcgcgcccaattgccttattacacgttgagaggccccacccttttctccaaaattgttggcaccacccttcctctttaacattcggagcccggcccctaaatactcttttacccttgtt

SEQ ID NO: 74227 - DNA, 698 bp, Triticum aestivum
  Clone ID: PAT_TA_74227
cacaactagagcacaagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacgaactattccccaaccccatcaaacattccaccatcaaccacaacaaacatttccccaaccccaacaaacatacccccatcaaccacaacaacaatttccccagacccaacaaccacaacaaccatttccccagccccaacaaacattcccccaacaaccccaactaccatttgcccaacaaccccaacaaccaattcccccagccttaacaaaccccaacaaccatttccccagtcacaacaaccacaacaaccttttccccagccccaacaacaatttccgcagccccaacaaccacaacaatcattgccccaacaacaacaaccggcgattcagtcatttctacaacaacagatgaacccctgcaagaattttctcttgcagcaatgcaaccatgtgtcattggtgtcatctctcgtgtaataattttgccacgaagtgattgcacgtgatgcagaacaatgttccaacaactgcacaaattctcaacact

SEQ ID NO: 74228 - DNA, 549 bp, Triticum aestivum
  Clone ID: PAT_TA_74228
gttcctcgttccgcctcgccgctgcactgcttctgtctccgttccgtacttgccatcgccgctccccgttgctcgccatcgccatcgccttgcttgttgcctgcttgccgcgtcgctttttttgagggatcatggctcctctcgctgctgctgttgcgtttggttaggggtgcctgcggctgcttagtcgtgcgtccgtgcggctgtttcttccttctttccgaggtggttgttggttgagtgtgagcattgtagtccttcatcgatctctgatcttgttcgtcaatgaattctgcgcctgtcaccatcgccattcgcctagaaatcgcactaatcagttcgtcgtcagatttgccttgctgtttcatctgctgaaaggatcatctttctcttcagagattctgagagagaatgttatgtgccgaggctgagtcgcggacggcggcgggatgcgatctggcggcgcggcgaccggatgtggtctggaaaatcggtggggcgtcgccgtgccgtgctggtggtggtgttgtcgatgtggggatggcgctc

SEQ ID NO: 74229 - DNA, 619 bp, Triticum aestivum
  unsure (1)..(619): unsure at all n locations
  Clone ID: PAT_TA_74229
caaatcctcgccgccgcaccacctcggagaaagagaagccccggccgccgccgccgccgagagaagccatggccaccacccggcccatcgccagcgcggaggcctcgccggcatcccaggcgaagcgccgcggccggccgcccaaggccccgctggcggccgaggtcgaggcgccgaggaccccgtcgcccatgtccccgctgacggccgcggcggaaggctacgagcgggagcgggaggcgaggatcaaggagaacatggagcggatgcagaagctcggcctcgtcgacctcgccacctgcttcaaccagtccgccacccccgccggcgccggcaccggcaccggtcgcggccgctggcgacggaggccggagacgccgggctcccccgccgncgccggtcccaggatcaggggaccgcctnncccgatggccggccgcgcccgggtcggctcaggggttgaaagaagcgtggggagcccaagtntaggaatattggttggaaaaattttggcggaaaaaaggaangggaggaaaagggggtcctttgaatggggtggggaaaagggcccctttttcctcctaatttgggaaggaaaaaggggntggccaaaagggga

SEQ ID NO: 74230 - DNA, 623 bp, Triticum aestivum
  Clone ID: PAT_TA_74230
cgcaggctaattctcaccagcgtggccgccggcggagtgcagaacagatgggcgctccagctttccctgctcacccactacgtgcagactctgggactctcgcatgctctgactaaattcatgtggatgtgccgccctattgatggattagtggcacaaccatacgttgggctctacaatgacaagcgcacttgtagatggcgaagacacacaccgtctattgtgacaggatgcatacacatccgcatcgatgtcgtagtcatcgggtgctaggctgacattggagctgatctgggcgacagcaacgaagagagcaacctgtatcatgagcctctgtggcacgctataaatgaggatgaccccggatactgcctccttgacttgtccaacaacactgtgcaaggtgcagacagtgctcttatggctgatgataacctaacatagacccaccgcacatatcaatgtcatgtatcgatggcactcgaataacgcgcaactctgaggtcacaatatgccaaaggagtacgacctcgacaagactgtggaacctggcaatataagacattttgtgcacgtgtccagccttgggtgtaatgcactccccagctacgccatggtcgacg

SEQ ID NO: 74231 - DNA, 637 bp, Triticum aestivum
  Clone ID: PAT_TA_74231
ctctctctctctctctctctctctcttctttcgtcactccttaaaccttctgcgtcattgagttctgagggtgttgacaatgagatgactgagctatcagatgaggaggatgaatatgatcagctaccacctttccgtgttctaaaaagatctgaatatgaaaagttgaccaaagaacagagaactgcatatcttgatgaactggactaccgtgagacttcatacctcaaacagcagtggaaggagggaatccggagtcaaaagcttgctgaagctcaaaacagcgaagcatcatctgcagttgctgatgattatgaagagaccacatccccagttgtgcacatatcagatatggaaatcccattaagttttgactctgattatccagcacaccgctaccgtcacattataactaatgatcagttgtttagaccagttttggatccccaaggatgggaccatgatattgggttcgatggtatcaattttcaatcatgtcatgacttaaaaaagaacatatcaacatctattgctggacagatgaggaaggacaaagaagacatgtatatccagtcggattgttcagtaagctatagtgatcaaaggcgctactcattgatggggggcatggatatgc

SEQ ID NO: 74232 - DNA, 549 bp, Triticum aestivum
  Clone ID: PAT_TA_74232
gatgacttgcgtgggaactggactcaaacgtgcgctaatttgtcagttctcgatgctcctgaaacatggcctatgcgtggccactggggacagtacaccgatgtgctcatatataaccgtggctagatgggggcgctcaataagggtctccgtgatggcgagaatttcacccgcctcatccgccagagctcagatcggatgaattgctgtaaagaagacgataacggcggcgtcctgcgcgtggtacttttgtgtcgccccatagcacactatttccttaggggagtgaccaaccccgattgaacaatggaatatggcaaatatggcggagggcactgaagtgtggatctagcgggacgatctgtcctgtatgcagttgagggggaacaaggtaccgaagctctagttggtgctgacagatgcagcaccacacggtgctgactgtgccatgactggcggtgggatacatagtaaccattggcgagcgactgtagcagctggcaagcatgtcaatatagagtgctatccgatactgcgtacttcctaatt

SEQ ID NO: 74233 - DNA, 831 bp, Triticum aestivum
  Clone ID: PAT_TA_74233
cccaaatctcctcaacttccgggcgcatttccgacgacatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcatgtaccagaagagcaccgagctgctcatccgcaagctcccctttcagcgcctcgtccgcgagatcgcccaggacttcaagaccgacctccgctttcagtcctccgtcgtctccgccctgcaggaggccgccgaagcgtacttggtggagcttttcgatgacaccaacctctgtgccatacacgcccaaggcgttaccattatgcccaaggacattcaaacttatcccgcccgcatccgggggggaagaggggcctaaaggccggaattctggggcgccccgagaagtggtttaaagtcccactctttaaacctttggtcccagccctttggaaaatgtatgtgccgggccatacacgatttggtttcgctttccattccggggaatggttagagggtagctctggaatccttaatgggtcaaccttatcttgggcttgagctatccaaggaatcccggaaaaaggaaccaatatgtttgggcactatactggggtgcgttattaccaaaagctatattactgacgccttataccacacaagcaactcatcactgtgcgctataaatcctttcttgaggggggggggtccgccgctctctcccccataatatcgagccgtctatatcggatggc

SEQ ID NO: 74234 - DNA, 679 bp, Triticum aestivum
  Clone ID: PAT_TA_74234
gagagagagagagagagagagagagagagagagagagagagagagagagagagcgtcagagttattgagatgcttgcagtgggggttctcttgattgataactactagctgggcatgtttttttgactgatcaccgcttttgtcgctccatatgttgctttagtattatagtgcctatgtgtatctgggagaaaatatggcgctgatgattatatcttcatctcactgggatgatggtagagagagaacattgtaacttctggtggggctctgatcttaattctccctgttattgtgcggcttttcacatcgctgttcggcttgatataacgatttgtatgggagaaagctgaggtggctttatgttatatgtgttgtaaaggaatctccgttttttttcagttgggtttttataagcaaaatttggcccccgggcccaaaagggttgtattttttcagaaaaagtatgtgtttcggaaatggggaattttatcgaattttttgtgcggggtatcccttatgaaaaggggttcaaaattatttttttatgtttattaaaaaaattgtggggcggggtgtaaaaaaaatattattggtgtaggaatatattaaagagtatctggttattttttttttctttttcccttctctttttgtggagatatttggacacttattt

SEQ ID NO: 74235 - DNA, 682 bp, Triticum aestivum
  unsure (1)..(682): unsure at all n locations
  Clone ID: PAT_TA_74235
gtgagctcggtcttgacatccaagaagcacacgcattttcaacaatcgatggctactcactcgatgtattcgttgtcactggttggcgtcttgtgggtactaaacagctgcaagaaaagataatggagaaatttcgcagtgttgaggcacaagcttgtacagtatcaagcgcatcatcaccttcattggaaggcctgcaaggtggagagagtaggcccacatctaccagtgttcaaataccatcggatggagcagatgtttgggaaatagacctgaagctgctcaagtttgggaacaagattgcatctggatcaaatggtgacctataccgtggatcatactgcatccaggatgtggccattaaagtagtgagacctgagcgcatcagtgcagatatgtaccgagattttgcgcaggaagtgtacattatgagaaaggtcgtcacaggaatgttgtgcagtttatcggtgcctgtacaagacagcccaacttatatattataacagacttcatgtcaggagggagtgtatacgattacctccataaaaaggggtagttcttcaagctcccagaaattctaagagtggcaacagacatctctaaaggaatgagctacctgcatcagaacaacataattcaccgagatctcaagactgcaaaatttctcatggatgaaaaacan

SEQ ID NO: 74236 - DNA, 663 bp, Triticum aestivum
  unsure (1)..(663): unsure at all n locations
  Clone ID: PAT_TA_74236
gaacggcgaagcttcgccggccgccatgtcgccgccgtcgctctgcgccgcccctccccgcgccggcccgaccccgccccccctcctgcgcctccgccgccgcgcggcctcctccgtctccgcgtcgcgcgcggcggccccgtccgtctccgacgacctggtcctccgcatcgccgagcagctggaggacgcggcgccgtcctcgccgctgctcgacccgctccgctccgcctccgcgctctccctcctcaccacgccctggcccacccgccgctccaacgaggccttccgcttcaccgacatctcctacctccgctccctccccatctcgacgcccacccggacccccggcctcgcgccgccaccgccctcctccgacctggaatcgcacgtcctcttctccgacggccgcctcgtcgccgcctccggcgcccacgtctccgccctcgcggacatgcccccccggccacgccccgggaccgggcgngccgcccgccgtcgcccgnctcccgcgcgggttcttcccacccgggacattcttctacgaacttcaacgcccgttcggcgcgaagcgaccgtcgcccgtgggtgtacggtgcccgagtggggccaaggatggcccgacgacccccgtccacatcatgttcgccctacagcggcagg

SEQ ID NO: 74237 - DNA, 697 bp, Triticum aestivum
  unsure (1)..(697): unsure at all n locations
  Clone ID: PAT_TA_74237
gcgccccctgctttcaccgccaccgccgccgcgccccctgcttccaccggccgccaccgccgccgctccccctgcttccaccctccgccgccagcccagctttcttccgctcaaggaccaagaacgacgtgagatgtcgtcctggcccatcgttgtggccctgcgccctaaccaccgctgtcggccaacacggtggccctgcttctcgcaatgtcgcatcgtgctctcaccgcgccatgtgtggcctcctcccggcgaagcgccctcgccaacaacacacgtcacgccccagtccagctctccggtgccagcccatccaccttcgcgaccccaggccgtttagcactgccagcagagcctgttcaacaccccagctctcacgccccccatctgtggtgcaactttttttttgtgccacctgctgccggtcgaagctctagagtcactacatcgacgcacgcatctgctgcagtgggggctcagttgctgctccaaaatcgaacaatntggaggaagaatgcatgagaaacaagtctcccaacgatgacaaggacccgacccaaccagcttcgccatggcatggcgcctactggcgaatgaccaccaactncctgacgacgtgcccaaacccgtcgacgagggccgacgncccaaccctcgtcttnttctcgcatcgggatgagcaagatccagccgg

SEQ ID NO: 74238 - DNA, 550 bp, Triticum aestivum
  Clone ID: PAT_TA_74238
ccactctcaaatcttcttgccatggcaacttctctgtcgccaaccgtcgtggtgatggctctgttgctggccacgttgatcgccctctccttggcgcacaaggagcaccagcacgcgccaactcaagcaccgagccccgctcaccatcatggccatcttgccccggcgccaagccattatcaccatcacgggccagtgtcgacgcctgctcccgcccgcgggggacaccaccaacatcaccatgctccggcccactcgccgggccaccaccatcatcaccatgctccggcccactcaccgggtcaccaccatcatcaccaagctccgtctccatcaccaatccaccaccatcatcaccacagtcccgcaccgtcgccaatccatcaccatcatcaccatgctccggcaccatcgccagtccaccaccatcgtcaccacgttccagcgccgtccccggtccacctcgacgccaaggagctggacacttagagttatacgatctcctatgtatatcttcatcttatttcccctggggaagtgtttaataaat

SEQ ID NO: 74239 - DNA, 836 bp, Triticum aestivum
  unsure (1)..(836): unsure at all n locations
  Clone ID: PAT_TA_74239
ccgtctcgtagctgctcagatggcgatcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtcttcgcggtgactccatcgtgctcatgggcaagaacaccctcatccgccgctgcatcaaggtgcactcggagaagaccggcaacaaggacttccttgagctcagcaacctcctcgtcggtaacgttggcctcatcttcaccaagggtgacctcaaggaggttcgcgaggaggtcgccaagtacaaggttggtgctcctgctcgtgttgggctagttgcacctgttgatgtggtggggttcccctgggaaaaactggtctggattccctcccaaaacgttccttctttccagggtgccttaaactatttccccacccaaagatttaaccaaggggttacctggtgggaaaaattaacttattcccncaggtgggaagccttatatgcaaagtataaagggtggaacaaaggggntggggccntgcacttcttgaagatccttggccccttggcttttgccccaaagaccttggggttattcacggcacaccttttccttcaatattgggcacctgggggtcatntcttgccaaaatggtcctaatgnaacaaagtggggtgtcaatgtcctttcaagccccctggaagggtttcctttgacccttcaaccgagagaagagaccctgaatgtggacaagagtttgccattctggtgggtttcccatggtttgctttaa

SEQ ID NO: 74240 - DNA, 688 bp, Triticum aestivum
  unsure (1)..(688): unsure at all n locations
  Clone ID: PAT_TA_74240
cccccagccccaacaaccatgctcccaacaaccacaacaaatttttccccaaccccaacaaacattcccccatcaaccacaacaagcatttccccaaccccaacaaacattcccccatcaaccacaacaacaatttccccagccccagcaaccacaacaaccatttccccagcaaccacaacaacaatttccccagccccaacaaccacaacaaccatttccccagcaaccacaacaacaatttccccagccccaacaaccacaacaaccatttgcccagccccaacaaccccaactaccatttccgcaacaaccacaacaaccattcccccagcctcaacaaccccaacaaccattttcccagttacagcaaccacaacaacctttaccccaggcccaacaaccgaacaaacatttccccagcaacaacaaccattgattcagccatacctacaacaacagatgaacccctgcaagattacctcttgcagcaatgcacccctgtgtcattggggtcatccctcgtgtcaatgatcttgccacgaagtgattgcaggtgatgcggaacaatgttgccaacaactagcacaaaattcttagaagctcagtgcgagcattcatgcatcgngcatgcttatcttgcggcagacaacaacatcaccacaacacaacaacgactacacctcgg

SEQ ID NO: 74241 - DNA, 835 bp, Triticum aestivum
  unsure (1)..(835): unsure at all n locations
  Clone ID: PAT_TA_74241
cccggaccagcagcgcctgatctttgctggcaagcagctggaggacggccgcaccctcgccgactacaacatccagaaggagtccacccttcacctggtgctccgcctccgtggtggtatgcagattttcgtgaagaccctcaccggcaagaccatcacccttgaggttgagagctccgacaccatcgacaacgtcaaggccaagatccaagacaaggagggcattcccccggaccagcagcgcctgatcttcgctggcaagcagctggaggacggccgcacccttgcagactacaacattcagaaggagtccacccttcacctggtgctccgcctccgtggtggtatgcagattttcgtgaagaccctcaccggcaagaccatcacccttgaaggtgaaaagctccgacaccatcggacaacgtcaagggccaagatcccaggaacaaaggaggggcatttcccccggaaccaagacagcgccctggattcttttgcttgggcatagcaagnctgtgagtgtacgggcccggcaacccctttgcaagaacctaaccaaacaatttcagagaaaggaaaggtcccaacnccttttccaaccttgggggggcctcncagnntcttcccgtgggggtggggtccaaggtaaatatgggccttcttgggccggttttggaacccttgcttggggttttaattcaccttggttcgcgtaccggggtgggggtggggttgcccccctggttcggtttcaattttggaaactgtntttcttccggttccgtgggtcaaggtcccttacatgggggttggggtttaaaatggaaacctattc

SEQ ID NO: 74242 - DNA, 851 bp, Triticum aestivum
  Clone ID: PAT_TA_74242
gagagagagagagagagagagagagatgtgtgagagagagagagagagagagagagagagagagagagagagagagagagagagagagagagagagagagagaatagaactcatcctctcacatgtttccatacaattcatgtaatccttcacaaggtacgcccttgggtctgtgcgcgaaggtctgagtggacctgctgctggtgctagtcggcacggtggaacatgggggatcggtgcagggggctcttgcgagggattgcaagattgattgtcacaagttgcatggggcgtgcattagcaaacctattgcgagaacgggtgtcagactgagggatttacccgcgttaagagtgatagggtttaatgactctgtcgttaaggatgtgttgccatggcttagatttggcccaggcttagggttggcttttgcgcgaacctcatagtggagtagtagttcctcttgcgaataatttatggttgacgcaccattgggtgatgaattcgcattcagtaattatctgcaatggccggggctcattggacggatggcgtttgggatcctcgaacgatagattgtgctgatattgcgtgaggtggaactattaggcgtgtgaatattggacatttataatggaggtaatagtgtgtgatgtgttcctctacataaaatatatctcgcttggattaatatatgtaagtctattgtgggatgatcgatatcctttatattcattaataaatataatgggagtaagcttcgtgatcgtgttaatctagagatgggtgtgtctcttttgtgtggggaggtgacccgcgtaaccaatatgagcgtttttttaataaatatg

SEQ ID NO: 74243 - DNA, 819 bp, Triticum aestivum
  unsure (1)..(819): unsure at all n locations
  Clone ID: PAT_TA_74243
ctccactccacttcccccctcccacctcaccctcgcctcgcctttttagagagagaaacacgagctccccaccccgacccccatcgttgcagcaggacagagaaatccacgaccagacctttcctcaactctgacggcttccccgacgatgacatggtcgaggcccacgtcgttcaggggagccgacaactactccttggacgtgtcggcctagccctacggggtcgcacccgaatccgccgacgggcaccccttcggcgtgcccccacttaacacggccaaggccgttgggaggccgaacccacaaggggtgacgtgccttcctggcacacgacctcccggcgcccggaaggctccccaagagccctctcaccccaggaagggtaaggccaccgggacttagggggctccccccattaccttgncctatggaaaggaattgtatccctcgctcatcatctaagtgcgtcataatatttctctcaatcccttgagtgagtggaataatacaaatggtatctcatatccccttctcacgtatgactatatgcatgcccccttcgaattgcgtagagtgttctctctattaaaaaatctagaccctactcgtatagtcccttctgtatatgtgaacgtgtgttctacatgaggataaatataggagtgtcgctttgcgagtgggtgttgaagatagactgcgcctacttatgttccgtgagacacattcctgcatctatatcaaacgtcgtaagagtggagtggctagctaacgttcgtcggcgtaatatcgcgcctagtaaaaaactcattatcatccct

SEQ ID NO: 74244 - DNA, 652 bp, Triticum aestivum
  Clone ID: PAT_TA_74244
cactactggagcacaatcatcaaatacaaggatgttatagttgacataaatccaccatgaagaccttacttatcctgacaatcatcgtggaggcactcactacctccagcgccaatatacaggtggaccctagtgtccaagcacaatggccacaacaacaactactattgtcccagccccaacaagaagttgtcgcaacaacgacagcaaatttttgggcaacggcaacacacatttgccgatcgaccacatcaagcatgtccacaatccccacagacgttcccgtatcaaccgcaacagcgatttggattgccccagttaccacaacatctatttgcgcagcaaccactagagcaatttgccgagaccgacaactacaacaaccattttcacagggacgacgacaacaatgttcctagtgacataaaccacagcaaccattgtcccagccccatcaatccaactacaatttccgaaagaacctcaaatggcattccccgaaaattaacagccgtaacaccatttgcccatgttgcaggaacctcatcgacctttttcgcgagccccaaacaattgcaacatacgataccctcagggacaatcaacaattggttttagccagtacctaccacaacagatggaacccgtgaag

SEQ ID NO: 74245 - DNA, 538 bp, Triticum aestivum
  unsure (1)..(538): unsure at all n locations
  Clone ID: PAT_TA_74245
gtaagaaggatcaccatgctgattgctcttctcgttgttttgctcgccttttcaggcccaatcaaaggagaagatgacttgggcggaggtgatggcggtgacttggcccctcctcctaatccagggggcagtcatttgtctcctccacctcctccatctccaaagagccatccacctccacctccaaagactgatttggctcctcctccacctcctccatctccaaagaccaatccacctccacctgcaccgatccagccgccaccaggaccctgtgcggaagtgaggtcgtacagagggccgtgcgtcaacatggtttgcgctgccgcttgtatcgcagagttgcatcanggcggccactgtcgtgggcatatttttactggtggttgctattgtttcgtgtgttcggtagcaaagtctggcccatcattacattgatgcggagcatgcagaatgtggttatatgttttcgattggttcgatcaaataataaaggatgtggagttttaaaaaaaaaanannaaaataaaaaaaaaaa

SEQ ID NO: 74246 - DNA, 275 bp, Triticum aestivum
  Clone ID: PAT_TA_74246
gacactaaacaatcgcagaatgcacggagaccacccgtcgtgactattgctggtgcacatcagacaaagccgaaacagtacctgggaggcccattcatagctgcggtgaccgtcagtgcaaacgcccattcgagatggatgccggttcatagaccagcgcgcgtccccccagcgcacgcatcaggcaactttcttcttcgctttaaaatccaattcccagaaaacctcgacctcgtatttggcatgcatttaaaaagtcccaaaatttagttatc

SEQ ID NO: 74247 - DNA, 621 bp, Triticum aestivum
  unsure (1)..(621): unsure at all n locations
  Clone ID: PAT_TA_74247
ggaatctagggttcggttccatcttaacccctcccagatgcctctcccaaatcaacagccggcggcggcggcggcggcggcgatcgagcacatctataagccggaggacacttcaaggttcgagccacggctcaaggttgtaaatcgggagaaatcggagcttctccataagatccgcgactcgtatgatcgtgcccgcgagcggctcgccaaggcgacggcattcaaagaggagatcttcctcggcgccggcctctcctttggccttctcgatccgaccaccaacatcatctacaacaccctcgtcgcctccaacctctgcgacgagaaaatccagggtgttcaggacgggaacatagccgagcgctccctggacggccttgtcgccttcctcaccttcttcttccgctacctcgcaaactgggaagccgtgcgctacctgctcctcgccgatgcggacctcgtctacgcgatgcgcctcgttgtgcatgaccggtgtatctctcccttcaacttgaactctgataccagcaagtccgacgtacgcactgccctcatgtgcgctgcgctggcctctaagcacatggatccccaccaccttgtncacacctggctgtcgcn

SEQ ID NO: 74248 - DNA, 632 bp, Triticum aestivum
  unsure (1)..(632): unsure at all n locations
  Clone ID: PAT_TA_74248
gcgacgtgggcaagctgaaccggctggtgatctcctaaacagcacgccgtgaatcacttgccgctgcagctcccggccgcgggcggcgagagcaagggcctgctcctgaacttcgaggacgccgccggcaaggtgtggcggttccgctactcgtactggaacagcagccagagctacttgctcagcaacggctggagccgcttcgtgaaggagaagggcctcggcgccggagacgtcgtcgggttctaccgcgcagccgccggcgaggacagcaagctctgcatagactgcaagcagcggccgagcaccaacagccctgcccccgcagaccccgtggaccagtcggcggtgcccgtgaagaaagccgtgagactcttcggcgtngaacttcttacagctccggatgtagacggagcaagggatgccggggtgcaatggggccagagacttggtgaagtcgccgnctccgacagcggggttcaagaagcaatgcatagagctggcgctagcgtagagttggaactattagctcgatcgatctcttctctccagctaggcggcggtttttgctcgcgtaattcaagtggtagagcttagcttaattagtcccttgttggactatcatcaacttg

SEQ ID NO: 74249 - DNA, 572 bp, Triticum aestivum
  Clone ID: PAT_TA_74249
ggccaacttcaccgccaactggtcgggccccaacgtctgcgcctacaacggcgtcttctgcgcgccgcacccggccgacggcggcgtggtcgtggtcgccgggatcgacctcaaccacgccgacctcgccgggtacatccccgactcgctccccgcggggctccccgacctggccctgctccacctcaactccaaccgcttctgcggcgtgctcccggacaccttcctccacctccgcctcctccacgagctcgacatcagcaacaaccgcttcgtcggcggcttcccggaggtcgtgctccagctgccctcgctccgctacctggacctcaggttcaacgagttcgagggcggcatcccgcccgcgctcttcgaccgcccgctcgacgccatcttcctcaactcgaatcgcctcacgcgccccatcccgcccaacctaggcaactcgccggcctctgtgctcgtgctcgcgcacaacaggctcggggggtgcatcccgccgtcgattgggaggatggccgagacgctcaacgaaatcgtgctcatcgacgacgacctcaccggctgcatcc

SEQ ID NO: 74250 - DNA, 469 bp, Triticum aestivum
  Clone ID: PAT_TA_74250
ggctaatataggcggaagatagcaacttactgagcaacaacgagcgtgaggtattccactagccatgacggccagccacgggatattaccactcaccattgtcgtccttgttctattatcgtcagacatccaaaatgtcagagcgttggtgagggaggaggctgacgttaccacagattacaaccattacacatgcaccaaggtcattggccgccgctgcaccatccgcacgtgtagggactcatgccataagaagctcagcggcgtcggtaactgccttgccgacggcgagtgtaggtgctcatattactgcaacacacccccttcttttatgaccaagtcggatgagacgctccattgaagggctagatgcagacaccgataaaattttgtgttatgacacatcttgttcatcaataaactacatgacttgatattgcaagcaactagtaccaatcaatttagcaat

SEQ ID NO: 74251 - DNA, 753 bp, Triticum aestivum
  unsure (1)..(753): unsure at all n locations
  Clone ID: PAT_TA_74251
gagagagagatagttagagacagagagatagagacatggagtgttagagagagccagagattgttattgacagaaaacgcacatcttctaattcacaccatacaaccattttggaaaagaaagcccttccccgatgaaaangaccaaaattcttttttttttctttgtgaccgggccctnaancacggcgccgtccacgagcacgaaatttccctcgcaacgatccatcgaaacgagggctcgctcccataaactcctgaaatcctggagcgatcatgacttgagcgcaccttccatggctgagaaatcccgctgctcgatgccatacatgtcaacggggggttggtacataccccgcacgttctccgagattttggaggcctgcgcctaatttttggcgactctattattgcccctgtacttatttaagggcggcccctgattggtgacaaaatccataagcgctttaatcgtaaatgcacgtttccatgtcctccggagcaaaaattttttaccgtgggaaaagttttccaggcatttgtcctttggaatcctagaccggagagcctttttctattgtgtgtaacccgccgtttgtggcccaccagacaccatttgataccgggtttctgccagagtttcattaggcgggtgttatagatatatattctcccgttagaaagcaaagagctccaattacgccccctcacagagatatttcggatcagtgggtcctccactaatatattgttn

SEQ ID NO: 74252 - DNA, 645 bp, Triticum aestivum
  Clone ID: PAT_TA_74252
caagcgacattttcaactaattcttctatcctcccctcaactctaccatcattatccaccaattacactttttactttatctatattaacatttattcttcctatccaccacaacctactttcactcctaccaattttactttcttaccaacgccttccagctccttcacctcccgccccctctcgcgaccagaagccaattgtattctccaaccctttacccattcctaccaccacaaacacattgtatttccctttccccatcattccttatcaccattaatatcttttcctccctccctcccttcactcttcttatattattgtatccaccatcaaacacaccctttatttaccatccatctctatttatcttcctcctctctcatcactatcctcccctctctttccaaatacattccaacctcctttctcaaaaataatactccctctcattttccccattccatattcctccaacttcattctcttttccctctacacatatattttcaccctcttcatactcaaatttctctctcaattaataatcccactcaacctcaatcttcacctttcatctccctctcaccttaaaatattctcactcctcccaacttgtcataattatcatcatttccccct

SEQ ID NO: 74253 - DNA, 477 bp, Triticum aestivum
  unsure (1)..(477): unsure at all n locations
  Clone ID: PAT_TA_74253
ccagctccctcgcctgaacggcagccaagggagacgcggggagagatcgagacgatgggcagcgtcggcggcggtggctcgccggagcaggaccagcccgtgtgcgtgacgggcgccaccggctacgtcggctcctggctcgtccgcaccctgctgcggcggggccgccgcgtccacgccacggccagggacccagccaaggcgtggcggatgctgtcggcgatggaggggaaggagcggctcacggtgttccgggcggacatggccgaggaagggagcttcgacgacgccctcgccggctgcgccgcgctcttccacgtcgccgcctccatggacctccacctatcgcccgaccagcacgacgccgaggagcgcgtgaggtcgcangtgctggagccggcgacgaggggcaccatcaacgtgctgcggtcatgcgtccgcgccgggaccgtccgccgggtcgtcttcacctcctcc

SEQ ID NO: 74254 - DNA, 617 bp, Triticum aestivum
  Clone ID: PAT_TA_74254
cacaaacataaacatcgaagcaagcttgtagccaaccaccatgaagaccatgttgatcctcgctctcattgccctcgcggcgactagcgtcgttgcgcagctggacactacatgcagccagggctatgggcaatgccaacagcagccacaacaacaggtgaacacatgcgctgctctcctgcagcagtgtagcccgacaccatatgtccagtcacaaatgtggcaggcaagcggttgccagttgatgcggcaacagtgctgccaaccgctggcccagatctcggagcaggctcggtgccatgccgtctgcggtgtggcccaggtcatcatgcggcagcagcaagggcaaagtttcggtcagcctcagcagcagcaagggcaaagttttggccagcctcaacagcaggttcccattgagataagaaggatggtgcttcagacccttccatcgatgtgcaacgtccctatggccactacctgtgttggtggtacctgctaagatctgtgatgcgctaactagaccgatcaccatttagtttaaatgatggatgaagggtgaaaaataaaattaaagtgccatacatcattatggtgggccaggacgttgcacatagaaa

SEQ ID NO: 74255 - DNA, 621 bp, Triticum aestivum
  Clone ID: PAT_TA_74255
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctacgtggtggacttg

SEQ ID NO: 74256 - DNA, 613 bp, Triticum aestivum
  unsure (1)..(613): unsure at all n locations
  Clone ID: PAT_TA_74256
aacgcatccgccgccgtcagtaaccccacccccacctgttactgcggcgccaccgccgaagggccggccggcgaagtcgtgctgcgccccgggatggcggcggcgggccggatccatcccccgacgcgcttccctccaccccgccccgtgcctccatatctcgccctactccgcccgcttccgttgtgccgccgccggtgggccggccgacgaggccgtgccttgccccgggttgttggcgccggctggatccgcccccaccgcacgccccccgaccccctggccccgtgtgcctgtgctgttgcacggacaccctcctcccagcgttgttgtactctcctggcggtcgtctccagcggccctcccccgagccgcggtgacgtctcacaagcggaggcgatgatactaccttgttagtggtagtcaggaagcccctcaaggcgggtgcttgctggcactgctctggccctgacgaccttggacccgtgtttctcggatgtccattgctgcangcgttgctgacggctccggctcgcgaccagtacttgatncttccagtcgttactcccacgtccacagcttggcacacggtggatatgcgtctcagctactt

SEQ ID NO: 74257 - DNA, 471 bp, Triticum aestivum
  unsure (1)..(471): unsure at all n locations
  Clone ID: PAT_TA_74257
ccactccaaccaccggcaaaaccctagcttcccgccggcgccggcgatggccagccggttctccaacgtcgacccggtgacggaggccgacatgcggcgccaaggcctcgacccgcacgagctggaccggagcacggagcagctcatgtcgctcatccacggcaacctcccggacccgcccgtcttcaccaccagccgcctcaccgncttncgcgcgcgccccttcgatggggtggacccgattaagcggctcttcgacgcgctcctncgcgacatcgtcttcccgcttcccggtaagggacgcggccggaccggcgggctcggcgggcgcttgggccgggtctggagctcgaaggcggtcggtcttattgacacttaactgatcttccgggggcggaaccctgggcgcggcaagacggcggaaggtaacgggggcggtttccggattattggcgggccacaaggggcctt

SEQ ID NO: 74258 - DNA, 664 bp, Triticum aestivum
  Clone ID: PAT_TA_74258
cttgtatccaacaagcttgagtttgctcaattcggagctcatttgcagaaattatggcagttctgtttttattggatccgtctgttgtctttagctgcgttttgaaggcatccaagtgctaaagcctctatggcgtgcggtagtactgctcaagggagtggtagtaccgcatgccagcggtagtaccgctcttggtgagcggtagtaccgttgcctctagcccagagcgctggcgcgcacggaagtaggcgcggaagtaattctttacttccgcgtcctacgcggtagtactgctcaccgctgcctcgcgtcctgacgctgtttcgtgcggaagaaggggcggatgtcattttttacatgcgcccctgcccgggagaacccgatacctgtgaaccggacataacagccccactttttactcgagctagcctacaaccgggaatatgggcgcgacagtcctaaaacttttgtcttggcctccaggtgctttccaaggggggggatgcccggttacgggttaatgctttttaaaccttagttggcaccctcaggagcaaacccaaggccaattgggttgatctacgaacatacctgggattttggaaccccgtttttcttggaggggttagcaagggaacaacttatttttacccctggttatttt

SEQ ID NO: 74259 - DNA, 571 bp, Triticum aestivum
  Clone ID: PAT_TA_74259
caccctccgggccctaaccctagaagaagacatccatctctccacccccggcgcgcgcccagctgctcggggcagcggcgatggggaggcggaaggagcgccgcctggcggacaaggcggactccggccgcagggtcaagctcgacctcttcctcgatccttcccccggggaggcatctatgaaagagggagttggagaggaaaaccgtgggcaggcaactggtgttcccacttcaccatcttcggcaggtgggttcaatcaatttccttccaacggatatgtgaagacggcacatgcctatggaacgtaaatttggtgggaatttggaatattctttaagcatagtgctgctccacatgtctgggttgaggcacatgtaggattcccggcctgcaaggaacattaagaaaattcttcagatcacgctgtcactggcaaaactgggcgtgtaacttccggtaattaaactttctgcagcatctgagcgccgggatcccacgatgattgttgcctactcgatataacgaaaatcctctagcattgcttgggcaatatagtgatgatgaagaa

SEQ ID NO: 74260 - DNA, 622 bp, Triticum aestivum
  Clone ID: PAT_TA_74260
acaccacagagctagcagtatcacacactaacaatggtgatgggaaagatgcccatcctcgttgccggagctctcgtgggcgcaacggcctggtgcaccacaagggagcctaacatgtgtacgccgatggcggaagttgcaccatctgctgtagatgacgccgtgacggctctcatacacgctttacggacactactgggctccgggcggcaactcgggagccactgatgtgtgccgtgctacagctggcctgctgggctgtggaggcgtacaacgtgcggcactggacaacggtgcccgccaactgaaacggatacgtagcccagtacatgctcgggaggcactatcgccgctattccaaggtctgctatagatgcatccatcagctaccttgatagactgaagctcgctggctactgcaatgatgtatgggtcttctacatcgacgagaccatgctctgcaacctatcttactacgccactcacgggttctgggccacgccatacaactcgacgagctacaacacgtatgtgctggaggcgagcgcgcctgcactaccggagacaaaacggttgtactacaagctgatcgcggtaggcatgaagccaacgttctgacaga

SEQ ID NO: 74261 - DNA, 482 bp, Triticum aestivum
  Clone ID: PAT_TA_74261
ggggaacaggggaaggatcactcttcggctgtgcccaaatatgagaaacacggcgacctaacccgagcttgctacccttgctcggggttcgaagaagcatctagaacaggtttactgccccgtctcactggatgcttgacaagcttggtggagcttttggccccaagccattatttggtcctcacaacgccagggagtgcctgcctctgcatctcatcctgaggaacagactgaaatatgctctaacctaccgtgaagggcaatgtatccttatacagcgtcctattatggttgatggataagtccgcactgactagacctacccttgatgcttcatggacatcattttcattcccaagactggtgagaactacaggcttcttttttacacccagggtcggttacgccttcactctgtcagggatgaagatgctaaggtcaaatctctgcaaaggtcactgctgtacaatttttgccctaag

SEQ ID NO: 74262 - DNA, 469 bp, Triticum aestivum
  Clone ID: PAT_TA_74262
aggatcttcccgccggctggcacatagcccgccacacgtccctagctgggaactacaagctgccgtgggacaatgactcatactggcgtgagccctgcaacaaccgcctggcgccggacataggtgcgtgcgaagctctctcgtaacaaactggtagtatcttcttcttccccgctctgctcctaactgacgctcagaatgacaaaggcttcaaaatgcctgatacaccaaatgtcttcccggctgacattaagagagcctaacttgcagataaaacataccatactccctcgcaccctgtcaagtgttacgaggaactgaactctgcacatacactgtcatcgcaatggcggacgatgaagataggcatgtctttaacataaatcgtggagatggttgaatcaagataagcgatgccaatgcgcgcctatctatgcatggagccatgtgatacacactcatgggcttc

SEQ ID NO: 74263 - DNA, 778 bp, Triticum aestivum
  unsure (1)..(778): unsure at all n locations
  Clone ID: PAT_TA_74263
aattcggggccaggacgaaggagctgtttgcaccgaagacctcgctggggacgactggactaggagtccaacgcctgatgcgcttggatgggatgcaatttcaagaactgccaatactggctggtaacagggcatgtgtggagaacccgcagaagcaccaactgctactgcaaactgggagtgaatgactagacccaaagtttatgctactcggcactgtggagtgaaggaattcggacgctgtttttgagtgaaggatgagtgttttggtcagtcactactttgttagtggacgctggttaagctgatttaaggtttacagtactgatttatcttagaagggaacatccagatttagactatgttcgttttttgcaggagattgaggagtgtatccgtccccaggccttggtgaaggggcctcttcattcgaaaaaacgctttaattttggaaggattccatatttttgccaaaactatgaggggatttgggcacagaatttttgtttttgaaaaacggtatatataaaacacaccgcggggttccttttttggaataacccgggaagggtgcttgactttacaccacaaggggatcttctttaatctctcaatatgagaggggccccccgtttcctccacaagtgtaagccgccataattagttgtggttagctatcttactcagtaaaacaatgcccccgtttgagttcttaaacaaactattccggaactatgatggaaaaatacccttggccgcttaaaccaccctttttatn

SEQ ID NO: 74264 - DNA, 820 bp, Triticum aestivum
  unsure (1)..(820): unsure at all n locations
  Clone ID: PAT_TA_74264
ctgccgcggcgcggacggcgcctgggagttctcctgggaccaggacagcctcctgcggcagctcaaggaaagcctgcgcgcgcaccagggccgcgcccacatggacttcgtctacatcggcggactgcgcgacgacatcccggcagaggaccaggacaaggtcgcgctcgagctctacgagcgctttcgctgcgtgcccgcgttcctgccggacgacctccgctcccgcttttaccacggcttctgcaagcagcagctgtggccactgttccattacatgctggcacttgtcgccgagctcggcgggccgcttcgaccgcgacctggggaaaggcctatcctgttcgtcaacacagatattcnttcgacaaagaacctgtgagggtgatcacacccccgagagagggacattcgttctgtgggtgcgccgaaattcacatattttatgtgtgncttgggcccacactttttctgttggcgcaaggaaaaattttcaaaacccgggtgtacaagggtcgtggggttttntcttttctcgttggcaacaagccccgggttctcccttaatataattgggggaagtcttcatcacaagaagacccctcttggcccgcggttttcaggaaaaaagagaagtggtgtcccttcgcgggggccgtctttgtttttgaaaatgccccccatctttgagatgttggggggtttaaccaacaacccattgaggaaattgaatgccccaaggccaatttttccccttcttccattggcctggncaanccaaggggaatgcccttgggggaaaatgggacaaataacggaa

SEQ ID NO: 74265 - DNA, 482 bp, Triticum aestivum
  Clone ID: PAT_TA_74265
agcaaacctcccatctccgtctagcgtcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctc

SEQ ID NO: 74266 - DNA, 473 bp, Triticum aestivum
  Clone ID: PAT_TA_74266
gagagagagagagagagagagagagagagagagagagagagagagagagagagagagagagagagagagagagagagagagagagagagagagagagagagagagagagagagagatagtgatccgggctgtgtctgtttgctctcgcgtgcggcgcgtctattctcgtacgcgcctgcgccccgaccgttctcgatgcctgccgcccgatccaccggtacactatcgcgccggagggatggcggattagatcaccgacgacgagatcggcgagttaaaggaggctttcaggctcttctacactgacgggtatggttgcatcatcaccaaggagttgggaacagtcatgtgttcgctggcgcaaaccccgacttatgctgagtttcaggacttgatcaattaactctgcgcttgtggttatggcaccattgactttccagaattgctgaacgttgtggctcggaagtttacag

SEQ ID NO: 74267 - DNA, 788 bp, Triticum aestivum
  Clone ID: PAT_TA_74267
aggagtagttcctatcatttaagccaagcacgccggggtcaataaatatccgccccggccacacactttaaatatgcgccccccactctcagggcgaccacccccacatgtgcggatagagcttcagcgccacaatcgctgtctcacaatccatctacacaacaaccacaaaagcaagttccattgatgcaacaacaacaacaatttacagggcagaaaaaacaatttccgccacaacagctcttatccaataaccacccatttccatcaaaacaaccatatctcgaactcataacacattttttcccacatttacctatttccggaaaccccacccctttttcccaccaccaacaccctctttatcccaacacccccggcaaccccaacagataattccgcgaaacctcactataccaaacccataatttttctcggaaatcgacatcaaaggcaacgaaaacaagaccaaagcgttttcaatatcgatacctcacgctggcgttttccgtgtacaacacgaaaaaatttttcttcgcaaaaaggaatccccctacccggtaatttccccattgtgccatacgggaaatgggtatactcaatttgccaaatattactctggagacccctattcctcttatgtcaaacgcaacaatcaaggtattttggcttcaaccaatgaaaatactctccctggaaacctttttttaaaaaatttcaaaaaactgtgttttagacacaaaatccaattttaaccccgctttggcggttcaacccgttttgaattt

SEQ ID NO: 74268 - DNA, 679 bp, Triticum aestivum
  Clone ID: PAT_TA_74268
caaaagcctaaaccctacctcccggcggcggcggctaccagcaccaccacacgaccagtaccatgaaggcgcccatgagaggaggaggaagccccggcggccgcatgggcttctggcaccgagagagccgcagaggctacgggcgcggtttcagcggcacgagccacagccgcggactcaacgtgcggcgcaccggcgggagggggttcggtcgccggagcgccatcctggcgcctctggcgggtcaggagatgcagccatcctggaacctgccttaatgagaggggcacctttgtcggcctgtcccactgtcgcgacagggagttaatgtctactatcagcgtgaacgcactatgtaccaataatatcattgatgatgacactgtttctgagcataccaagagaataagttcccaaagccgaccgatgcgatgactggctactggagaggataaatctcttaccagggaaaatcggtccggccccattagaattggcggttaatacataaattattggtctgggggaatcgcttctcaggggggatgatatactcttcacatggcccctctggatgcaatatttgatttttatgaggaatgacatgtggagtggtacactttttggcgtggggagaactgccgcgcttttgtattactttggaaactttcgcgcggcg

SEQ ID NO: 74269 - DNA, 621 bp, Triticum aestivum
  Clone ID: PAT_TA_74269
ggggaaatagggggggatttatataaaataacaatcacaacccacacatagatataaacaaaaacatatccagaaatccatatataaacaaacaccaaaataagatcaacaccttcccttgacccgggggacaaccagtagaatcgaaaaagccaaacaaagctaaatttacactaattcatcacgcaaaatggctagaagcaagagctaaaaaagcacaacctctcctcaaagaagaaactgaaataaaaatcatcggtaaaaaaataatttccatacggaatgtgcccaatttcacaaaacgtcctaatttactcacagtacgccaaaaactatgattataccccccaaatcgcaaaacttgccgcacgtgacagcaattatcacccgccatactcaataatagcatcatatagaaaccatttttaatctaccttctaactacaccacatatattataagaattgcacataggactctttaagatcgaaagcctgtactaaccaccaccactgtccacagtattttgaaagataacagatattccgaattgacaccctcaacgtcgaagtcacaggagtccgagtaccatcacaaatatccatgtgcaaatcataaccg

SEQ ID NO: 74270 - DNA, 697 bp, Triticum aestivum
  Clone ID: PAT_TA_74270
ccgaccactagtttctaccccctcgccctccccgtggaagcttctctccccactccccacctcgctggcctctgcttgagtgctccggggaggccggctggggcgcagtcgatggcgagggtgatgcaccggtcgagctcggacggcgggtcgagcagcgggtggtcggaggcggccgcggcggcggcggtgggggaggaggagagggccgggtgggaggtccggccgagcgggatggtcgtgcaggcccgggacaggggggccgacggcgccgcggcggtggtgccgcccaggccgccgccgccggagatcagggtgcgggtcaagtacggcgccgctacccacgaggtcgccgtctcctccattgccacgttcggtgagctgaagaaggcgctggcgccgaggacggggctgcagccgtcggagcagctggtgacgtacaagggccgggagcggaaaaactcggagttcttggacaggttcggcgtcaagaaacaagtccaaagctcgtcgttctccgaaggacccggcgaagccctggaaccggccgcttacaatcgaagcgggcaagagggaaccgcccagggaatcccaagaaacgccccaaacccggggcccaatcgggggcccaatgggccccctggaagggttcgaacaaaggcttcggccggattcacaaggtgaaccgaggccattt

SEQ ID NO: 74271 - DNA, 605 bp, Triticum aestivum
  Clone ID: PAT_TA_74271
aagattttcaagcactttttaatccatggcaacaaataaactgagcaaaaattcataattaaaatgcacaaaactatacaccttatttacgttcatcgacatcttaatcaaactttctaaccccacattattaacaaacccattactttgaaatagatcgagtctccaccctaccaaaacttcaacccaaacattggcatcagaaacatctgaactggacacctttaaccactcgatcttcactccgtttcagttacaggatcctcaaaaacaacctctttatcacaaaccctcccctaccctgcaaaaaacttctctccacttctatcaatatgatggggcctctctctacgttcccagtggaatctttatgaaatcctttccacccattcccaaaaccgtttttactttgacataaactttttttcccccaccaaaaaattctccacatttttagctctctcacaaatcccaaacaatatttccttttctaataaccatatattacccccattttttttatccactattacacaacacccctctctatattgataaatacgccctctctcccctcacaatatttatcaacacccaataacccc

SEQ ID NO: 74272 - DNA, 568 bp, Triticum aestivum
  unsure (1)..(568): unsure at all n locations
  Clone ID: PAT_TA_74272
gcgtcaaccaatgcctcgagatgtatttgcggtgcgcggtgcacgacacgccacggcaatggcgcaagtggcttcctgcagcagaattctggtacaactccgctcatcactcctcgctcaactgttcgccgttcaaggccctgtacggcaaggaaccgaacctgggcggcctaccacacctgagctccgccctacaagatcaagcggcgtcaccggagctggactggacagcacacacagagatgctgcgcgcccagctcgcgcgcgcccaaactcgcttcaagaagcaagccgactgtcatcgcgcggagcgcgccttcgacatcggcgagaaggtgctcctganactgcagncgtacgcgcagtcgaccgtcgcgaaccgcccgtgctgcaagctctcctacaagttcttcgggccgtttgaagtaacagagcggattgggactttggcatatcgcctgcagttgcctccagacagccgtatccatccggtatttcacgtctcccagctcaaacccttcaccccagattacaccccagtcttcgccgagctgccgcgggtgcctgn

SEQ ID NO: 74273 - DNA, 577 bp, Triticum aestivum
  Clone ID: PAT_TA_74273
gccgccaccccctcgtcttgtcactcctcctagaccggctcctctctcgctcctccttgatccccacctagattcgctcctctctccctcctctatccccacctagattcgctcctctctcccttctcctcgatgctgatttttttagagcaagcagattggatcgatggtgaccgcatgagcatgccgccgccgcatggaattgccttgccgctgcgtggagtcgctttgtcgccgccgcccgttgccacttgccagcaaggtgcacacacgcacctaacatccagggaagtccaccatctgaaccaccacgaccatccctcttggctagcacaagcagcgccatcagcacttcggaagtgaaggcaagcagccaagaactgtagaaaatcctgaatttgtgtctatctcatggacacccaggttgatatacagttttctcaacacccagatttgtggagcctgatgttggacaattaggatgggactgcagacctttagattttggtgctgagatttgtgcgcccctcgctacatgtaagccacgtttatgatgttgatctttctgctatggatt

SEQ ID NO: 74274 - DNA, 617 bp, Triticum aestivum
  unsure (1)..(617): unsure at all n locations
  Clone ID: PAT_TA_74274
ggaaaccctagccgcccgcactttgtctccctgccgcgccgccgccggagggttcgccggcgaagacatgccggacctaaggatggtggcggcggggcgcttctgctcctcctgggcgcactcgcgcacctcctggcatggatcgtggttgtgtgaggcgagaatatgcggcttcggcgtcgtgtgttccccgtgaactgacctcatgctccgggcttgccggctgcgtcctggctgtggcacctctttccaacgatggagtggtggcctcctaggaccggatccatggccagaaaggccatgggatcctaccccggcggacggccttgccaagctcgggatgtggcagtatctacaaccaactaggtggccctgctcggcaaggattagcagctccgacaggtggctgcagtccccttccaacgacggcggcggatggttgggcccagggccttcggaggtgcagtcaggcgggctacaacatgagacgactgtctcactgcggattctggtgaccatcgaagtcttcagatctaatggctgctttcggcaatgagatgcaatctacatatgacggcttgacgcanagggtggttgtgcggcagcggcgctggttn

SEQ ID NO: 74275 - DNA, 739 bp, Triticum aestivum
  Clone ID: PAT_TA_74275
gccaggagttatatgcttgcctgacagatgaaaccatgcatgttcaagtatgaaccaatttgaactgtaaaactgctattggcccattaaatcaactatactttgtttgatggtacaagctactctgataacccgcactatcctagagctaatacgtgcaacaaaccccgtcttttgggaggggcgcagttattagataaaatgctgacacggactctgctcgctgatccgatgattaatgataactccgacggatcgcatgtgctttgtgccggcaacgcatacttgaaatctctggcctatccactttcgatggtaggatatgtgagtacctcaaccattatggctgacacagaattaaggtttctactccccgacaagtagcgctgagaaactgtttcccacatacaacgcaatgtagtgttgcgaccccatataatccccctagtccttaacacactctggaaagttttgttctaccattgtaaataaacccatactcctggggtcgctgtctatgcggttcctgcctacacttagtaaactgattgaccaatgtctaaatactccctattaagcgttagagatcccaattcatggtggactaacattatatgatgccacctcagcttcaagtgtataaaaccacaaatatcttctggcgtttgtccttaagattgcgccaaatatatcacccctttatacgttttatacgctaggaccacatttctacccttct

SEQ ID NO: 74276 - DNA, 805 bp, Triticum aestivum
  Clone ID: PAT_TA_74276
aactagggggcgtcttaccagcacgaacctgctatgcctccttgcgatggggaacctcttgctcaagctgacccaatctctaactatggagtgtgcaagactactgccgctcctactcttgcaacacgatatctcgtcgctgtacaagccattcttccatcttcatcatatcgacaacgtcttctatgactcagaccaaattcactttcctattcctcggttactacaccaaccctgttctcccaataacctgttacatactatgctcatggcattgagacttaacacgaaaatagcatacttattctcttataacctttagctgcaagtgcgccacctctttagcaatacgatctgtgttttttatatcaagatttactgacacttattggcaaaggtgtaaagtaatccttatatcgaccttgttagaagtttttcagcgaacctaacctgggcttattcattgttctgacgaaacaacatcagagtcaaggtcttaacatattgtgtttggacagaaggactgcgatatacaactggtatctcctctttctttacattataaaacatcgttttgtggtccttatcactatttgccactgacttcggccctgtaacttaatggtaatgtgcggatacttgtcctctcaacctcactctaactataagcggcctgtgtctcatataattattctaatacaaattgtgtgagaatgtctgtttcagtcactcctttatgtgacaattttgaaaaaacatacatcttttcctatacacgctaaattactatacactttctctacct

SEQ ID NO: 74277 - DNA, 833 bp, Triticum aestivum
  unsure (1)..(833): unsure at all n locations
  Clone ID: PAT_TA_74277
ccccccccccaaccacacaaacaaacgaacaccatgacaccaacccaaccgacctctactcaaaccaacacccataccaaaacacaactccaccagcacacacaccgaaatctcccaaacccacaccaaatcacaccaaacgaaaaaaacaaaaccactcacacaaacaaaccacaccatcgaaacccaacccaccaaacgaaccaatccaacccataacaaacaaatcaacacaatacacaccaacccaaaaacaacctaacacaaaccaacccatatcacaacaaaaacaaatcaacacaccccccccatcaagacacctagtaccacccacaacctccaacaacatacagcaccataccagaaacacctcaccccacctcgcaacagaccaaacctctcctcaccaaacactctcccacgaaatacagaacccaaatacacatcacaaacacaaacctaaaacgaatccccccctccactccccaaacaaacaattaaaccaatccctaccaccaaaagaaagccaatacaaactcccctctaccaaaacaaacacatcagcaagaaaaacggttagagccccccaaacacctccctcgtaaagagcgccacattcaagacgcgcgcctttcaaacaactcaaaacacaacacgctgcctcaacttacccgaatatcctagataaaaccaacaccacnaatcaatctccaactccataccacacacgcaaaaccaacccgaaactacacaccaaacacgaacccaaaacgacaatccaaatcccacccaaaacactaacttaataaccacaccatactgcaacactaacc

SEQ ID NO: 74278 - DNA, 516 bp, Triticum aestivum
  Clone ID: PAT_TA_74278
cctcatcttcatctaaagttgaagcaaaaacagctgtttctcatacttcaactgctgatgctggttctgaaagcttaacgtacccagttgatgatcctgctccaaaaactggacacactggctaaagaagcagaccatggccgaagaatgctaaggtacccaccgagatccctacatagatacccattgagtcagtctcctgatcatttcagaatttcccggatatcccacagaaccgaattattgtttctgccaccaaatcagttacgattaaaatagctcctgctacaaccctaattgctagaaagatcgattccaatctctgaaaacacctctttgaaaaaaaacatcctccacggtaaagttggctcttgccttaaattttcaaccatcgtttcaaaccacagaaaaaccgccaaaggtgaattgggtcgaagtactggctctaaatgcattctcccttcacaccccttttgaaatggtactttctccctcgccaaaatatctattctccct

SEQ ID NO: 74279 - DNA, 591 bp, Triticum aestivum
  Clone ID: PAT_TA_74279
cagacggattatgatatgaggaaaactttggaggtttttgctgacattgttgggagtgacccggacttcttatcgatagcgagagcagggtaaagaagttgagaggtcgacaaccccgaaaactaacctcggaggtttggccactatcctcagaggtttggcctgtgtatttaatttgtactactctgtcccataatgtaagacgtttttgcagttcaatttaaactgcaaaaacgtcctatattatgggacggagggagtagttcacaatcagaatatttgcactgcttacaacatgctcactcgtgttatctcactgtgtgcagaccagaacaaaatgttgctgtctttgtaattctcattaaaagaagctgattcatgctggtattgacagggtcgtgttgttaggagaaccaatctggcaatagtgtcacgcaagcaaagtgtatcctagagctatgttcgggcagttcgggcgaatcctcatcgaaggtatactacggaggttgagaagatgaacaagtatgtgacaatgcacaacaatgcggcagaacgtgagaagtgtagtagagttgttatgaggtaacaatc

SEQ ID NO: 74280 - DNA, 447 bp, Triticum aestivum
  unsure (1)..(447): unsure at all n locations
  Clone ID: PAT_TA_74280
gctaaagatgagggccaccctaacgctgctgctacctctcgtgttcctcctcctcgtgctagcaccagctaaggcgagttatgattgtacaagccatatcgtcgcgtgcaaggacaaacccgaaccaccttgtccgtgcaaccaggcggagtgtaacttcgacagtcgcatagcgtacggtcaccttgggtgcccgaaatctgcgaccagctgctcttggacaggactgtgcatgagtcaggggtgtaacttcacctactgcgtatatagataagataggcaggcatgtcgacctgatagaataacaaagatgataccatggatggcaatgcagtatgtagttntattcgctgcaaagtgatgtacgtgaatggtgaattatttacatgcctaccatggatatgtctcgtttttcatattatcctgaaataaaaagtgttcacttta

SEQ ID NO: 74281 - DNA, 627 bp, Triticum aestivum
  Clone ID: PAT_TA_74281
cctattttaaaagaacacacccacaccgctcactcacccaaccctaccacctctacccccaatacacaatcgaaaattcaacctcgccagagctgcaacctacgcacaaccgcccaaagccccgaccgaacaaatgacctcggcctcgaaccgaaaattatctatccatttgctcaaacacccacacccctaagaaggaccactctcaagcacaaaataccacaacccccccaagccatccccccaacaccacaccaagccataaccctaccagacgcctaaaaaaaaccttttacagaactgtttacatcatgccacaagcaccaccaccaccctaagtaactaccatattcacaaagcaaaaccccccaaaacgctactataacgatacctcattacccccaacaaccacaacaacaaaattccccaaccccaacaaccacaacaaccattttcccagccccaacaaccccaactaccatttccgcaacaaccacaacaaggaaggtcttttttagataaagcactatctcccactttccaccgtttacagaaaccaacacaacacctttaccccatcccacaacaaccgcaacaaccatgtccccccaacaaacaacaacccat

SEQ ID NO: 74282 - DNA, 571 bp, Triticum aestivum
  unsure (1)..(571): unsure at all n locations
  Clone ID: PAT_TA_74282
tcaacacccgaacacattggcatggatacaaactccaggagatatatataggtgcatctatcctctgaccttaagaagagaggaggggtgtggaagcacaagcgcaaacaagagtgtgttttccccttccatcatggatattgctcaggaggatgagagggatcaggggcaagaccatgaccatgttatcgtggtcgccggagatcaaggggaaggagaaggcgaagagacgacgatggatgggtcggtcgattggaacggcagcccgtgcctgagagccaaatctggtggatggcctgccggactcctcatcctgctaaaccaggcgcttgcgacgatggcggtgaacggcgtgagcatcaacctggtgaccttcatgagggtggtgatgcagctcgacaacgccaacgctgccaagtatgtgagcaactggtccggcaccacctacgtcttctccatcgtcggcgccatcatcgccgactcctactggggaagatacaagtcctgcatcatcttccagctcatcttcctcgccggactggtggagctcgccatatcctcctatntcttc

SEQ ID NO: 74283 - DNA, 654 bp, Triticum aestivum
  Clone ID: PAT_TA_74283
ccgtgtcggtggggctcttccctaccccctccgacccggcgtaaaaaccctagctgtaaaccgcgctgatctccgggcgattcgcggtccccggcgctgcccggcgcgactcttcgcacaacgtgaaggcaaagcgccttcccggccccttcccaacaggggcccccatggacatacgacaccttcgaacgcctccaagccgagaccaggctccgcgatgcgctcattcggctcggggaggccgatgagaccggcgacgacgacaaggggcgggccgcggaggaggagctggattgccccttctgcggggaggagaatcacggcgagggcctgtgcttgacatccgggacgaccacccgcgtaaaaccaaagccggggcgagccctatatgcacagaacagagtgggatggacctggttgggcacatgacctcaaagcatcccatttttcttttacgtcgaagttgaggaacccagcggagtttcatctgggtcaacctttctctccagggatttcccgcacacggaaaaaaggatgcgggcgccacaatacaattacccgctttttggtgggaattccttcttcgtggcctacgccctggctcaaacaacacgtgtgcccgaccccttgataccggaaacctctctataaaag

SEQ ID NO: 74284 - DNA, 596 bp, Triticum aestivum
  unsure (1)..(596): unsure at all n locations
  Clone ID: PAT_TA_74284
gtcccattggcccagtccgccccccgccgtcacccggaccccacatggcagccacgcgcaagccccgatccccgtccgccgccgccgcggccggcgaccacctccgcttcctccgccccggcgccctcgcccgcctccgcgacgccaggctccgccgccgctccaagcccgcctactcccgcccggccccggcctcgccgcagccacagccgtccccctctccccctcccgcgcccgcggcgggcggggacggcgagagcgggcccttcgtgccctacgtcgtgcccgggtccagattcctcgcgccgcgctgcccgcagcggaagaagctcacggcggngaaggtggtgccgctcttctcgccgccgatgcccagcccggacctgccattcgaggcggttatggagttcttcaacgcgccggatatggtcgtcgccgcccactagatgggacccgtcgtcttgtattagtcgtggtatacttgtagatgcagggatctagtcccctccttgtcaatctagcttcatgtcttacagtttatcgtttaccttgtttgtctgtaccaaatcgatgtgaaaaacaaatactataaacaa

SEQ ID NO: 74285 - DNA, 586 bp, Triticum aestivum
  unsure (1)..(586): unsure at all n locations
  Clone ID: PAT_TA_74285
gccggacgcatgggccccgaatcccctaggatattcatcgggaatccccgaagaaagtcctggccatggacacggagccggtgattcgcaccacggtgccgcagcctctccacccgatgccggagcacgcgacggcctacagcttggacctagcgccggtctacttgtgctgtctctgcgaggaattcttctacaaggaccggctgatgttagggccccacgatacgcctactgacgtcgaagcccgcgtccgatgctgacgtcgtacgcgcgcgactatgcacgaatctgcgtctgccacgctgaacacggtccctgctgcgaccacacgtcctgatcctacttaccgccctncgacgaggagagtgagccacatcccaccacgcctcttgtatttgaatcaataaatggacgatccaacgttcaccgatgccgcaccgagcccgccatggcgccgctcggcgtctatgatcataccgtcttcgcccaaggcgaccaacggaacccggccttgattacacataagtcgcccataatacttacacgccctaactaatgactagtgagcaatacatcgacctgggag

SEQ ID NO: 74286 - DNA, 601 bp, Triticum aestivum
  Clone ID: PAT_TA_74286
cccccatgtcaatacccgcacgcgctggctgctggtgctggctgcctactgctactcccttctcgtgagccgtggcccgctcctcttcccggcggagactctccgaacaaggtctttggagactggcttgagggcgcccaggaaagactggactggaggatgtacaaggcatggaggcaagcctcactcaaggtgcggcgacaagtcagcacgtatgagctcgggcgcaccatcggggaagggacgtgcggcacgggccggttcgcctaggacaccgagtctgaggatcctgttgccatcaagatccttgacaaggacaaggatcaaaagcacgggttggtccagcagattagacgagaaatctgtacgatgaagctgatacagcgaccaaatgttgtccgcctgcatgaggtgatgggaagcaaggcaagaattttcattgctctggaatatggcacgggtggagagctccatgatatcatcggcgaccgtgggagcttgaaggaggatgaagcacgcagatactgttagcaattgagcaacgctgctgattattgccatagcatgggctgataccaccgagatcctgagctagagaatt

SEQ ID NO: 74287 - DNA, 649 bp, Triticum aestivum
  Clone ID: PAT_TA_74287
gccgcctccctcctcgtgccctccgccgccgccgcagcctctgcctcggcctcgaggcctccgcccgccacctccgcgcggccagggctcgagaggcgaccccggtctgcccgcccccgcttacggaacaccccgcccccgacgcaatgcagagcgcgggggccatggggctcctccggccatgcgccgcgcgggccatcctcaagagccctagccccggggccgcccgcctcccggcctcccgcacggccctccgcctctccgccgccgcgccccgcgcgggcctcgtggcggcggcggggctcggccgcatcgggctcgtgccggcgtcgcctgagcaggaaaagaggagcgactgcctcgtggccgccgcggccgcggggaaggcgtctgcgggcgatgaggccggtgaggaaagcggtgcatcgctcgccaagacgctccatctcggcgtctttttcgggctctggtacctttttcacaatttactttaacaattgtaccaacaaagcagggtccctcaagggtttttttccccttaattccccattaaaccattcacaatccaggcttcaaatttttggcttgggttggcaaacctttcccgcattttcccctctgggtttaatggtagcggcgcccaacagct

SEQ ID NO: 74288 - DNA, 678 bp, Triticum aestivum
  Clone ID: PAT_TA_74288
gaaactatttcacaggccatattttatccttctcaaacctttatttcccacccttttttaatccaccatgcacgctcttttccttaaccccacgcccctctttttttctcttaccccaaccccctccaactaaaagacaggtgttccacataacactgcctccacttcgttcacaaccgggagaatgtcttccttccccccctccatgataccattctctggcgtttccgttgaacatttccacataatattttccagacccctttaagcttgacttgcagatgtcattcctgtggtcaagacctctatcggtggcactataataaatattcgcctcttcctctgaaaaacaaaaaaatttttttttccccaccaccacccttgtaagagcctctaccttttaaaaatccctaacttgttccaaatactttataaaaaactcctttccttacacagaccatagccccctttcttacccatttccaattctgaacctcttaccatattgtatctattcaacaattctatgctcccggtacaaatagaaaacctccaacctctcttttttcatatccaaatccctatctgttctttccttacccttccctactaatttccttctttttcctttattcttttctccccctcaccacatttcctttccttctccccctcccc

SEQ ID NO: 74289 - DNA, 926 bp, Triticum aestivum
  unsure (1)..(926): unsure at all n locations
  Clone ID: PAT_TA_74289
gagagagagagagagagagagagagagagagagagagagagagagagagagagagagagagagagagagagagagagagagagagagagagagagagagagatatagagatagatatagaaaaaatttgaatttatggtagatanaaagggaggaatatggttttgatagtgggatttgagagataggaaatttgtgggaatgagggnatggtaaattttaagaaagattggtgatgattaaataatggagattttaaatatttggataggtttgaaaggaaagaaataatatttggaggatttgttaataaaaattataatttgttggggtaaaggaataaggaattttttttttattttgggatgtgaggtaatatgatttgggaggtgataaattaattgtaggggaagtntttttttttttttggggtggtgtttttagagatgttttttttagaantatnatatttggggggatatattntttttatggggaaaaagggttgagttttttgtgtagggggaaaaaatggaaaattggttggtttgtttatttttttagaatgaggtttttggaagaggagggtatttttggtntattttaagntttgaaaaagaatatttgttgtntttttttgagattgtgtgtgaaatatatagagggtggaaattgtgtgatttaccataagtaattgggttgattgggaaggaaattgtggttttnaataaattaaattttaattggtttgtgggagttgaatcattggtggtatagggttgttgtaaaattaacaaaaagaaattggttttgtattgactgagaggnaaagatgggggtaattttatcactagggggatggataatgaaggattaatttnttccttaattgaaatcttgttgtggaacaaacaaaagatcttgatt

SEQ ID NO: 74290 - DNA, 603 bp, Triticum aestivum
  unsure (1)..(603): unsure at all n locations
  Clone ID: PAT_TA_74290
cctagaccacaagcatcaaaggcaagcaagcagtagtaaccacaaatccaagatgaagaccttcctcatctttgtcctccttgccatggcgatgaagatcgccactgccgctagggagttaaaccctagcaacaaagaattacctccacaacaatcaccttttccacaacaacaacaacaacaccaacagctggtgcaacaacaaatccctgttgttcagccatccattttgcagcagctaaacccatgcaaggtattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcggggcacaaacctcacaacaacaatggcacagggtaccttttgcagncacaccagatagctcagctgn

SEQ ID NO: 74291 - DNA, 600 bp, Triticum aestivum
  unsure (1)..(600): unsure at all n locations
  Clone ID: PAT_TA_74291
attaaatgcagataaaaaaattatcccctgtttgagcagtatggaagtacacatggttatttggtcagtggccttcttggcatatgtagattttctgtgttctgaatttttagcccttgtgattcttgtaggttatgctttattcaggcgtataacttgtacttccattgctctacattttacttaaatcacatatttgacactttgtacaatctgcagttaattactaaatccccagagttgcagaggagttctacattatttcattagtccatttagagcatgtcaattggatgtataagttatttaggggtaaaatcaacttccctctgaagtctgctgctggtcatgctcttttatatgatggtctgatctggtcacactctttcgacagtcgatgcatattttcttttgggtaatttgcttcacctaagcttcagtagcactgtgcatggccctttgagttcatatcttctattggcgtctgaaaactatcatttttggtcatctgatatcactctattcatgctatcaatttttctttctcactatatggtagtccttgacctggttgtgtcattcgagaagggaattntnctt

SEQ ID NO: 74292 - DNA, 528 bp, Triticum aestivum
  Clone ID: PAT_TA_74292
cggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatc

SEQ ID NO: 74293 - DNA, 529 bp, Triticum aestivum
  Clone ID: PAT_TA_74293
cctataccacaagcatcaaaggcaagccagcagtagttaccacacatgcaagatgaagaccttcctcatctgtggcctacttgccatggcgatgaagatcgccactgtcgctagggagttaaaccctagcaacaaagaattacctccacaacaatcacctttttcacaacaacaacaacaacaccaacagctggtgcaacaacaaatgcctgtagttcagacatccattttgcagcagctaaacccatgcaaggtattcctgcagcagcagtgcagacctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagatgggccaatgtgtttgccaaccccaacagcagtcgcagcag

SEQ ID NO: 74294 - DNA, 610 bp, Triticum aestivum
  unsure (1)..(610): unsure at all n locations
  Clone ID: PAT_TA_74294
ccccactcccccctcccgatccagattggatcgggatcgatcccaccactccatcccctgcgctcgacccgactccggtgcccctctccgtcatcaacgtcgcctcaccaaccgcctccccgacagccaccatcaaccctcgccgcgccccggcgctgctcgccatctccggcgccgccccaccgcgccgccctccgccccgacacgccgtcttcatcacctggacctcgagctcgccccggaccgccccgatgtcgtcggtgccgccttgctggacgaccccgaccgcgtcgccgccgttcgtctacctcgggccctccccaagcacgcgattgcacatcggcaggctcgatatgctggagcccaggatccagacgccaccttcgatgacgactcctactacactggaggtgcctactactacgtgcagcccgctgacaacgacctggagtagttaggaggatcccaggcaggaggcctgcgcctctttcgatatgtatcccagtttgtgctagtcttcttaagggcaaactgtttaaactatgtctgtactcagatatggtgcttccgctgactcgtctatgatcgagcactngtattcgagccctcg

SEQ ID NO: 74295 - DNA, 536 bp, Triticum aestivum
  Clone ID: PAT_TA_74295
ccacggtggagacgcccgtcgccgccgaggaggtcgcgaagacggaggaggcccccgcgccggccgaggccgaggtcaaggcgcctgctgcccccgtcgaggtcgaggagaccaaggaggtggcacctgccgccgctgagacggaggaggccaaggagcccgagccagcagctgcggccgagccggaggccgaggcccccaaagagacagaggcgccagccgtggtcgagacagagaccaaggaggccgtggctgaggcagagccagcggcgcccgaggaggtgaaggaggaggccgcgcctcctgccgagccagaagcaccggccgtcgccgaggaggcaccggctgcaccggaggaggcgcccgcggccgcggcagaggagccggccgccgcggtggccagcgtcagcgtgtgaggcgccggcgcgcgcggaggaggagctggccgggtcagcttccacggcggcggccgtgtgctcctacgtggcacggcgtgatgctgagtcagccagtggagtggagtggaatgatacttt

SEQ ID NO: 74296 - DNA, 518 bp, Triticum aestivum
  Clone ID: PAT_TA_74296
agagagagagagagagagagagatatagagagagagagagagatagagagagttagagagagtgagagagattgtgagtgtgagtgtttgatcttgacagtgcctgtggtagcttctcgcagcgatggctgattaggcgtccgccgcggtgtttgttaacttctcattatcacggagcgtgagaggcggaagcggattatcgatattttgactaagtttgtcgggctcctcctcacccttccttgcaaggttgacaagtcgagcatagtgatggaagccatacacttcatcatgatcctggaggggacggtgagcgagctggtgaagcaaatgttagagagggttttcgcagtagtaggcatgctcgccgacgcagccaatgacggggtctcctcctcagtggcagtggccttgcttatgtgcatggcgacgccggtgactgggctgtcgggtggtgggttctggctgactggggcggcgcaagcgccatccatggctctgggcgtggtgaccgttgt

SEQ ID NO: 74297 - DNA, 609 bp, Triticum aestivum
  Clone ID: PAT_TA_74297
tcaacatggtatcagaggccagcgacggcggggcctaaggagacggcggcgacgtccggcgaggtggcggcggatctggcgcgcgcgcgggaggctgcggagagctgcacgcacgagagacgcggggagcggcccggcagagctgcgcgggcggctgctgctgctgcttcttggaccggaggcagagcccctgctcgggctcttcctcgtcctcgggcggctgcagaggaagaggagctgctcggggtggttgctggcgtgcgtgtgctgagcggcagcaggcagaggagcaccagtggagagaaggcgtgcgtgcgtcctgcgtgcgctgtggtgctgctgagcggagagtagaaaggggagtgatcgagaggagaggagctgctgctgggcgctgtggtcctggaggctgcgtgtttgctgctgctgactctgttgctgctactgctggtgctgctgagggggagaaggaagaggaggtgctggagcttattcctgcgaggagctgctgctggttggaaagagaagaagaggtgttgctgagttttgctggtgctgcttatcccgccaaacaatggctgaaccaactggtcttgccgaggctttgga

SEQ ID NO: 74298 - DNA, 585 bp, Triticum aestivum
  Clone ID: PAT_TA_74298
attcaagccgggcaagcattggtcaatacaaatccaccatgaagacctttctcatccttgccctccttgctatcgtggcgaccaccaccacaactgttgcttgagttgcagagccacaattgcaggcacaaaatgcatctcaccaacaaccacgagagcaagatccattggtgcaacaacaacaatgtgtagggcggcaacaacaacatttttcagggcaacaacaaccatttgcaccacaacagccatatccgcagccgcaaccatttctgccacaactaccatatccgcagccgcaaccatttccaccacaacaatcatatgcacaaccacaaccacaatattcggaaccacaacaaccaattttgcaccaacgaggccccactacaaccaccaccaccaacaacaacaacaacaacaacggcaacaaccagccagcaaccaccttacagcaccccgtcgcagggcagggtcttccttatgcagcaagccctgcagagaatcatttgattgcattcaatgcctcagggaaatcggctatcaatggcactcttccaatctaggataccccacaaggtctttatg

SEQ ID NO: 74299 - DNA, 519 bp, Triticum aestivum
  unsure (1)..(519): unsure at all n locations
  Clone ID: PAT_TA_74299
tcaaggtgtcggtgtggtgggacttcgagaactgccacgtcccccagaacgtcaacgtctgccgcgtcgcccagcgcgtctccgccgcgctccgcgccgccggcgtccgcggcccgctctccatcaccgccttcggggacgtcgtccagctctcccgcgtcgcgcaggaggcgctcgttgccaccggcgtcgtcatctcccacgtcccaagcagtggaaagaacagctctgaccggtcatttatggctgatcttgtctactggattgctcagaaccctccaccagctcattttttcctcatatctggggataaagatttcgccaacattntgcatcggttgcgaatgagcaactataacatactacttgcttgtcctggtaaaactaccagtgtactgtgcaatgcagcgacgattatgtggccttgggaagctttagtgaaaggggaaaatttctcaccaaagcgttttaaccacccaccagatggtttatctggatcttggtatggtcactacaaag

SEQ ID NO: 74300 - DNA, 560 bp, Triticum aestivum
  unsure (1)..(560): unsure at all n locations
  Clone ID: PAT_TA_74300
ggcgccgggggggagcgagcggcggcggtcctcggtagtcacatagttgccctatttctcctctctgcaaacatatgtgataatggacaaccttggacatagggaaaatgggaggcaaaggccagacccatataaagcacttcatactcagtggatgatgccccaaaggcaaatgaaagaccaccacagcatgaacctcctagcactaatgagtgagagggacaccgccatcatggagagagaccatgctctggctgagaagaaagctgccatggctgagagagacatggcgtttgcccagcgggactctgcaatggctgaacggaatgctngcatcgtcgaacgagacaatgcccttgccgcacttgaactagcccgtacaaatggatttaatatgaataatgggaccggattcaacccaggatctctcaatggagcaaagaacttccaccaccaggaccagcagccccatgctcaatcatcgccactgcaactggcagattctccatatgaccatgcgagggaaatgcacatatcagacgcatacccgatctcaacan

SEQ ID NO: 74301 - DNA, 535 bp, Triticum aestivum
  Clone ID: PAT_TA_74301
ctgagctgagtgaggagtgagctgagggagtggcgtctggtgttcaagcaagagaggaggaggagcacggcgtgtcctcggcgatctcatccatccgtccatccattagactcgagagctgaaactcaagctcacggccaagcagctgcggtaacggcgccacccggaagaccaggagggctggatctgggcggaatggaggccaaggacgtcgcgccggtcgccgccggcaccgccgacgcccccaccaccgcgccggcgccggcgccggccccggccgctgcccctgccccggtttcgcaggccaagccgcagtcgcagacgcacacgcagccaccgccgatcgtctgcatgccgacgccggcgcatccgttcgcgcaccatcagcaccaccaccaccaccagcatgagtagcagcagcagcagccgccggctgggtcggtgaaccctgccgcgcccatgcccggaggcggcatgaggctctcgttcgaccagatggtggcgaagccgtccggcgagcaccaccctgaccagc

SEQ ID NO: 74302 - DNA, 599 bp, Triticum aestivum
  unsure (1)..(599): unsure at all n locations
  Clone ID: PAT_TA_74302
gctacgccgagctggccgcctttgcccctcttcttcctctccccccacatcgatccctaaaacccatcgcgccgccgccgccgccgccgccgaatccctcctcctcccatgtcccgccaccccgctcgccacttcctcccgttgcttcgccgccgccacctccaccattcggtccatctcccctacacatccgtgcccattccccccgacgcgatcccctccacctccatcccgtcgtccacgtccccgccgccgtttcatcccgcgccctggccgcagtcgtgttcgcccaccttcacgccgctcccgcctttcacgggctnccacctncgcgcggncgtctnctncctcgccgnctctcttctggctctgcccgacccggatcccgaccccctgcccgccctccacgcccattcattccccaccatcctcgcagtctcaccgctcgcctccctcgagctcctgtccctcctccgccccaagcccttacctcggcctcgcggtcttttcgtttcgccgcacgctttngncgncgnccacgctncccgagtttgtcttcgccatctcgcttgccagccgcgcccgggaccccaccggcg

SEQ ID NO: 74303 - DNA, 532 bp, Triticum aestivum
  unsure (1)..(532): unsure at all n locations
  Clone ID: PAT_TA_74303
cgagtttttttttttttttttttcagaaggacaaaacgatctttcattcattcagttcagagattcagaccacacgcgttcggttcacagcttcagagaaatttcacctagctagtagcaaagcaacagaaggaaaatgcaaagcaaatcgatgatacatcatggctgggctatcagtcgagcacctcgagggcgtcgtactcggggccggagatggcgtccgccatgatggccgacggggtgagcacgccgtccgcctccaggaacaaccgcaccaggttcttcgagtagccgctcaccagcgccacgccggcctgcgccgccaccaccggcaccgacgccttggacgtgcccacgttccagaacaccacctccggcacggcgaacccctcggccgcgaacttcttcttgatggcctcgtggctcgacacccacgcctngccgcccacccacccgtcgaactccatgtcgctcagcacgaacacccgcttcaccatcatgtccttggacagcgcgccggccaccgccacgt

SEQ ID NO: 74304 - DNA, 648 bp, Triticum aestivum
  unsure (1)..(648): unsure at all n locations
  Clone ID: PAT_TA_74304
gaactatcggatctcgggaagaagatatatctccgctggcacccgtcgtcttcctcccccatcccatcttcatccgagccgcaatccacccgcgagcacgccattaatcccgccccactcggctccaggagggaaggccggcggcctccgctccaaggtacgacgacgtcgttttccacccccacgtcagtcactccactcccggaaggtccccctcccgccccccgttaagatgatgcggtgcgccgtgaggggcggcggtgctcacgtcgtcgtcggcgagcggaggtctgcgtcgtcgtcgcccggcggcagcggcggaaggagcgtcgtgcggatgtcggagggccgcggcgggctctgctgcggcggcgtgcggtcgcgcgcggcggatctcgcggggctcgagatgggccggnccagcgccggcgccgcggggcttttccggagcgcgcgctacggcncgcgttgcgcgccacccgnctcaagctggatcccgagggataattccatctggacaaagctttcaaagctaaaatcgtccccgggaagtggtttcttgcccataaccattgggccgtttgcttttgctttgggggggccaaatttttggtttcggggttacccacatcatggggtggtgggggg

SEQ ID NO: 74305 - DNA, 527 bp, Triticum aestivum
  Clone ID: PAT_TA_74305
cataaacccaagtcggactcgccttcctcctccccaactactcctctcctccgcgcatcgcatcgcaccgggggtcacctgaggtagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccagaagatgaaatccgccatgctggtgatcttggaaatgtgacagctggagcggatggtgttgctaacatcaatgttactgactgccatatcccccttactggaccaaattcaattgttggccgtgctgttgtcgtccacggtgacgctgatgatcttggcaagggtggacatgagcttagcaagagcactggaaacgctggtgcgcgtgc

SEQ ID NO: 74306 - DNA, 906 bp, Triticum aestivum
  unsure (1)..(906): unsure at all n locations
  Clone ID: PAT_TA_74306
cttctttgcctcccactaactcttcctccaatcaatatccctccacccaaccgacgcgctcccacccatctccaagatgctttcctcccgagtcacacttaacgatatcgcagtccgcgaaatcaatatccaatcgattgaaaacagaataaacctcgcattgcatcaattacactgaatctactctaccagagcgacacaacccaatcggcctagctcaatatgacccattaataantggccacccgccgatatctaacgatcgagtctgattcgtatgcatcaactctctctcatacccctctcgctattgtatctaacccttagcgaatcagtactgaacacccaccttactcatatccttactacacgcactccgagtcctatcatatcgaatacgattcgtaacagaaggccttggcatgtctctggcatacgaaccccctcgtatcctttacaactcctttgatacgatctctaaaagcacgatgtctaatcctatcgaatccgaaccgatacactcctttgttgatcctacccgccggctaaccaaccatcccccaccccatacataaccctccacccagatccgctgcgcataatatcccctagcccatatggccacccacagccgtaatcaccgtctatccctttaacatgtacaagtaaataagacctctccccctctcacctcttcgctattttataacaccccatcactcactctcgctatcattctaacacacacgatcactctgtctcatcaccttaaagaaatatctctcgtatacctcgcgatctatatatataataccactctctcctcaaaaaaccgcataactctccacgtttatgctnctcacagtaagcacaaccccacatctgccacgtataagtgacgaaccc

SEQ ID NO: 74307 - DNA, 562 bp, Triticum aestivum
  Clone ID: PAT_TA_74307
gggacacacacggtcgccatcgccgtgatcgccggcggcccctcccccacacacccgccccagccgccgtcccgacctctcgccagcgataagcaaatcccgcccgcctccacgtcgtccacaaaagccccgttctttaccacccccacccccacctcgctcctcctctccacccgaccctcctccccgatcccagccccagccccagccccaatggcgtccaccgccgcgccgcccgccgccctcgtcgcccgccgcgccgcgtccgcctccgccgccgccgcgccgctccggcgcgcggggctcgcggccgggtgccagccggcgcgctcgctggcgttcgcggccggggccgacccgggcctcgcggtccacgttcgcgtcgcgctgccgggctcgcgttcggccgcgcgccgggaccccgcggcccgtcgcccacccttgtgcccaagaaagagccgtcggggggaccttcactcggtcgctcgaacccttcgaggggcatatgcgccgttggcttctttgccggggcccgaaccctcatacgttgcccgccttcggc

SEQ ID NO: 74308 - DNA, 527 bp, Triticum aestivum
  Clone ID: PAT_TA_74308
gtgctcgccacgggctcactaccccccaatccctctattgacctcaaggagttagaccgcgcgcacaggcatgggcttcatatccgccggcgccaaggtcacctccgcgcgtctcttcgcacaccaaggagctcgccgaggtggagtcgcaccaacaactctagaacgcggtctccagcatccggctcgcgcggtccagacgcgttcgcacgatctggacacctatccgcgcgccatgctaccccgcttacatcgattctgggtagagccccatgacgaccacagacaatatcctggcgcatacgtgagagcgcgcaaacctcaaacccgctgaaaactggaggttggaccaggacgagctcatgacgcacgacatctgaggacccggtaccattaggatctttaaacaagagctctaggatgtcgcctacgtgtgggaccgcacaaagggcgtatcatacccgaccactacattttaaccaatgaccagagcgccgacatgaagcgttcacattgtaacggactta

SEQ ID NO: 74309 - DNA, 523 bp, Triticum aestivum
  unsure (1)..(523): unsure at all n locations
  Clone ID: PAT_TA_74309
agaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccattgtcccaacaaccacaacaaccattcccccagactcaacaaccccaacaaccatttncccagcttcaggaaccacaacaacctttttcccagacccaacaacaattggcggaggcccaacaaccggn

SEQ ID NO: 74310 - DNA, 561 bp, Triticum aestivum
  unsure (1)..(561): unsure at all n locations
  Clone ID: PAT_TA_74310
ccctctcgtgctcgcgagccgcgtcaaaaccctagccaccttctgcccaccacatgcaccgcggcagcgaccgctccggcgacccctccggccccgcgggcggcgctcgcagcggcgcggacggcagattcgcgcgcggaccctcgcgctggtccggcggcggcgggggtagccccccgccccaccgctcctcccgcggcgggagcagcgacggcggcggaggcggaggcggaggcgggaggttccatccgtaccgtgcgccgtctgaatacgttgttggcggtggtggaactggagggtacagaggcggcggcggcggcggcggcgacttcngtgagacggccggtggagcgaggagccgctacggaggcggtggcggnggaggccgtggagactactcagatcatgataacaaaagtggttatgttaaactttttgttggatcagttccaagaacagcaaatgaagatgatgttcgacctttattcgaggatcatggagatgttcttgaagttgctttgatcagggataggaaaactggtgaacaacaaagctgttgtt

SEQ ID NO: 74311 - DNA, 532 bp, Triticum aestivum
  Clone ID: PAT_TA_74311
gaaatcatctatttcgttgcagtttcgttggacttatcctttggtttcaactatacatcagagtgtatcattttccttttgagtagctttatctggcgtatctagctcaagtagtagtttcccagtgaagaaaaaaattccagtaccagagatgaatggttgattagtttgagcttcaagccattttagtatatttctttgtacgtgtggcttgtggctaaaactagtttacttttaagttcatccatgatggcccatagctatgtgatctgagggatgcagaccgttcaagccatgcagcctatttcacctttggtgaaccttgtttgaggcttagtataattgatgtactagtgcactgcttggcgtaaaattatagcagtacacatagatatgcaatgaatgcttctagtatcttacacatgtatatttgacatgaatgtgtactgcttggcttaaagttgcaacaaccatgttttctgaataactatagttgctttgaaaagctgtaatttattggcgatgttacctt

SEQ ID NO: 74312 - DNA, 525 bp, Triticum aestivum
  unsure (1)..(525): unsure at all n locations
  Clone ID: PAT_TA_74312
ggccgccgccgtcctccgtccccgcgtctcgcctccggccggcacgcggcccctccgctccaggctcttcagctccttggaggtaatttgcccgcccccttgcaccccgcgctccctcaaagtcggagaaatttccgtccgccccgtgcgattcgtgccgacgattgccctagtttattgttactccgacctgtccctccgtccgtccgtcgtcgcgtcattgctcgattccccgcggtccggcccctagatcatcacgcgctctacttgcaagtgtgcgtctactccctccctctctgattgcaatctgtacaagtctccaaattaacactntggccactgatttctatcaaagtattttgctttgacttgcatatattcaaatttacatcttgcaagtatatttcctgataactctcctaccggttctgctcaacatttccctagtgatattgagaaaaatgtttgactagccaagcagccacctgcatttgcaaatcacaggggtctatcctcaagcttgaa

SEQ ID NO: 74313 - DNA, 417 bp, Triticum aestivum
  Clone ID: PAT_TA_74313
ttcaagcccccgaaggtctctttccgcaccaaggtgttccacccaaacatcaacagcaacggcagcatttgccttgacattctcaaggaacagtggagcccggctttgaccatataaaggtctctgtcatctgtcgtgctgacgacccactgtgatccctgggctgaatcgtacattccaatgatcggcaagttaattcacggcgctctggaacaaaaaccctgggttaactggaccgccatgggacatgtgcccagccaaacgttaccttaataccacaaggttcccccccccgaaaaagaaaggcttttaaggccgtggcgccctgtgggaactcgtaaaaggcctctggccatgtaaagtcccttgggtctgggtagtctgttctacctgacgtttaaaaaaaaaaaaaaaaaa

SEQ ID NO: 74314 - DNA, 519 bp, Triticum aestivum
  unsure (1)..(519): unsure at all n locations
  Clone ID: PAT_TA_74314
gaaaggcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctntcagacaactgcactggtctccagggattccttgtattn

SEQ ID NO: 74315 - DNA, 559 bp, Triticum aestivum
  unsure (1)..(559): unsure at all n locations
  Clone ID: PAT_TA_74315
ttccctcctctgtaatccaatcttttcacattccccgctcctcgctccccccctcccgtcccctccgagaaatcaaagcccgccgccgcgtggagatactagcggcgcaatggacgcctacgaggccaccaaggtggtgttcgcacgggtccaggggctcgtcgacgcggacctcgcctccaagatcatgggcatgctgctcacccaggacaagagcgaggaggatatgatccgcctcgccttcggccccgagcacctcctccagtccgtcgtcgccgacctcgcggcctgcagcaaacccccctccccgcccgcgccggcatggaggatggcgcccggtgcggctggaggagatgctgaaggcggcctcccgttcggcgccgcatccgaagcgttctaccccgaggaggagtacggctgctggtctccggcgagcggcactcatcaccgccggagcttctcgctgagcgacgccgagggcgggtggaagccgtgccagtacttcgcccgggggttctgcaagaacggctccggctgccgcttnctgcacgggctgncc

SEQ ID NO: 74316 - DNA, 526 bp, Triticum aestivum
  Clone ID: PAT_TA_74316
gagagagagagagagagagagagagagagagagagagagagagagagagagagagagagagagagagagagagagagagagagagactgagagagacacaggcgtctcaaggatagggtcttaggcggagcacccagagcgcgctgcggtcaccgtttgttcctcggcgactcgaggcaagaagtgatgtagtaccgcaactatatggtgctctcgcccatggtccgcgcgggtactctgccgtttaagctattgtctcctgtatatggcgcggctttttcttacggcgaagaatttatagatcacagctttgtgaactgtccacgcgttatatatgaatctcttggcacaactgattttgtggagagagggactgattgtcttgttttccgcacatgcccgcaagacacggacaaggttgtttttcaaatctgcacatcacatgctgtcagagcacttcatgctgctgagctagtgtgtaatgatattgctgctatagatatccacatggggtgttccacagttt

SEQ ID NO: 74317 - DNA, 591 bp, Triticum aestivum
  Clone ID: PAT_TA_74317
cggtttcagccctccgccgccagcggcgctctctccttccccagctgctgatgctgcttcgtctggcggtgctgggtttgcgaagctctcctagttcgggaggcggaagatccgagggaacgccgcgagatggtacgtcttcttctctctctgcttcgtactctgggcttcgtctctctcctcctgcggggtttctggaggtttcctcccggtggaggcggcggggccggggccggggccgcagcggatttggctggatctccgccggcgacatggcccttttgtaggagggatgggagcgatctgtctgacgcgtttggttgggtacaggtaatgtattcagtgttgtaatgagaatctgctgtattagatcgggaactatgcgattgcacgatctgtttggttcaagcaaggtaagaggaagcggtgggttgggttgcatcgaaaaaacgagggtgccagctgctcacgacggcggagggaaatcggccacactgagatgacggcggcgggatctttggcgctgctgcacacggcgggggatagatcgccggtgctgctcctcacggtgggggagatcgccggcgctgc

SEQ ID NO: 74318 - DNA, 644 bp, Triticum aestivum
  Clone ID: PAT_TA_74318
acaaactatcccattttgatccaatatggatgccaagatttaatttctggtggaccatacaacattgtgacaatgacttatgtgaatcgccatacatcgtccgcaaccttgctcactagtttcaacttggaggcaaccggggtttctgctagtaggaatcacctgtcttctgcgtgatcagatcttatatccatgatttctggtccgaatctccaaactcttattgacaataccatctcatccaagctcgccatggattaactgttttgtgttaattacgatcagaaagaatccatttgttcggagatcatcgctctgaacttgaaattttcatcaactctttcacactctatcaattctttacctccttactcttaaactaattgcttcttcaactaaaatatacttattatttctgactccgatatcttctttactcaatcaatcaaaattttcaatcttctttctccctaaatctctactttctcatatttatgtgtatccttaaattcactaatataattatattctactataaatctcatatatccaaattcgcagaaattgtatatttgcttatatttcgataatttacaaccatagtcgacaacttcaatttcattcgtccactattagtcaatatt

SEQ ID NO: 74319 - DNA, 681 bp, Triticum aestivum
  Clone ID: PAT_TA_74319
tatgaaaggtctgtatattgcaaagaggatagaaagcctgtgactttaccttgcggtagctaaacggggattggatgtactcatacgtgcaaatagttgactgacctgattctattctgtctctcatctaattttaaatttgaaaccgccgggatggcgaagtaaataatatttagtgctgcataacaatatttcagggggatatgtaaagagatctcttgcgcaggctgcacatgttgtgagcgttgcatattagaattcttaagtcgccgaggacaatgcggctgggatttggtgtaattgcatagacgaagttcgaattgggaggccggcttgcgggtggcggtttggggaattgggcattcctaatcgttctgtttgtagacgcgggctttgggaatttcgtatactgggaatatggggttacgagtttaggtgcaattagcaagactgggaatgatgagatccgcgatattgcgggctttgggtgaattctctaatagagtaatcggggaagattggggaaattcgactaatagggcattgtcggatactcgcgaaatttctgcatttggtggtaaattctggtgaattcacgaagatacgcgcaatttgggtgatatgcgcgcgaaatggtgaatgattttgtgaggataaactactgactatattggcgataca

SEQ ID NO: 74320 - DNA, 607 bp, Triticum aestivum
  Clone ID: PAT_TA_74320
ctctgattccttcgcgagggttttgccggcgcagagcacggttatggggtcgccggcctggcgcggcttatggcgaggcttgtcgagatgtggccgctccccctacaccgcggcgccccctcccagtctctacctcgccagggcagcagaggtccccgatgcgtcggggcgccgccatctcgccgtgcagcggcacgcgatctcacacatgctgggaaccatggacctggcgcctagcatcaacacggaggagtggtggaagaggaggagccggtaccacggggcgagctgggttcaggcgcacgctccgtcgcgcttcttctcggctacccccaaggatctactgaagggttcgaaggcggatccgagcgatcttgcggtgccgagtccaggtgatgatgcacacggtcccggggacatggcgatgcacaatcggttcgcatcggcacaaccgctcgcgcttgtagagcaggtgaagtgttggcagatcagatatctgagtaaaggcgcacaagctgctggtgcaattgactctaattttgaaagaggcttgatatgtgttgaggtgtacgcttatttgtacctccctctaatacgccggagagaa

SEQ ID NO: 74321 - DNA, 736 bp, Triticum aestivum
  Clone ID: PAT_TA_74321
caactattaggtaactgatccggtgcaagtctcaatacttacccatccatcaataggaccggagcgagtatgaacaaattatcgtagacgttgttgttattaactgcaggaaaaaatatgggtgcgcgatagagactcgctttagtaacaaacccgatatgtcactggacgtaccgacttagatgtggtaagcatgtggggcccgctccggaacggaaataaaagaagagcgggcatccaggctcctgattatatgtggacacaacgcttcccatcaaaaacgaccggttgtattaggcacacggattttgataaccaaaagaggtagcatcaatgcagctcactcttaactataaggaccgcttaagaaaaattcgaagtgcgcgattgagggtggaattatgtacggacgtaggatccctactgtacgctgatatggacattggacgggggggaaggaatatttgtgattgataaactgcggacattcacccctacttttcgaacgaaaaaagggtgcttttacggacgcaccaaaaagacttccaacaatttggtggttggggatgcgtgttaataccgcagttatttaaaacaccgccttttttcttaaaaccaaacccgcgggggagggggcccccaaaattttttcgcgcccgtaagcaccccccaattttatccatcgacgcaacacctttctttgggggccataacaaaatgacctctctaaataacg

SEQ ID NO: 74322 - DNA, 717 bp, Triticum aestivum
  unsure (1)..(717): unsure at all n locations
  Clone ID: PAT_TA_74322
cctgatcgcgctctcaccatacaccagttctctcatttcctcaactccaacctctaccccatgctcagctactcatcggtcatcctagtattgcgccctgatgtttgagagacaaatatatacagtaaataatatgtctatatgtagtcctttggcgtattatcagtgtgcacaattgctctattgccagtgatctattcgatagcggccgcgaattcctgcagcccgggggatccactagttctagagcggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcgnngagaggcggntngcgtattgggcgctcttccgctttctcgctcactgactcgctgcgcttcgtcgttcggctgcggcgagccgtatcagctcactcaaaggcggtaatacggntatccacagaatcaggggataacggcagaaagaacatgtgagcaaagggccagcaaaaggccagggaccggaaaaagagcgggtgg

SEQ ID NO: 74323 - DNA, 741 bp, Triticum aestivum
  unsure (1)..(741): unsure at all n locations
  Clone ID: PAT_TA_74323
ctgtgcacgtgatgccatagatgtttttatatactagcgaaagagagggtcactaagcagtcatgtcggggtgaatcggtgtggtcccctatccatacacatattgatcaggcgtgtgaaacattagtatcttctagagaggccgtgagtcctacatagctattgctcagcacgccatgttacgtgaatctattagacatgacagtctgtgcgaatactctttactgcccatcattccgaggttcattgagacattgtccatcgctattgatactgcccagatggaaaagcgtgctggtgattatatgttaccacatgactccgtgttgatccatgatgtgcgcatacaaagttcatactgcgccaagggtgccttcctactggctgacataggtgcagacttgcacactgacagtactccaccacttcaggacatgcatcagtgtcgctcatgatatggcgcacaaaggctcgatgcttgccattgcactcacaccaagcctttctgaggagggaatagatctactactgtagagcctgctgcgtgcgatgcgtgaggaaccagctcgacgcctgccagaatagtaacattgctgatcatgtcaatgaggggtggtggcacaaagacgtgtccaatgtcacaccatgnncccccctattggaggctcatacacgttaaactggatccctcgacctggaacccttggtaatttatcgtgggcgggttccaaaccgaaaccc

SEQ ID NO: 74324 - DNA, 520 bp, Triticum aestivum
  Clone ID: PAT_TA_74324
agacaagtcaacctcaccgaggagaagagaagaaaagagaagcgagaagatgtcgggccgtggcaagggaggcaaggggctcggcaagggcggcgccaagcgccaccggaaggtgctgcgcgacaacatccagggcatcaccaagccggcgatccgccgtctggcgaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgctctcaagcgccagggacgcaccctctacggattcggaggctaggccgccaccaccaccaaattaaggacctagcccatgtgtagggttcgtgggcctcgttgtaatcgcagtatctcgctgttgttcgctgtgttctgtaggatcgaatggaatggaattgaaattaaactagttcgtcgttgaaaaaaaaaaaaaaaaaaa

SEQ ID NO: 74325 - DNA, 712 bp, Triticum aestivum
  Clone ID: PAT_TA_74325
ctcccagttcgagttccgccgccagcaccaaccgaagccaagtttcgagggccgcgccgcccgggagcagtagacgccccgcctggccggaccaagcagaccgccccagtccaccggcggcaaggcgccccgcaagcagctcgccaccaaggcggcgaggaagtcggcgccgaccaccgggcggagggaagaagccccaccgctacaggccgggcaccgtggccctccgggagatccgcaagtaccagaagaacacggagctgctgatcccgcaagctgccccttccagcgccctggtcccgccgagaatccgcggccagggacctttcaaggaccggacccttccggcttttccagggtcccccaccgccccgtggcctggcccccttcccaagggagggcccggcccggagtggcggtaacccttcggtgggggaacctcctttcggagggggaccacccaaacccctggtggccgccccattccccaacggccccaaggccggccgttccaccccaattcattggcccccaaggggaccaattcccaaggctttcgggccccccgccccgcaattccccgccggggggaaagcccgcgccccttaaaagccgaagccggaagggccccaattccccaacgccccccttggccggcctcgtcggttccagcccgacattttcggggcattttccggggggggccgccatt

SEQ ID NO: 74326 - DNA, 561 bp, Triticum aestivum
  unsure (1)..(561): unsure at all n locations
  Clone ID: PAT_TA_74326
ggcaacagcgctggctatgtaaaaaacggactaaaacagcaacagggctaagtttgtgtccgtttcttcataaccgcgtccggtgcgaactgaggataggggtctagacgctttccttaatgtgcaacgtgaacatctgacattaatgcacacccactccaatgaatactatgacctgggagatgttcctgatatccatgacacatacctgtggcgttagaggatgatagcatctgtgatgtgcatcttcaatctatcacagaatcattggccggttgatatggacaagacagaagctgcatccgtcatctaggatgatcagctgtattgcatctcagagactgactgcctatgtgccctatatgagcttgactccgnttctggggagaatgtgcagaactgcaggattgtcttcattgcctgttccccttacacataccggatccacaccaagatgctcgactccacctacaatgaccacttgaaacacgatctcgacagctatctatacgagatccaggcacatgacccttacgacgttgagctcgatgtcctccagga

SEQ ID NO: 74327 - DNA, 777 bp, Triticum aestivum
  Clone ID: PAT_TA_74327
ccagcaaccacaacaaccattcccccagactcaacaaccccaacaactattttcccagtcccagcaaccacaacaacaattttctcagccccaacaacaatttccgcagccccaacaaccgcaacaatcattcccccaacaacaaccaccgttcattcagccatctctacaacaacaggtgaacccatgcaagaattttctcttgcagcaatgcaaacctgtgtcactggtgtcatccctctggtcaatgatctggccacaaagcgattgccaagtgatgcggcaacaatgctgccaacaactagcacagattcctcagcagctccagtgtgcagccattcataccattatacatttccttatcatgccgccagaacaaccaggaccaccaccagggcttgctattctggtggcactatattaacaaccacaagggggttaaaggactttttgtccagggccagggcttattccacccccaacaccacattaatgggagcgaaacaggtcatgggtgtgaaaactcttccaacctgtgcaacgggtgtgcccacctgagcgctccattataagcgcaccattttccagcgtactccccggctttgggggcctgtgaaaaatgccagacccctcctaaggggaaagggctcacggcggttatgtggttccccccccgtggcgacgataaaaaaaaaaggggcgcgccccatttgtggcacccccaccgccgctttacaatcgggggaaaaaaaaacaaaaaggttttttttggagagc

SEQ ID NO: 74328 - DNA, 485 bp, Triticum aestivum
  unsure (1)..(485): unsure at all n locations
  Clone ID: PAT_TA_74328
ctctctctctctctctctctctctctctctctctctctctctctctctctctctctctctctctcctcgtgccgaattcggcaccaggccttcaatttcgagttccaccgcccgctcccgcacagcaaaggcaaccgaagccggcgagaggagccatggcccgtaccaagcagaccgcccgcaagtccaccggcggcaaggcgccccgcaagcagctcgccaccaaggccgccaggaagtcggccccgaccaccggcggcgtgaagaagccgcaccgctacaggcccgggaccgtggcactccgcgagatccgcaagtaccagaagagcacggagctgctgatccgcaagctgcccttacagcgcctggtccgcgagatcgcgcaggacttcaagacggacctccgcttccagtcccacgccgtgctcgccctccagaggccgncgaggcctacctcgtcggcctcttcgaggacaccaacctcg

SEQ ID NO: 74329 - DNA, 456 bp, Triticum aestivum
  Clone ID: PAT_TA_74329
ctgtctggctgtctctctctctctctctcacgctctctctcgggcgccgtcccggtctggcggcgcctcgctggcaggagatgcttcttaccagtacaggcattacgccgtacatctcgaagcggactgttaatgggacaagaactgctcactgcacctacgagaactgctcctctactggccgccgcaagccgtgctcaggtcatctcttcttgccacggacgtatactagaaagaacgacactactgacgagttccgcagctaggtcacgagaggctccctgcatacaagagtggagaagggagccaccaaggctgaatgtactgacatgccagcacttagaggcaaggattaggggaagaccagaatgagttacccatagtacactgaaacagactcatgactgcaaagcaaggacattgcggatttgagagggcccaaccactagcaagggg

SEQ ID NO: 74330 - DNA, 478 bp, Triticum aestivum
  Clone ID: PAT_TA_74330
gttcagcagactcaacggccagatggaagccaaggcagccgcggttttgttcattgtgctccttggatgctccatgctcatgttggtctcctcaactgatggtgagatcggcagatcaggttgtcctcgtctttcggatggcgatgccataggcaaagacgacaccccgttcccaaaaatgtgcatagggaggagacacggccctgagaacgtcgaattctgttgtgcaacattgccaggactaccttgctggcgaacgcaggaagagtgcctccacgtttgcccataggtctcatcgttgtgattaatcaacgtagtgggccaatctttgatgtttctgtccatcgaaaaaattagaatgaagggaaatgaataatatttttttcatggggaggaaacaaatagtcatgcatggatatgtatacagagatggaccggctctgcatctgggaaattaataatttgtaaacttatctcc

SEQ ID NO: 74331 - DNA, 484 bp, Triticum aestivum
  unsure (1)..(484): unsure at all n locations
  Clone ID: PAT_TA_74331
gtcgcctccacatactccagtcaaccaattcgctcccggccaccacggcaatggccatggatttggacgagccgcttgccgcggagaagggcgaggtggcgctgcagcagctgcggcgcgccgacccgtccgtctacctctccccgtccgcggacctcgccgccgccgcccgggcggctctgaagcacttccactcgtcgctcgccgttgtctcccccgtgcagccgccgcccctccccaacctcctcgccggccccaacttcgacgccgagcagatttggtcccagagcgagctgctctcccgccccctcctcccccacctccaccgccagctccgccgcctcgagcaccaaccgcctgcgcagccgttggctactcctccgccgtccaagcccgctgaagccgtggagggcccgtcagacgaggaggaggatggagagggtgacgaatcggaggaggaggatgagggnggnnngnnggnncg

SEQ ID NO: 74332 - DNA, 339 bp, Triticum aestivum
  Clone ID: PAT_TA_74332
caaaggccaaggagatgctttcttttaacaactgcgaaggtaacaaagtgggactgtccctattgcagcaccaaaccaaatacaaaggatggccgcttcgatcaccttctatcttatgccgaggatgtagcgattcacggggaggactacatgatcaaagggcgagcatgccgccctcgcgaaggccctgacttccgcgtgatgtgatcgatgaagtgatgctgtgttacttttgggttggttttttgaaccggtggggtaattttgggttgttgaactaaaactcattggttatgggatgttgaactgaatctcgttgggtattctagtaatatgggt

SEQ ID NO: 74333 - DNA, 874 bp, Triticum aestivum
  Clone ID: PAT_TA_74333
cttgggccttcccacttttcttcctttcttgggggaggagaacaagaataacaaagggcttccctttgcctaccccctttgcctgggttttgtcttctgaaccaaccaaaaatccttccttcaattttgttcttggggaatccattccgaaggggtacatccttcatgcattccaaccccaactctttccgggggttaacaaaaatttggggactctggggtccacagtcctgttccatgaagtcatcttcgactgtctaacgccggcatgtttgtagtccgtctatatgtctcgaagacggatgacgtgtaccaccatgagacactcttgaagcttcatctcgacctccaggctcgcaagaagctgtctacagatatcctcacactgactgacctgagttgaagcagtgaacatgagtgaagtgaagactatgtagcgaaaacgatctgatgtgtcacccctctcaggttcaggacgcacttaaaagccgcgtgatattgaaatctgtccgctcgaacacgctgagaatccttaaagccccatagtcatttgggcacaaatatgtaacgggtggctagacgacatcaatatggcagcgcgtacctccataaacagggggagtacttaaatttggagaaccggatttgtggtttgatagctagccacactctaaacctttggagagagaattccttccaaaggataaagcccaaaaccatccccaagccgaaaaatgattatggctaaacttaagggtgtctggccattggaactcggaacatttttttctctttagaccattgaaactcttccaaaccgcttggggccttcgggttttgacctctccaaaaaagaattgtgtgttattgccct

SEQ ID NO: 74334 - DNA, 871 bp, Triticum aestivum
  unsure (1)..(871): unsure at all n locations
  Clone ID: PAT_TA_74334
cttatcgataccggcgacctcgagttttttttttttttttttgtagcagccggccggggctcaacccgacgatcaaactacaatgcaggggaaatgaagaagcaataatttcaccaaagaaattcattatccccccagcagattcaagggatcccttaaaagtcgggaaccttccttttcaaccaaaacaaaactcctttgggtttcaccgttccttccccgggggaatgaaaacctaaagcgccgatccggttccaccagccaataccggctggggttggcccggccaaaaaacacacccggttacccaagttggttttgggcgccccaacactcccaatggccgaacacccctggccaccaaaacaaaccatttattccgtgtgaacacactccgaaccgtgtttaagctctaaatccccctgggagacagtggcccaaaacactgggtggttaatgttcccccaataatcctaagaaggccggcccagaaagcccctccaggggggaaccccccaggggggcttgggtttttgctcccccggagggaccattagacaaattaaatatccctgaaaaaagggaactgggaaagcttccgggggcgaacaaatttggaaaagtggtattcacccggcgggttggttatcaaaaaaaacggcccctccaaaaaaatccgcgggttatgtaaaaagggaaaaantggacacccccgaaaaaaataacccccggggggcgcccccgcggggggaaaacacaccccgcgggcccctcttttggtgggccccggggcctgaaaacaataccctcccccaaggggtttttggggacgcttgttaataaaataacccacccccccctcccttgtttc

SEQ ID NO: 74335 - DNA, 669 bp, Triticum aestivum
  unsure (1)..(669): unsure at all n locations
  Clone ID: PAT_TA_74335
ggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgggatcctctccatggccaacgcgggccccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaaggcgtcattcgccgactggggccagctctagattcgtcccgcccgccggncggctggtcgtcgtcgccccgtgtcccggtgtcgcgatccaaataaaaaaagccgcggggcg

SEQ ID NO: 74336 - DNA, 184 bp, Triticum aestivum
  unsure (1)..(184): unsure at all n locations
  Clone ID: PAT_TA_74336
ggagagcggncggcggaaggtcattatccctccctnctntnntaccaaccactattattgaacaatatatacaatctcccaaaccatctcattaagctccgagcgcggatgggtttggggaatggctcgcgccagctgctagagcgagctttattggcgacttgcgcggaaggtgagcccccgc

SEQ ID NO: 74337 - DNA, 325 bp, Triticum aestivum
  unsure (1)..(325): unsure at all n locations
  Clone ID: PAT_TA_74337
cgccagtgcgcgtctgccatggcctcaccaccgcgcgtcctcctcgggcacgccctcctcctcacccccctcctaccgctcctcgcctgcgccgggctcgtcctggaggacggctacaccgtctccacggtctccgacctaaaccccaccgggacccacccctacgcgctcctcccgcggccccgcgccggggacctcgtcctcctcgactccgccggatccacgctctacaccctccccctccccgtctccgcggacgccgggccgcggaggctcgcgnnccccccccctccnctctgggcgggccggctctccctccgccccc

SEQ ID NO: 74338 - DNA, 912 bp, Triticum aestivum
  Clone ID: PAT_TA_74338
gggcgagggtgcaaacttatacgcccattgtacagggctattgccgtgaatgacgtgtatacgatgcccaaccactccactccactccgtctccttctgcatcctccccccacctgtctccccccacaacgattctccacattgtccctcctcctacccccctctcaccaactcccttccctaccctacccaccccttcatctccccccatcctttctcatcccctcctctcccgactactcctcctcaatctattccactctcccccctcctccgctcctctttctccctcccccctgcatctccctcccttctccccctcccaacacatatccctcccacccctccactctaactctatcttccccccccttcctccaccctccctcctctcccgctctccaattctcctcatccctcctcatcctcacccattccccccaccccgatcccactctcatcccacctcctctactatccccctcacttcactcccactcacatccctctacatcttacccttccctcttctatcctccccctcatccccttccccagctcccccctactaccccccttcccctctccctctctccctcccctcctctcctccacactctcacaccccctctcctttcccccccgctccccactttgccactcccatctcaatccccatccccctctctcacgcttcctctctcttccgccaactccaccctcctccttcactctttctcccccccctctcgactcccccttcccccctctccaatctccctcctcatccttctctcaccctatactttcccatcccctcattcccctcctctttcttcttcgcatactctcctctctctactctccctacctcctctcgcaacactccgactcaccacttctcattctcca

SEQ ID NO: 74339 - DNA, 905 bp, Triticum aestivum
  unsure (1)..(905): unsure at all n locations
  Clone ID: PAT_TA_74339
ccgtccggagatatatatatacccacactccaaaccccaccatggtgaatccacctcgtgtcctcggcctccctcctccacagcgcggtctagtctttataatagacccctcgcgccatcatattatttacactcagcatattatcctacccatctttgtcgtcacgggatgatataccaatccacacctcttggcctcccatttgcactacaggtacgccatcctgcacctctttcgactctcgcatcccgcgtgactcctagacttctcttcatctctcgtccacacaccacctccttaattgacgtccactggtcgccttgttacgtcccctgacctatttctatctcgattctatccttccaccccttttcatcagctttgcctctcactcacctacatcccgatcccctctgagtcctttcgtatccatccaccatcgattctaatctcttactaacccaatggctaccgcactccccaccgtcactgattgcatccgcttgcactctcatctttcctccatcatgcctgccgcgctcgcatccatctcctccgcttctacatctcctgcctgtactcccgtatccaatgcctcttaacccctcattcatatcgccatacctttacccattcctatctgatcacctccacctctcccacctttagttccgctcacccccatccaacttcccttcgctttcctccacctctctttcaactgcaatcgtcattatgctcacttcccactagcgattagcttacacctcantctatccttcgtcacttctgccttctccacgctcccaatcttatatatccacccaatcattcctcaccttggctcacactctccacctctttattctccctcttcctgcctacccaccacttgcgaaatccc

SEQ ID NO: 74340 - DNA, 877 bp, Triticum aestivum
  unsure (1)..(877): unsure at all n locations
  Clone ID: PAT_TA_74340
ncgccggggcttctgttagattcgaatcgcgcccgcacttgacttagtttgagtgtttgtattgttgctgggcccttctcatccactttctttgttttcgattcgccctgctaccgttcatttctgcttcctcctttggtttctttgctttccttggctggccgtcgaatttttccttctctctgctttgtcctcccccctctctccggttgtctgcgtggctgtctttctttcattcccttcgctggtttctctggattctactttcctttgtcctcggttttttctcttttctctcctgctttccttcgttcgattggctttctttcactttgcttcattgtttgcattatctctctttgcctgttcgtctcctactcatgccatcctattaatcgcctccgtgtttcctctgtttgttttctcttccgttctatctgctctcggttatttcttcctttcccctttgcttgtgttctcttttttttgcgtttcgccgtctcctcttctgtttcgcttcccatctggctgctctttcctctggctctcgcctctgtctccccgccttcttttcttcctttattccgtattgctacgtgcatttttcatctccatctcgcttccgttcttgtgtcctctgttcctctaattctcgtgtgctttgccctcttggtttcgcacatcccactatggtctcccctgtctcccattcctattttgctatctctgattctccgtcttactctgtccgtctctcgcttgcctcatattgtcttaccgtgcttatcgtcatgtctctttccgcattcttcactatccgcaccggtgcttactttctatcccggatgntgcgactactgcctgtctgtcctttccg

SEQ ID NO: 74341 - DNA, 751 bp, Triticum aestivum
  Clone ID: PAT_TA_74341
tggttagggagtggttgttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggatgtgtttcgcagtggtgtaccaagtgtggtgggcgcggcggccatgtgtagtgcgattgtcatatccgttagtgtttcagtgtttgtcttccctgtccctcctttccttccctctgttatgcctgttggtcccttttgctaagtctcaaactgggggtctttcccagggccttgacccagcgtcccatggtattctgattttaaaaaatccgaccagggcgacggcctatgcagcgggttactgtttcgacagatggaccgctgtttcccgatgccggaggttatgcctcccaacagcggatctccgccctaaatcggaattgttatccaattttcactctggctcaacctcccccgacccacaagggaacccggttgaccctgtttcaccgggccaaaaaacggaatcggcccaaataaaaaaacccaatgtgaaaccccattaaaaatcccaatgtccctaaaccccttcggaggttggtacccccctctccctttttacccgcggtgggagccccctataattgtacccggtcgttttc

SEQ ID NO: 74342 - DNA, 542 bp, Triticum aestivum
  unsure (1)..(542): unsure at all n locations
  Clone ID: PAT_TA_74342
tcgttctataaaagcctagccaaccttcacaatcttatcatcacccacaacaccgagcaccacaaactagagatccccttcgaaatcgataagcttggatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctgatgacccgggggatccaccggtctagtactatatctctttgtttgattggcccccgatgcctataccactactacaaatggttgctggggctggggaaatggtagttgtggttgttggggggacggttgttgtggttgcagagggaatggttgttggggttgctgggaaattatttgttncggttgctgggggaatggttgttgcggttgtagggggaatggttgttggggttgttggggaattatttgttcaggttgttgaggaaatggttgttggggctgggaaaatggttgtt

SEQ ID NO: 74343 - DNA, 940 bp, Triticum aestivum
  Clone ID: PAT_TA_74343
tccgttgctcaatcttaagaaactttattgccaaatgtttgaacgatcggggaaattcggatcagaaacatcaattccaagcaagcattagtaaccacaaatccaacatgaagacgcttcctcatctttgtcctcgccatgacgatgagcatcatcactaccgctaggcagctaaaccctagcgaacaagagttgcaatcaccacaacaacctgttccaaaagaacaatcatatccacagcaaccatatccctcacaccaaccatttcccacaccgcaacaatattccccctatcaaccacagcaaccatttccccaaccccaacaaccaacccccatacaaccacaacaaccattcccccagcgaccccaacaacctttcccccagccccaacaacaattacccttgcaaccacaacaatcatttccccagccccaacatccaattccccagcaaccacaacaatcgttcccgcaacaaccccagagaccagagcaacaattcccccagcaaccacaacaaataattccccagcaaacacaacaaccatttcccctgcaacctcaacaaccattcccacaacaaccacaaagaccattcgcccagcaaccagaacaaataatttcccaacaaccattccctctgcagccacaacaaccattttcccagccgcaacaaccatttcctcagcaaccgggacaaataattccccagcaaccccaacaaccatcccccctgcaaccgcaacaaccattctcgcaagcaaccccagagaccacaacaaccatttccccagcaaccaacaacaataaattcctcaggaacccacaacaaaccattccccctgcaaccggaaacaaccaggtccccaaacaaacaaaaaagaccatttcggccagcaacccaaaacaaattaatttcccaggggaccccaacaccc

SEQ ID NO: 74344 - DNA, 716 bp, Triticum aestivum
  Clone ID: PAT_TA_74344
cctccgatagccatggatgagactgcaagttttaacaacacacagtatggtattacgactcagttaccagaattctcgatgcacaaaataaaaaatgagtcaggggtagtcatatacctttaagtaaatatctatggcacgataaaggccatcgtcgaaaggcctgccgtattcaagaacagcagcagctagcttctgaaacttcgatagcttctaacaaccgtcgcgcgtacactttagaagagatcagtctctcacttgctgactagtgcggtgaccttcaatgcggacccgccctggatgctgaatctatacaagagtactgggatgtacctagatcgagcaactctggatgatcttctgaagcctagcttctcaaattcgatggagacgctttacaacgtgaactgtatgcagcgaattctcgagcatttcgtcgccatggatcagaacaccgcaggaggtggagcttctcccggttcggctgccagcagatagtttgataggctcccccacttttgactccgatcacaacggtggccaagttgaccgacggataccctggcagaggttgccccgggcgcttatttgaagctcttgaagattcaggaaacttgatgctgctggccctgaatacaggaaggcttcttgcccatgggccctttatcggcccatagatatgtacttgaaggcctttgactacccctgactcaatc

SEQ ID NO: 74345 - DNA, 625 bp, Triticum aestivum
  Clone ID: PAT_TA_74345
ctgttgttgctggtgctgttcctgagctgagtgtgattggctagggttgcggatctgcgcgaggcgattcggggaggatttcggaggaaggcatggatctctcgtgttcagagtcgttagacctctcgcttgggcttcacccgcacgcccacgccccatgctcgcgtgcacgcgcgcgtcgccacgccgcttgggatgttcaacactgggacgacttcaagacggagggcagcgccgtggcggtggctaccgcgatgacggttacgacatggctccgaccaacagttttcggttctagggcaattgcttttgtgcaagcgcccgtgccggggtcctctatggcgggcggtgggggaggggagaacccgctcctggtcgtactttgtccgtcggcggacatgcgtcccttcgaaacttctctaatctttgggcgctctatctcgaaagcgtcgaatcaccgcaattcccgtgccttgggggaaatactcccgctctgcggagatccctatcgtctactagcacccctatctctctatataatcgcgtaaatgtatcgcgacacgctccgctcattctccgcactttattgcgcctcatgtataaccttatattgccgcgccgcgcg

SEQ ID NO: 74346 - DNA, 1015 bp, Triticum aestivum
  Clone ID: PAT_TA_74346
cgcaccccttctcttctcaacttccaatattaccatcacacattctcataactactaccccattacccattcacttaccactacattttaacttaatactctattattaatatatctttccctacactacttcatacttctcacttctcaactatatcacactcaatatcttccattacccccaacccttctatttttactccatacttaatatcacatttcaaccttttaatcattttactaactacacacaactttaatatattaactttctactctatttttcctcattcttcttatatttcacttacatataaactttttccacaatattctacctaaatattcattttacacttaattcaaactcctttctataataccaactatccctaatatctttcttattctcacatcaatatataactattcatctaatctaactcctcattcatcctccatacctcattctataaaatcttacacacttacctatcctaccaacacttttctctacactatctctacttcttatactctaaccaacttctcccaaaatcttctttctacatcatataatatataacttatacaatctatcaacattctatactcctcaacataatctccactatcttcctaatcccactctattcacacataactacctcttacctcttcagatatcacataacatctctctaacaactacttttaaactctatactcctcactattcaacatcaatctcctactctacactccttactcctattaataccttcctactacacttacactacttctactacccatacttatcatctgataccactacatatcactctaccattctatcctataactcatcctatacctcataacaccactcattaatatactttactatcaccaattactctaattactactttacactaaactatgcaactctcctcaactacttctatttacactaatagatcatctctacaaccatcatatatatcacacg

SEQ ID NO: 74347 - DNA, 1311 bp, Triticum aestivum
  unsure (1)..(1311): unsure at all n locations
  Clone ID: PAT_TA_74347
gatggcaatagataacgcaaagacatcatggacaccaactcattcaatcaatcctcgtgacgggttaatgaaccattcgtgcagccgcccattatgcaaggttcgacacctttagcggggcctaagattactcaaaggtgctcaacaaactagaacataacccagtttattcctgccaaggaacgtccatctcatatccacattgtgtgtattcgcagggtgaatactctgcgctgaacacgtcacgatgctactttatgtgctcgtcgtcaaaaatctcntcgcgcgatgagcgataataacatatttgttcgcatcgcccgccaatgacgttctaccccctacgaatatcctgattacgattaaatctgttggtgtcgccccacagggctcccttcacagagatgaatgaccctcagatccantttgcaattaacaaatatgtatggtgagtgtaactaatgtcgacgtctcatattcagatactggcgagttctaacgcgcgctgtgaataatagcgccgtgctgagttgactaaccgctatatatcttcggcgtgagtgacgacacaacccgtatctggtggaactatacgtcctgcttttttatgttcagctgtttgtaacactatctacacctgtgtacgnctccatattggctgacgccctattctctgtcgtccactaattgtatcattcacgacgtgcgtaatatacactcacaccgagacaatataatacttctgtttatgatgagtgtcgtacactatgtngtcgccccgcttaaatacgccgtatacgcgagaagttntttcttcccctcgggtgccagtgtgtcactctcctctagtggcctagatatcgtcccatcgcaantcgcgatgtgttttgcaaatgtgtcccgtgcactcttatatcgtagacgtatacacccatgtgcgcgcgtagaaatgtacgtaaaacccagaatgttattgcgctagcgatgatcaaatatccattgcgcgcggtattactctctcagtgtgcacatatggtattattttgtantctgttctctttgatgcagcaacacatatatgggcgataagatctacttggttgtgtctgcattatggagtatggtccatataacactcatctctgtgcgacagaaaattatatcactttgtgcccacatgaaagacagtattatgcgccacagagtgataggcgggagatatccaaattggtgtgcgcgatacacaacctcgtagaaacctaagatgtacacttatagtatacattctaagttgtggcgcaatctactccc

SEQ ID NO: 74348 - DNA, 1059 bp, Triticum aestivum
  unsure (1)..(1059): unsure at all n locations
  Clone ID: PAT_TA_74348
accacgtcatcctgacagcgaactcatgaaccttaaggcgcaactcaccatgaagcgacggtcgtggctaccttcaacggttaggctttttccacggtgcgtcgaacgaacgcatggtcatccactaccgccattacaatgcgccacgatttatttttttgttcggnctgacaattaaaccccaagcattcaatttccattcaagaacttcaatctaattctccgaatcttcggtgaggtgcacagcactgtccatctcgaccctccgtggatacgcctgactcctcttgagcgatttttatcctttccccgcggagacggaaataagattttttggggcggcaacattggaacagtgcttgagagagagacttttccaggacccgtagcccattagacccagggggccccgcctccctatcaaggcgctttcactacctatcgccaacttttcttcaaggccttggtccacgctccaaaggcacctttctattcaattgtctgccccatataccccctcttcatatggcccgcaatgaaatgttccactgtgtcctagagttccccgaataatattgtttcgggtgggattgggtgtttccccatcgcgaggactctcgcccaacaaagatgtcctggaggggtgggcctattaatcctcctttatgtcggaccgggggggggaatcgaaatataaaaaaaccccatctttggtttggtgggcgtctaattcggaacaaaacgggttaaaaataccttttcaaaggccaaaaaacgacgtttggcaccctgctttttaaaatcgtaagggagggaatccccaaaatcggccaaggtgacacgcgataggccttatttttcgctcctattccaactcatgtctttgccttggctcaccatcccaaagattcgttgccgcctcttcgatagcaacatatatcttctggcctcctacacaaaggaagtagggctcgccactatctttttatctccgccgaactaatataaagaatggtgaataggggtattggtcacttagaatcttcccgttaaaaaaag

SEQ ID NO: 74349 - DNA, 1201 bp, Triticum aestivum
  unsure (1)..(1201): unsure at all n locations
  Clone ID: PAT_TA_74349
ccccaccccaacactatacttcctactcacattccactacctataactttacaatatctcacacccactttcttactatccaaacatttctctattccataaataaccattctttcctaacacttaataacctccatatcaatcttatacacactcatcattatacaatttctctttactctcaccttttctttatctactcctccatctataaacatccaatcctcataactccttattataaacaacctaatctacatttcataactcgatcttacccaactcaattcattccttctatatcaataccatacatttctatattatatatacatcattctatatattcactcccatctcatctatcacataagtgtctataataattctcataatctcttccctctttacttactcactactaaatatcttctctttcatcattcactactctcatttcgttcacaacacttatatactcactatttcttcaacaaccctcgtaatatgtactctaactctaaaacattaatctcttctgttcatattctaatctcacataataaatatttcattatataacatttctcccctcacttatatatatcatttatcccatcccctatcataacaacaataattcacacatcatatttctatatattattaatcaatcatatctttcttcatctctcaccacattttatttataattagtctaacattccattaatcattactacatcaactcatttcttattaaaatacacccatatcctacctaccataaaaaataataatccctatatacttcccccacatttttcactttccatcctctattctattttacctctttctacactatatcacttacctgataatctatgcactacaaaatctcaatatcttcaactctctacttaccaaactcctctcttcatattctcctcttttctctctctactcattcctataaaacaacctattttcttttctagatcttattgtactacacatatctcctataatttaatcttcactacatactaactctatctacatattactcattaccactatcctcacattcatcattacttcttacataaatcatccaccactcacacatatatccttctatcattattanactcaattctatcaacatgttctaatacatactctcttttctcccctt

SEQ ID NO: 74350 - DNA, 1026 bp, Triticum aestivum
  unsure (1)..(1026): unsure at all n locations
  Clone ID: PAT_TA_74350
gctctaacgcggtcagaaaaaaacgcgcgctgcagtttgactaacggcccattggataatacatcacgatagacgctacactgactgatagcatcatgtcatctgtgcatacagtctctatgtagatacatatcgatggcacccgccctacagcatgcgtaagcgcatgtataactaagcgcgcactcgcaggtgcgtgacttcgctatggacaccactacgtcacgaagagatggctctacgatgatatgctcttggagaacgagagcaggcgctttatccacatatgaacgttcagatctctgtggtgagcacgtctcaccatgaagcagatattcatggatcgaaacgggcgacgagncctgcccagcctggcttcgattcatagggttcgccctcgcagcttttcgagatctcccgttgcggcaggcaactaaaaacccactaaatntcgatttgttcctaaaaaacatggtccaaccgccgcctggcaatgaattgggaacaacttggccaagcagggtaactggataacgaaggttgccaaagggtggaccaagtaaaccccttggtaaacctcttgtccaaacaggaccctcagnaagattccaatgccgagcgggcaaatggtccttgggggncccttgggagaaactcctcaaactcgttgtcccccagagggaagattggttgtgcccctagatgaattggccttaaccggcncccaagaccttggtttagacaccctaaaccttttaggtgaaaaccccgcatccgttgaaatgtgggaaaaccaaggaacccgaatggtgcccaaaactgtgaacgcccaaacaattaagaaatttgaaagcgtaacgttnnatctccccccttttacccttcaaccggtgcgttcacaccncagccttattggaacaccttacccccttgncgtcgcctttcttagcatttttaaccccctggatccttccctttttccccacttctttcaaatacacaccttcgtggaaaaccggggtcggg

SEQ ID NO: 74351 - DNA, 1116 bp, Triticum aestivum
  unsure (1)..(1116): unsure at all n locations
  Clone ID: PAT_TA_74351
tttcaatcacgaccctccctcactctccttcaagtacataccacatatccgtctctcacaaaccatactaacacacttttcctcacccccaagatacaacaacaacaacctagtactttcacatataccctcccaaacgcaaaacggcaacaccctacatatcacaaccactatctacctttcaccaactcctcacaactatctgaccatatacacatcctcattatcacctccactctattgataccatctatataataactaccttcacatatactactccaaatcaactacccaaattatctcttcatcatccacccgaacttatcctcaacatgtcactcaacactggcgactcttttacttcacagcacactaatctgtcaactctaacccctactagaataatatctccatttaatacacacgaccaccacatgcgagactcactatacacactaatttcctccatctcttcccaagaaacacacctcgatatcatctcacattcttatcaatcaatatcattccatagatatcatactctcgcacaatcatcacacgacaacctcctataaccaccccactcactcctctatctctcatatctgaccacactcagaaccctactacctctattgtcaccaactctatcgacgcttctacatcgcgctctaaagtcactatatcgcgctcatcgtatattcacatcctaatgccatatccttttacaaatatatccacccttgcctatattcttctcaatataatgaccccacatacctaccccccaatattcactcattcataacacctctctcatactcactatcacgcctatctattctaatttcactacaatacatctacantactgccctctctactgctaccgtaatacccaccttctctctcttatatctacatccatcctcatcatcaggcaacacattacgcacatctctagctctctattcacgatcaaactcacacatcacgtcgcattacaataataacaaacacaacaatacgtgagtctcatatcgtacatacttatatatcatgatactaataaatctacgcattctactgactctaagatactatatcaacccc

SEQ ID NO: 74352 - DNA, 1148 bp, Triticum aestivum
  unsure (1)..(1148): unsure at all n locations
  Clone ID: PAT_TA_74352
gccaatttgggaaatttttacaacacaacacattacccatttcatattacaccccataaaacctcttcatatcgcactacacccaccacactattagaaaccattctctccccaacatttacctatgtaccatttttcccatgctccccacatatctccctctcctactaaaaaatccaattatttatctcaaacgaaacacaactacattaatctttcgccatcacctatttgctctcatcaacaccaccctcgaatttctcaatatataatctacgtacattcaatattactacttatatcactattggttcttccaaactcctaccaacatatccaatatccccacaattctctattacaatctgatatattccacnacacaaacatctcagctgtgtaaccacatactctcaatctacaatctcatatccctccacattattatttctcatcaatatcaccttgtcacatatacacccaatattctttctccacatatataatttcatcattcatatctctttataacattactaaatttcgtaccaacactatactcacgaccatattacatacaactctaatattactaacaacacactcaagaacaccttctctaatatacaccacatatatattctgatgacctcccaacacataattcgtttaacactactatacattctcaccgaatcatcatcgccctctctaataaacacacttacctatgattgtttttttcacgtatacatatctctcaaccatcatcccaataaccccaatataaatttcatggtacatcttcgaccttcaaatcacactatccatagttctacacactacttcctattaccgttcttattacaaccattcactcatattctaaatatattttttatgtaatcaatatccatagtactataaaatcgtgctatattattactacactaatatcccaatacatagtaactaatatttctcttcgcagtatctcagacatacatctcgctcgacccgctcactattcgaatttataccactctcataaatttaaccaatatagctcacttctattcaatacacgtatttctgtcactcaaatactaaaataatatttctccccttatagtccctacatatattct

SEQ ID NO: 74353 - DNA, 1100 bp, Triticum aestivum
  unsure (1)..(1100): unsure at all n locations
  Clone ID: PAT_TA_74353
cttcggggagtttttttaacggcgcttataccatataaactatacccttcaccactacgctctatattccccgcttcgaaccacactccatccataacatttaaaccgcatatgactaataaaggcacagacatagactcaacgtcatgcgctctatgcccagtcctcagactcttaacctcgccacccactagtaatgcaatgtacacggacaaccgccccgatccaagactatctctgcgttcttcagcccaagatcccactacactgaaatatacataccccacgcctaaagctactatacaaccctgactagatcccaaaatacctcttatcaatgctgccactcacaaaactacatagcattcctacccagttattacacaacgaccaaactacattcgtcctcatagnactgctatccacatcagcttaacatctgataccattgcttctagtacacacatctgagacacaaaacacgccggccaaggaataacctcgcgtactataaatcaaagacccgcataacacttttataattaatacggctcggtgcgtaacagcgtctaacgtgagattgcatatatccttgctcaacatacatagtgagctctacgtgtgatcataaccccatatatattctacaccagtattctgcgatagtccccaacgaatacgcgtgtccgtcggatttaatatgagctcggacctcaaccatacacctaattagactttatataccacgcaacgtgtccatctcagtataacacagcttctgaataacactttccatatcaattaaaactacttacctaaccttgcataatgcgaaaacacatatcctcacctatactatattcattgattcacaactgtaaatcgtgagacgtctatcttcaacatggttggaagaccaaaggcacttatatctaagttcatttcccatataaaggtataagacgtnccatatatatacatatagtcgcaactcgcatacaccaatttttctcgtataacatactcacactcctcacaactactaanacgtctttgcatagagtatcaagtatacaacctcgtaatatatctagtacacg

SEQ ID NO: 74354 - DNA, 1506 bp, Triticum aestivum
  unsure (1)..(1506): unsure at all n locations
  Clone ID: PAT_TA_74354
cgacggggcacatctaacagctgcggcacattttctaacacaaaaccgacaccgcctcatactttattctaaaaaaacaccacgcaacccgacgcaccagaaaccaacctacaaacacgaacacacaacctaaaaaacctgcccaaaaaaccgcatagaccacacacacaataatacgaaatatatccacagtaaacactcggtgacgtcgaggataacaaccatctaccattcatgcatacaagaacagaaaccatattctccacacacactatctagaccattagcatatactccgcaaataaaaacataatcagacagcatatacatatatgcacctatctacacatatgagcacgcgatgacacataatatgcgtgatnctcatgcaaactctaagggatgggaaaactactgactagcatcccactcaacacggcacacgatagacgtaaccatgatgtcagatagactacaatgcagcacggcaacaaatcataaaaccgcacgtgacgctatataaataataccacgcacactaacacatacgtctgcgcaaattacacaatctctcaacacaacgatcgctctgagcaactataaatataagccgctcagtattgatatatatctctcacaactaaaatatctcactagaacgaaactactacaatcctaggaccgactactacgtacgataacaccaaactaactccgcgcgatgatatcgttgcgcgcaaaattaaaactatagcagcgacggcactaatacatacatctctatcctaaaacacacacaacgtgacacatcgcttatcacatgtagcgngacacgaatacatcatctgacgcgctcaaaatagaactatcatcgcaagatataaatcgtgcggtcaatgacgatgatacactacatcctatgacgataatacattcacgtatatanctcttacgtcaacactgacagcaacacatacaggtagagacgataacttatatttaacacgcgaaaaatacatatccatcgctgatatcaaagatgacatcgngatcgcataacacactacgcgcatgcgatacacacatatgtgacaacatcaaatacgtgtcacgtataaaaaatatatactcgcgcgacgcaacacaacgtcgcgcgtgacacacttacgaagagcagcagatatcacctaagtgagggccgaataataattatcatacatcattcacaatgacgtcgcgtggtcgctagatgcttatagatcgacaatacgactcatgggatcacgatataatcgactacagcacaagtatatacaaacttacacagacgaatctcttaacacgacgctcgaggagactcacacgacgtacatagtatacganacacgcccaagaagtaatatcatccgctcgagcaggaatacggatgaactctatctccagaacgctccgatgcacgacactatatgctgtacacgtacatatatataaacaacacgacaaact

SEQ ID NO: 74355 - DNA, 1069 bp, Triticum aestivum
  unsure (1)..(1069): unsure at all n locations
  Clone ID: PAT_TA_74355
aatcctctctactcaccgnntggttgggtagaaggtcttttgttaagcagattatgtggatgtagataacatctattaagtctaagttttatttttatacaaaccgagaggtcattgtttttagtgccaaaactntgggtgagatcgaaacaacgcagagggaggtnaatatttttnattctggaaganagaggacactcttattnttgatatataagcgaaacgacactggtagtgnttagagatatacgaacgaaataaatgtgcgacatgatcgagttatagtagagtatggncgtcggagagaactcaatagtgaactcacgattgagtagttatagggacgctactttagcgtaacataatgtatgtagagatgaaggtcctatgtgaataacataaccgtcatggtatgggaggacggaacaggtatagtatgataagatgtatctagggtcaaacggaattagatcgtatagttatatattgaacctcgagtataagaatattttaggaggtttaatggagtaagaattttaatatcataataaaaaagagggttgatggtgaaaaaaaaacgtgattttagcttgaggagtattaaaataaacaaaaatatttaagagggcagaaaaagcaaaatagtttggaaaaaatataggtgataaaaaagaacatatttatacgatctcgtaggtttgttaatatggggataaaaaacctcaattaaagatagagccgccaaatattgttcgcgtcccagaatgtgaggtgtgataattagaaagaaacaatctccgtatatattatttctctgctggtataaaagaaatatttataaaaataaggagttgctgtacctataaatgtagaagaaaatatgattttattatgtntcactccgcgcgagagatatatataagagctctctatttaaatagttaaaaaaacactaagtgtgtgtntttctgcgtgtgcgagaagaggggaatagaatcctctcaatatagtgtataagtagaatgttatattttgtgtttttctgctcccgggggtgtatgtgatgttt

SEQ ID NO: 74356 - DNA, 1594 bp, Triticum aestivum
  unsure (1)..(1594): unsure at all n locations
  Clone ID: PAT_TA_74356
aaacatctcagagtcgctcctcccataaccaagtttcacacntcaaaatcatctaagatcacgactattatacacgcgnagacacaacgggcgcgtgcacgaatgatataacgacgtcaactacttgacagcacgacctcaactcacacgtcgcactactgcacgtattatactctgtcactcacntatacacgtatcgcatacatanatcttcagagcagacgtcacataacacgacgcatcggacgcgcaacacgactcacaacatacagactatagagtgacactggctacatgtcctgtagatctgacgattcaatcacacacattaacgagtgagataacactgactagagatcaaagatgtgatataatttataccttattagacactttcactatagatatgctcctcactctatactaccactctatctacagcgaatgtaataatagacaatacgtaacacacaacgcataaatgatgactgcgaggatatgacacacatacatagctgacgtccatgcgtattacgcgtatcacatacaaactacgagatgtagttcattacgctcgcacaacagatatgtcgatgactcaacgatgtctaatatcgtcaacgtgctacaatcatacacgataataantctactgatatgacgatcaacaacctatcgtgcacctaacctgtgctacacgatcacacganatgcaatatatgaagatctcgactttacttgtatctatcgtgtatacataacatatatatatcatgtcacctatgtggacaaataacgtcgatcgtcacgacaaatactagcgtcaaacgacgtancggatctagacacatcagcaggattatgacagtaaactagatacacagataatagtcgagtctcgatttggnaatattgctctcactacaagcgcatatctacgtgaacgctatatctcacatataaatgcagtacgcgatcagcatanatcgtcactanctctcacgctaatactcngataagacctgntcacatgacgcatgcgagtcagcgacttgactcgtctcatactaaatgatacacactagacacatcgatgttaaatacgcgctagactcaacgtctcactactgatatcaatattactataagatgttctactgtggtatgtctcacacgcagctctcgcacttcagtactactatgatacaacncgactccgactctatcgnacatccctgacattacgacagttacgacatatgaattcgcatcacgacattgactacatcaaacactagtcgatgcgtcttacagactcgcgtcacatatcacatgtaatacaactcgaccatcatgatgatcacgatgtacacgatgacacgtacgtctacctacacgtctcgtaatcgtatagtcanctatccttctatatgtgtctgtctactataactacactcaagtatatcaatcgtatgcgacatcgatacgcacactanttcagtagataaactattccatcacgtatcgacacacaaacacaccacatctatactatctatatgcgactaacttactactacgataaacancgacc

SEQ ID NO: 74357 - DNA, 1218 bp, Triticum aestivum
  unsure (1)..(1218): unsure at all n locations
  Clone ID: PAT_TA_74357
gtctatcaacgcgggggcaactctaccctcactatactgagctgcttagactagatcgcagcacacactgtgtgcactgcctgtgaccgtttactttggtagacagttaaccacacccattggcgccgctgatagctgctacactcgcgttagtatagtatttctatctcttagcgctagagtgacgcttgggcagagattacaacgatggaatatcgtctctggtttncgcgatacacgtctagattctagagaagcatatctgatgctctaggcgtcggngacaatctgactagcgctagtancagcacataatatctactataaccgtgcgtaggtcgatttatcgcttgcgtgctcacatggngtgatacagaatacatagcatctacaaaacatgcgcccgtngctaccgtactcttgtaagacgatgcatagtatacatgtctatcacgcagcgtcctctgcttagccgcctcatggacatataccagaataatgacaagctactcgtatgctctacctcatcgtgcgtgatcgcgctgaacacgatcagctacatacttacctctacacggtatatgtgagngctcacgattctacaccagacagtttcactcaccacggagtgttgcgatgcagtatagagantgctntnaacagcattggctgctgtactcttatcgtctcatcaaccgtgtatcacatctcgctcaggactgtcgttcatatactgtatgctaggacgcgtctactcgtcgtatgtgtggcacgacaggatcgtcgtaacgcacacatatatattcgattacgtgactgtgtgtctgtgggcggtattcgctatcttatatgttcgcactgaccacatctagcggtgcgtactcgtggtgaacataaancactaactgaggtgttgctgagacatgacgcgagctcctgactgtgcgctgnatctcacgtcttcgctgaaacatcttattatcgatagtctatgtgcgctctcgcatatcgtcgctacttacgtatcgctgacgtggngttacttcatttttgtctatatttccacatatntacatancgcgtggtattgatacgtcatatatcaccatgcgcgagactggggctgtctgcacatctactgtactagctactgtagtcgagtgcccgcacgtcactgtgtctacctctaacacatgcatcctatggtgtgtatcgctc

SEQ ID NO: 74358 - DNA, 1024 bp, Triticum aestivum
  unsure (1)..(1024): unsure at all n locations
  Clone ID: PAT_TA_74358
gagagagagggagagagtgtgagagagagagagagatatagtgagagagagagagtgagagagagagagagtgagagtgagagagagtgtgagttagagatagagttagtgtgagatagcgtgatggccattgagagagagggtcttctttttttttttttttttctcgggttgtcctctaaattttttttccttctccttttgtctttcttcattatcttattttaccttgtttacttcttctctcgtttaccttcttttatcttttttcttcctagtattactcctcaccttttttctctatctaagtgttccctacctgtctttcttctcttgtctctacttacctctatcatatatcctttttctctcttttcttctctcctataatcgccttttgtttctttactcccacgttgcgctatattttgactgtcctcattatgtcttaattatctcgtattatcctcatcttttttttacttattctttctctcgtcngtctaccgcgtctgtagattctctcttctcaccgtatcggtgtctattatttgtcgttgtgtgcgtataccttctctattttgagctcaccattctctcttttaagttgtgtttcttgttttttttaatactctatgtgttcatcctcccttttctatatcctctactctcatttgtctctacatcctctctatttttttgtctgagatatcctctaatctctacctcttnttttctcttttcgttctaacgtctatcactctctgtcgcacatcttttctcttttccatttcttatcctactgttccttctttcatcatactgtgaactcttatattggctcacgtttgttttcctctccatttctattcgtttatttgtgtcgctcgtaatcctacatttaccttttgtagatacttccgttcttctttgtactattctgtgtcgcattctatacagtatcttctgtttgccgtttctcttaatctttgttgcctcttatattattcatatgtcctctttt

SEQ ID NO: 74359 - DNA, 1034 bp, Triticum aestivum
  unsure (1)..(1034): unsure at all n locations
  Clone ID: PAT_TA_74359
gcgggggggcccacccacaaaacacaaaaaggggacgcgaagacaggggcggccacaaaacggaaagcggcaaaccgcgaacacaggaaacagcgacgaaganagagcgcgaaacccgaacacgagacacggggagcggggaagagacggacggcgaacgcgggaacaccgaagggcaggaaaaaacggaagcgggcacaagaacaagcggaagacgcggacaaccggaaacgccgcgacagcgcgaacggcgaaagaaccacaaaggaaaaagagcaaggcgaggaaccgccaccagccgaatatggcacgcaaaaaacggaaaaggggaaacggcgcgcgggcgaaacaaggaaagcggcgagaccgggaacgcggagaacgccgcaaaccactagggggggagggagaaaaaccacgaaaaggggaccccaagaaaacggaaaccgcgaacaggggaaggggcagaacaagcgaacggggcgaaccgagacaccggaccagagccaaaataacccgaagaccggcgaacacccgaacaacacggcaaaggggacaagcgcacgaaacccggaaccacacacgcggaaanaggaagaaaacgcaacagaacgcacgaggggcctcgcgggaccgcgcaacacgagaaggcaagagaggacaacgcgccgaacacggggcgggcgggcgacaaacggcgcaaaaatacgggaaacgcgcanaaggcgatggagaaactctcagagggcgcgctcagaccgcaccacacatgcgcacggaagacggaccacacgacgcccacaaccacgcgacaaagacggcacaaacatggcgcgagccaaccgcacgcagacaccgcagaacgaacacccacaaaacaaaagatgggcgaaactaacaggaacatagcgaaagaatactactgacccgaagagcacgcggacccaagacggcgcgccaacagcggggagaaagacggcgcgcacacacaaagagaacgcgagccggaggggcgcaacggataacaacagaag

SEQ ID NO: 74360 - DNA, 1097 bp, Triticum aestivum
  unsure (1)..(1097): unsure at all n locations
  Clone ID: PAT_TA_74360
aatggatcaccatacttgtgcgttacttcatacatgtgtgttatccttatggcgacacgctgtaagactagacatcccagattctgctgcttcgacgcacccctgttcgaagcaacttgtctacatccttcttattgtgctcccgcacacgcttcacaagtctcttccgcatcgtcacctccctccctttcaaatcccctccggttcccctaattcttgcccctaattcttctttcacctacaattcgatctctcattggcacaacatactccataactgcacgacactctctttgcgccatctctatcccatctctcttgcaaatctcttttctctcatccccacttccatctcccttcctatcccctatccccatcctaactcgcatactcatataacacccgctacgcaaaacttctntccccatctctcttctataccgccacttttctatctatctctaaccttgtctacttccattccgctcttcgctttcgactgccgcactctgcgattccccctctccgaaaccattctcccacttgcgtatctcctcgctatccctcttcttacatccatcttcggctctctcgcttccttatttctccctgcggcattcctcatacgccatttctactcggccattctgctttctgtacttccgactctctcctcttgcctatctttcttctcttcaatttgcatgtcccaatacgctatcttaatatgctgtcctacaaacttccgcaaatccggcaataccaattatctccctgcgcttcatccgctcctcttcataccgaatttcgctatcttccattatcgacaactaccatctttccctttccgcttgtatatgcacacatctcccattctgtcgaatacctcccacccttagctactcatccgtcttcttccacattcgccgtcatcttgcgcacctactaccaactcgctcaatcaccatcatcccacgtatcgatcattatcgtcgttatactcgcacctccggacttcacatgcctactatccctgtccatctccgtcaatctctccagcttcacctctcgatattctcgatacatactcgctcact

SEQ ID NO: 74361 - DNA, 1077 bp, Triticum aestivum
  unsure (1)..(1077): unsure at all n locations
  Clone ID: PAT_TA_74361
naatactccggcctcgattataagaatattaaaacccttcccccccccccttctatacccnntattttattactctattcacatactctatcttcctctcctttccctattctactttactaatatctcaccttcgacaacctccctaatctcctatctcaatcccatatcctttcttctctcattatcattacacattttcaattcacactctatactccatcttccatcaccctcttnnnnntaccattctccctcctatttcctcctctatcaattttcatctacctctatatctcactatcattttttctttctcatccccatctccactcaatcttataaccttatctgcttctgatctcttatttgtcctacctataacaaatcttactttttttctttcttcatacctcgatttacttccgcttctctattgccatcactcctgtattatcctncaattnttcattctttcttacttttactacatgtaccctttacaacactcattcttccctaatccgccattgtctccttctttttctacctcataatatcgttcacatctctctttcattcatacactccatactcctattccattttcctttccgtatctcccattctcctctacctctctcccactcatatctaattatctcctcttatctctctttcttctacttcttctctctctatctctttcttcccatttgccacttctgtaacgtccatccgtctactctcaatattctctccttctcttccacctcctctatactcttactctctcccatcccttgatatctcactttctccccttaccttttcacaacatttcttcctctcttccccttcctcttatacttctctatcaccatattactcttcatcacatacccattttttccctctcttcccagcatctccacatcttcctcttccctcctcctccatctttccttccttacaaccctacatttccccactttgcgctactcctgttctacactaatacctacttctcgtctctcgcattcattcctttacttctcnatccttctatcatctcct

SEQ ID NO: 74362 - DNA, 465 bp, Triticum aestivum
  Clone ID: PAT_TA_74362
aacccaaagggcacttggcaaaaatttatgggtggaccggacaaaacaaatggggaaccctataaataaagggcccacagggcacagcagcacaggcatcgatcaaaggttccttggcccaaagcaccccgaaaaaataaaaaatgggaaaaaaagggaaatcggaattcaattttgggttctgccgactcggacggatcgacggcacattgatcggtttttggaaatcataaaaccaatcgggcatggaaaaacccagttgtatcaaaaaatcatttttaggggcggcaaatttggaggggggcgacaacgtcggccattttttcaaaggggggggccccaacctggacaaggtccggaacccccttcctaataagaagcctcctccggaattcctaaggggggtccatgcctgacaagtatgccccgggcacaactcccgagggctccgcgctggccgccttt

SEQ ID NO: 74363 - DNA, 417 bp, Triticum aestivum
  Clone ID: PAT_TA_74363
aaaagggggaaacctgttcatgaaaatattattaaccttatatatgatgccttttgccccccggacgatcaaattttccctcccccgggtagtccaattcctcgccaaaaaagggaaaaaaaaaaagggttctattgcttatggcaaattcacatgggcccatcccggcttccagtcctggaaaacaacgagccccccccccatggcatgggattcacatcggccggccggacaatatctggatatatgcccccgttcgccttcccatgtatatataggagttaccccctggggaaaatccactgcccccatgtctcaaacttgccggaaacaaattcttagggccccccccccagcttgggggttccgtggaaccccccctccttgacaaacgggtaggccaggaggttctggagg

SEQ ID NO: 74364 - DNA, 145 bp, Triticum aestivum
  Clone ID: PAT_TA_74364
agctaaaccagggagattttatttaggggggcctgtttacaacaagcatggcatggcacctgactgctgatgcaggtcaggtgcatagataaggccctcgatcaggtagcggttacatggtatggtagtagtagatcgatatgat

SEQ ID NO: 74365 - DNA, 575 bp, Triticum aestivum
  Clone ID: PAT_TA_74365
catggcaaatcattggtggacatcccctttgggctgcaatttttaattttgtttaacttcctatctccacttacatcatggataacatacaacaaaatttaattgaaattcgataaacttctatcaaatgatatgactgtgaaaatcagtgcaggttatgtcattgagcatcatctactaacccttgaaagtgtgaccgtaatccaaactacaatacatgaattaccatatagctaccttatggggcatatatgccatatcctcatatcttcttgtttggcagagttcaccacttgcatagtcttgaatggagaaaattgaacatgctctcgtacaactgggcaatggtgtggaactccataagcgatggcgacgatgctggatacagttgtccgtccggcatgatggagaagcttcaagaactaattttttttattccttgcccaggatctggacaggataatcttgtggcggacattgggaggaggtaccagaggtgttctagacggcggcgtgcagtgggtggggaacaaaatcaagcaagatattcagcgtgtcttcctcacggacagtct

SEQ ID NO: 74366 - DNA, 578 bp, Triticum aestivum
  Clone ID: PAT_TA_74366
gaggaatcaccgggggggcaaggcaccccacctgaattatcatttctcaagcagcaagctgcaccagtacactggggaagcgagtacaggaagggtttaaaacgggtcctcacacccaaaatggagagttgagaactacagcctcaagaagaactatacagagatagttaggagtattggcctccagtccaggagtgagcttctgtcgattggcttgaggcgaaacgcccagtcggagaggtctgcagccgcagccttgacgaggcgggtgatggaggggcgcatgccttggaagaccacttggtgccggtggttccagatcctccaaaggagcagaaggcgcactgtcgaccagcagccgtcggcggtgggggaggcaggttttgcatcccagatcgatctgcaacacagcggttgggggatgccgagagctggccagagtgcagcgaccctgcaacagtcgaagagaagatggtttgtggtttctgactctttgtggcacagctcgcagacatcctcggaccgcatatgctttttgaggagatttgctttggagtgcactcgatcctgggcaacta

SEQ ID NO: 74367 - DNA, 607 bp, Triticum aestivum
  Clone ID: PAT_TA_74367
gggtagttaatcatagtgctcgggaagggatagaaacgccgaactgtgcaaatcaactgctgtagccactgagaatataccgtaaaggataaaattgatgaattacatacaatcaccacggcaacatccccaatatgacagcagccaatatactacctacatcaccgactgcgccccccctaatctatgatcacatcggctgacacttttgccgcctctgtgaaaaacagactatcacattcagctatatgtatgacttccttcaattttgctcttatagtcactaacctctcagtacagcagagcagagtggtgcagttcctgcaagccagctcccatcttctgacaaaaatgcatttcaccattaggctacctaagtgggaagcacattgacagcatcattgtcgcaggagactcacgaaccctagataccaagctttcaccgggcgagcatcaggtagcctaccccaggattttagtcagcctgtgttcagtgttgttgagccagcaagagaagaaacattttggtccatcatcgtttgccttttcatgaagacagcgtacagaagctcgttccaggtatcaggaactccaggcaagcaccaat

SEQ ID NO: 74368 - DNA, 547 bp, Triticum aestivum
  Clone ID: PAT_TA_74368
tgccggttttctcttgttcgttctggctcaggctcaccggcccgattcgtccatggctgttgatttctcccaccggtgtagcaagctcaccttgctcaggctcagatctgattaccagacgacctatgaagctgctgagtgcctcgatctgctctgctcctagtcacctggtgacacggccggccgcccggcagatgtttcctcctgatctccgataatggtgcaccgagttcatgtctccgggctggcgccccgatccatccatggatatatgttggtcttctcgggatggatggcgatgcacgcgctagccttgctgcccaacggctggtgaacgccgctgccgccggccggccgtaccttgcttgttgccatctcgcgactggccgtttctgatgtttccttctgatctccgacgatgtaccgagcatccacatgacaaggggagcacatcgtttgtcgagaagagaagaagaagcatgaagaggtgggcttaaagtggatgatgggccggtgggcgataaaaagaatgaatagctcgtccgct

SEQ ID NO: 74369 - DNA, 199 bp, Triticum aestivum
  Clone ID: PAT_TA_74369
gaaaaccacccaaacccatgcaagcaaacatccaaaggggcaatgcaataaattcagctttcaaataaattcatcaagggcattaaacaaccgaatgactgaaaaacattcaccttacatgaattaacttgaccgggaaatgcaaaaaacaaccttgagttagggtttgtacaacaacattaaaacttggctggctttt

SEQ ID NO: 74370 - DNA, 345 bp, Triticum aestivum
  Clone ID: PAT_TA_74370
gcaggggatcgatatatttccaactgtgtactatttgtggtattccgataaacagtttgaaattatcatgccaaccatggtactgacccaccgggagggttctttgcaattcaaaattatctattattcaaccggtcatagaatagactaaaggtgctcctagttagtacaccacccactatacgtgtgagccacttcggcactttccttgacgcacaaccaatgctcatcgagaaaaacttttttgcaacccatatgtgggttctatgattcattttaagagaatacaaattggataggaggcgtgcattgctaggtctcttacaacggtatatgactcccatc

SEQ ID NO: 74371 - DNA, 655 bp, Triticum aestivum
  unsure (1)..(655): unsure at all n locations
  Clone ID: PAT_TA_74371
gtaagtataaccttgtgatacttttctttaattgacattttacatgaatgtttacagcgtctcggtagcaacaagtatgaacaaaaatttgatgtacacttcattcacagtggcgtactcacatgtcaggtctcagaattaatgatgtccacgctgcagctggttcttcacccagtggttcatggtctcgatctcaacatcttgtttcatctctgatggatgcctatattgatctcaacttgtttcatttccgatggaagcatgcgatgttgtctcggcacacttgctccccttttcaccatggcagcctcgcctgcaggctggggtttcatgtttcatccagtcaaagactccaaaggagttgtattctgggagaaggcaaatcatgacaaccgcaggcagcaggagttcgatccgtgacagtatgggctaatcgacacctgctaatctccaggtatcaacaaatctgcaatctatccgtgccataagtacttaaactgttaaatgattgcgtttgtactgcaagtatccccatccagcatcgagaacacatgctcattttcggngaaattttgcttttggttcctctccacagatctgtcctgcaatgctgcagtctggactttgatccaactagaacccacctctttcctcg

SEQ ID NO: 74372 - DNA, 174 bp, Triticum aestivum
  Clone ID: PAT_TA_74372
ggggttataacaaagatacttttgatcgaaagaaggcacaggctgaccaagagagaggaccacaaaacgtcctaaggaaaaaagacaactcgacgattttgtaggagcagcatgcgcacatgtagcaacaactcataccgacaggatctttggattagcacgtataaacagcgc

SEQ ID NO: 74373 - DNA, 685 bp, Triticum aestivum
  Clone ID: PAT_TA_74373
aagaaagccctgccaacggcaagggaaggataattattagagtatacaaatgttgtagcaatgctagttagcatagatgagtaaatacatgagctttacaaaatacaacaaaaaagctcataccagcgagtaagaaacaggagccatcattctacatcagtacataagttaaaaataaagccaagtagttcataccctacattgtaaaaataggtgttacagcagttgagttgtagggcctttgtcttcgttaatcaacgaacatgtactacgcttgtagattatcatttctgagaactcctacttcctctttcaacattctgaggtgaagctaatgcagctcgtagtgccggatacttgaaaggaaagactaggtagcatcctcatggcttcatttcctaaagatactgtgaaagatctacaaaaattattataattggctaacgaacctaggaaagctatacatcagaaatgatgaagtggtgttcttaaccaaaaaggaacatattttcatagaacaaatatatatcagtctccttaatacatgtaatagcaactccttgtgcacacaatgagggcgattaaggaatgcattccagtcactttcaacataaggaaacaaaaagtagcagctatgatacttgacagcaacaggtaaccatcataagtaagctcatcacaaatg

SEQ ID NO: 74374 - DNA, 268 bp, Triticum aestivum
  Clone ID: PAT_TA_74374
agaatgggggcaaaaggcggagcataatcatagatgaaggcgtcaccagagttcatacttacacggggagacactaacatgcagggatatgtatggatagtcaaaacttgcattatcctactatacctagtacaacaggctgcaggttggcatatccatgaacaatggccctgatgagatcatccactgctcgactaggacaaatattaagcaattacacctcacaaaggcaaagcaattaatcatggagcgagtgggaggggtagaa

SEQ ID NO: 74375 - DNA, 586 bp, Triticum aestivum
  Clone ID: PAT_TA_74375
agaaacgacttaaatcatgccagccttcaatggcaccagatttccagatagctgactgtctgtaattcatcccctctctcagaaagagctacacatcaaaatggaattacaaaccattccccaaaagacggacggcgggattccacgacgcgccccccaggctgttgttctcacgctatcttcatcgagtcgtcttcaggcggcgacaactcaaccatctgcatccctcttcctgcaacggcgatgcggtatttcccgctcccacggtcatggaaaacatccagagtttccggctcgggcacgctgatgatgacatgggaatgctccgcgaatttgccggattggcccatcttccaacatctgattctctgatcaagtccagtggagaaagcccaggcgccgtccgtccagatacctttcactgctgaaccgtgagccgaggggaccgtgtgttggccaagtattttaagttcgccattgtcacaaggcgagcttaggcttgccgtgtttgctgagcagcccggcaggggtcctagtgtaaaaacaaaacactgaaccgcctgatcatcaccgccacttacgatgc

SEQ ID NO: 74376 - DNA, 360 bp, Triticum aestivum
  Clone ID: PAT_TA_74376
aaaaaccccctccaaaatgggaaggacgggaatattttatataaataataaatccaaaatttcataggccctttcctacaatccaaaggccctaatagaaaaatccctatgggtttaccaatgaaattcctttgttccaaaaaaaaagagcttaccctcataaaaccggaaaatagtctattacatttattaacaaaggggttttctaaattttaacaactttttaaaacgtagtatttcacacccccaacataaattttctttgcctccacagggggccgctcaaccactgtaatattttctgcctctacaaactcccattttcctagcagttgatcccacaggtttgaatttttggcc

SEQ ID NO: 74377 - DNA, 609 bp, Triticum aestivum
  Clone ID: PAT_TA_74377
atattaaggggcttcggattgctgtaatttgataaaaatacaacaaaacatgttttttttgtggactcacagatctcctatacataatctggttgcctatcttctcaggatagtcccgtttcatctggggcctgatacatctgaagccaaaggtggagctgaggagcatgcatctcctgccacgccaaagttcactgtagttgttgcaacaaacttataatctatgttgtttcccgtgtttatggtgccttccaagactttgacaacctctgacattttcggcctctttttgcaatcaatctgcaaacaccacattgccatcctcatcatccgaatcacctcttgcttgttcacttgcatgtcatcactctgcttgtcgactagatctgctaactgatcactcttcaccttttcttccaatagggtgataagatggatgctctcttcaggttgagaggtgtcgaggttctttcttccactgattatttccatgaccacaacgccaaagctgtagacatcggccttttccgtgatctgcgatgtcaaccattcaggagccaaatagcctggtgtgcctctcattctagtaaccacttcactcatatccct

SEQ ID NO: 74378 - DNA, 302 bp, Triticum aestivum
  Clone ID: PAT_TA_74378
ccgcccgcgcccccgcaacgcccgtcgccgcctcctctcctgccgccgccgccgcctcctctcctgccgccgccgccgccgcctcctcttcgtcggtgctatcgaagcctgggctacgtgagcgcgcgagccgctggtgatgctcgaggcgtgaccgttgggccggggacaggtgcgcgcgctcgccgcgacgggaacgagagttgtccccactccttctgttccccatcgccggcctcctctcagccttggcctcgttgctcacgggagagagagagagagagagagagaggaggagaagg

SEQ ID NO: 74379 - DNA, 587 bp, Triticum aestivum
  Clone ID: PAT_TA_74379
agtatcaaaaacgctcttatattatggaacggagggagtagttccaaatacaatgatgatacataagtccggtctcttatctgtcgggcgactctgtttgatgcctctaggaagtttcatccttcaaatagctctcccaacatcttcttgaaaacctcaggactgctgctttcgcggccaatgtgtttctctagctctggatgctcttccaggtagtcgccgtaacctgaaatgactctctcggcgatagctctctgcagcacatctctcagccgagggtccggaaccttccagaacttctgagcccggtaagttttttgaaatgctgactcgaatttggctagtgaagaggtgttaatccaacagtggattggtccaggaaatctcgatttgggtatgcaggataggacatgtccccaagaaacatcaagatagctatccatgaacttcttacattcaggtgtaaggttaagttcagaccgttgctcaagataaagcgataccgatggctcagaaacctgtgctacgaaatgggaattgttgagcaggaaaatgtacctcaggcttggatccgagcatagctctga

SEQ ID NO: 74380 - DNA, 357 bp, Triticum aestivum
  Clone ID: PAT_TA_74380
aggaaaccaaccccattagatgcattatcaaatatcctttcacatagtaaaaattggtgagggaaaagatttatattttcttcaataaactgggccagactttaggaggttggacttcaggcaactctaataggcgaaggaaataaaaacgggggggggccagaagatatataggggcatccgggcagtcgcagacaacgggaaagggaaaattatctttcggggcggccccttttcccctatcggaggagggggatctctgggatacaacgaagggctggacggggaagggcacctatgcctggcaaaccacgacaagggggaagaaaaaaaagaggttacacaggggaacaacaa

SEQ ID NO: 74381 - DNA, 552 bp, Triticum aestivum
  Clone ID: PAT_TA_74381
accgtacaatgcctgggccaatggcgactcggcgaccagacaccagacagtcttttgctttgaacaagacacatgctacggacacattacacagccagcacaggatagaggctgatgctacaccacacacacaggagaaatttcatggcgatttctaagtggagacaaagaaatttccgtggtagagcagtgcgatgcttgctcatgtccagagtccaacagccttccctccctgcaccaaccaaaggagaaagaaagggaaggcatggccggactccggtttgaccgtgcgacgctgctaccctagcacgaacgagcaatggagcatagtacgcctcacgcgcagcttgttgcgctgctcggcttcatgaccccgcgctggcgacgcccacgggccacgggcttgcctgccagccgctgcgcccgtggcgtggcccgcaggggagtggcgggagtgacgcggttgccgacgcgcgtggcctcgccggcgacggacgggtcggcggcgccgtcgcgcggcggtgagaaaacggcggggagccagtcgtcggt

SEQ ID NO: 74382 - DNA, 628 bp, Triticum aestivum
  Clone ID: PAT_TA_74382
acaaactggatgaactaattctttaccattccactagagcataaagaaaaggatagcctaacaaatctccgcaatttccaaaattaatacttgaatatagtgataatacaaatagaatgtattagtatggtcacaatgcatggttcaattctcttgggtccgtccgctcaatgccaacagattagcacatggatgcatccgcgggcaataccaacttctagatctcacgtagtggacggttgctctgaacatcattgtgttacagaaacaatgtacctttctcagcctactaccgggtgcggaatccatagaccaccatgatcctctatcacatcaaagatgttatacatcattagattagagtatgtccttcctttgataaattgtgtaacactctgaaaaacaacaaatattgctatccattgtgaacagagaaaagaaagaacaaattatcttcatactatcatatttatgaaatctttccctactaataaagcaaatagtgcttctgcccgtccgtcgctagcgattttgcataaaagcccctcaatttataaaaaattaacccgcagtcctattttaatgtgttactgcagaaaacggttggattttgcaaaaagccccctgc

SEQ ID NO: 74383 - DNA, 346 bp, Triticum aestivum
  Clone ID: PAT_TA_74383
aaaggcccgaggacatcgggtcttttttttttacaaaagggagccacaacccggtaagggggaaactaacgtaacacccccaagaggccaaagggaaagggggggtaaactggggaattccgggaataaggccccaagacccaaaaataacaggggcgcaaaaaatacaaacggggggcgggcgggacaaaattatccggaagggggcccgaaaattttaaggccgctcgacgagctttttaaatgtacttgaacagcacacctccgtacggggaaaaaaagggcgcaaacacaagggactcaagggccataactttgatgaggatgttgagcaacggccctaagg

SEQ ID NO: 74384 - DNA, 291 bp, Triticum aestivum
  Clone ID: PAT_TA_74384
ggaaaaccaaagccacattctttggggaaacaccggatcatctgatatgtatgtacataaatccaaatggtcaatacaacactgaaaaaacaaaggcatgacaaccatgtacggaaaaaagttaactgcattattccgtctttttttactgaaaacggacactgcctgtgggctaaaacagggaaattacgggcagaattgggctaattttatctacgggccaaagttcccgaaaaggcgctccacatcaacatgtacgtacccaaaaggggccataagtgcccggatatt

SEQ ID NO: 74385 - DNA, 591 bp, Triticum aestivum
  Clone ID: PAT_TA_74385
attttttgttggagtattatgacgctcatgagaccgatggaatttagagaatactagttcacttcagaacgaaagaaacatgtgcatacaacaacgaaagataagtccagcctcttatttggcggttgactatgtccgatttctcaagcagctttcatccctcgaatatctgtcccaacatctccttcaaaacatcaggaccgctactttcgcggcgaacctgtttctttagctctggatgctcatccaggtagttgtggtaacctgaaataactctcttggtgatcgctatccgcagcgcatctctgagcagaggatccgggaccttccagaacttctgagcattgtaagtttgataaaacgctgactcgaatttagtatgcgaagaggtgttgatccaacaacagagcaatccaggaaattttgatttcgatatgcatggcagcacatgcccccaagaagcatcaagataactatccatgtacttctcacattcaggtgtaagcttaattccatggttgtctcccgatggctcagacacctgcactatgaaataggaattgttgagcaagaacaggtacctcatgctta

SEQ ID NO: 74386 - DNA, 657 bp, Triticum aestivum
  Clone ID: PAT_TA_74386
atgtttgataaatttgaattttggacttgatgttttgaacaagtggcaactagcaaggtaatcatgatgacatggcatgattagtgggagattactgtggcatgaatctcggggtgttacactgattctgcttcctcactccgtacaaagacagccccttttttcaacagattggtcaatgagcgactgataataccaaagttgcggacaaatcgtcgatagtaccctgccagtccaaggaaccaacgaacctccctggcattggtgggtgtcggccagtccttgacggctgcaatattcttatcgtcagtcgatacccccgctgcgctgatgacatgccccaaataggtgagccttggctgtgcaaatttgcatttggacatcttgaggtaaaattggtgcttggctagcaactgaaacacttgtcgcaacaactcgcaatgttgttcaagagtagagctgtgcaccaagatatcgtcgatgaacaccagaacacctttgcgtagcaagggagatagcacgatattcatggtgccctggaaagtggatggaccaccagtcacaccattaggcatcaccttgaactcataatgcccatggtgcgtcttgaaggcagtcttgaattcttcacctggcttcatgcgaatttgatggaac

SEQ ID NO: 74387 - DNA, 603 bp, Triticum aestivum
  Clone ID: PAT_TA_74387
gccgaattcggagacaatgtttccaaattcagaattcagagacaatgttaaacactactaataaagtgccgaattcagagacaatgtttccaaattcagaattcagagacaatgttaaacattactaataaagagcccgaattcagacacaatgtttccaaatacaccaacatcgatataagtgctctgaatttctgtactatgaaccaaccaccagtctgaaccagtttcaaaaaaaactttacaaaattcaacggactatgcagttggattcaataacttgtgactgaggatttgcgccagcccgcgctcagtcgccgccgcccggccgcctccagatgaggtacagggcgagggcgatgagccccagagcggaggcgcacacgacgaagtcctgtaggctggggagcgcctgggcacccgcacccgctgtcgcctccgtgatggaggaagcagggccggcagcccgggccctggcggcgaaggcgatgagcgaggagcactcgaggctctgcacggcgctcgtctcaaacttggccgcgagcatctgcctgacgacgggtggcagctccaggccggagcgcagagccgactgcacccctg

SEQ ID NO: 74388 - DNA, 359 bp, Triticum aestivum
  Clone ID: PAT_TA_74388
ctcaggtcaaagttccagagttctgcctagccgtcagccgcacaaggcagcgagaagcaggtaaactctcaaacacctggattatcaaatttattttatacccgttgcaacgcacgagccttttgctagtctttgctagcgattttgcaggaaagtcccttggtttttgagaattcaatccgcagtcctattttaagtgggtacgtgagataacgcttcgttttacataaacacccctgcattagttataattctaccccggtccttaattaaactgcttcgccgccgggcaccaccaccgcttctccatttgccttctccatcgcctggcacaggctgcagcttgctgtcgccttcca

SEQ ID NO: 74389 - DNA, 400 bp, Triticum aestivum
  Clone ID: PAT_TA_74389
cagggccaataatttctgtattaagcaaatataggagtagcccttttccccaaaagtagaagccgtaaactctacaaatacctctagtactactctgctcgcttcccaaatcgagaagaaggcgactatctacaacttgacagtatcgctaaattagtcgaacaagcagttccatagcggcgtctggacgccgatctgctcgccgctctccggcctggctctttcgtccggcggcgctacgagcatcccctgcgccaagctcgctgtagtacgacccgtcctccatgccgccaaaccactgctcctcgtccagctccaacaggtcgccggaagacatgtaaaactcgagcgccaggcacgcgactggaagaatgatctgctgctgctggagcgccacgac

SEQ ID NO: 74390 - DNA, 475 bp, Triticum aestivum
  Clone ID: PAT_TA_74390
cacaaagtaaaagacaataataacattacgattcattctacacttattacaatgccaaaacataagcatacaagctccgcttcaaagcgccgtcaatagaacagaaaagtacgcttttttcttcacgttgaaagggagtgaacttcatccatcaacttgtttcatcatcggcgccaattgtaacttcttatccaagcactttgggcatccgcgctccttccacaaattttctttaagagtattccttatgtagaacagcacaaggggttagaagaccacttacctaagggtcgatgtcaaattgttgcttgaaatacactgcatttatggttttctagacttttcccaacaaacatcctcctaacatgtaaactaaaggtaaatgcacaaaaatccaccttccatgccagtttagctagagcacaaccaaataccaaatggtccacatattccttctaaccacaattgtgatacc

SEQ ID NO: 74391 - DNA, 493 bp, Triticum aestivum
  Clone ID: PAT_TA_74391
aattcgccccgaccccgaggcctcgcccggcccgctccgactgctcgcgggccccgcacgccacctccctccttaacctccggtgcggcagctgccagaccccttcttcctcgcagacccggcggctcatcctccctcggagaaggcgcgcaccggccggtggtggagagagggggagggtgggagaagcggccgtataaggatctctccgcgctctctcgtctctctctctccggttttacctatctgtatatcttttttttttgagggaaacctatctgtatatctatttatttacgtacgtacggttcgtgggccgggctgaggagggggaaagcccgctgctgctcttgttgttggtctgctcgatgatggcgggagcgacgtcagccacggccgccgcgggcgcattcgccgccgccgctgccggcgccaaggcgcgggggaccgccaccgcgtgcccctgggtcgttgccgccggcggccggaggcg

SEQ ID NO: 74392 - DNA, 459 bp, Triticum aestivum
  Clone ID: PAT_TA_74392
gggggcagaatatatatggatatagatactgcttttctgtgtgtgcaatctgggagttctatgaccgattcacactcttctgtggctgcacctatgttcaaccagacaaagcccttggaggctgctgctaattcgtttgtgcttcgcgtgctccagctattttatcggtgaaagtggcgaacgcgaaaccaaaatctgcatccttgttcctgaatcctgaattcactcattgcagtttgtgcagcatactaacatgtactaagaatgttttgctgtttgttgctggatctgatgctcattcatcctggggttgatcgtcgccgccttcgtcctcgacgacctccaggggcttgaagtgcttcccgtctagacaggtacgtgccgacggcgagccgcacggtccacacgtccttcggcttccgcgccattatcctcccgacgtcgccgcgcttgacacgg

SEQ ID NO: 74393 - DNA, 339 bp, Triticum aestivum
  Clone ID: PAT_TA_74393
aaaggcacaaaccaaaattttttccccaaacccccatgggccggttttaaggggggaggcaataaacccccaccaacaaaggggggggggccaaaaaaccgctccccgacccataaggttttccttttaaaaaaaaggcccccaaccaagggggacccatttaacccgggagggggggggtccccccgcctaaagaccgaacccgggggggaaacaacccaattgggcctggggggggaagggggccccaaggaggggggcctgggcctcgggccccttttttggggactggccccctttttggttttggaaaaaaaccctaaggaggggccccagggg

SEQ ID NO: 74394 - DNA, 268 bp, Triticum aestivum
  Clone ID: PAT_TA_74394
aacggggcaaaccataccatacaggaagaaccaaacaaagagcgaggccacaacccacaggccattctaattacgaaaaaacaggctacagggcccgacgggaggaggcaccacagggttcctcttaaataataggcgctcgggagaagccctgggaaactaaaaacaggaggaccacatggataacggcgatacaaaggagggccagggccgaaactatcgaccccggacaaagggctttccctattcctccggcccgggggaaggg

SEQ ID NO: 74395 - DNA, 129 bp, Triticum aestivum
  Clone ID: PAT_TA_74395
gggaaaacgctgggggcttaatatttaatgggggaccaattatgggagccaacactaacggtgcgttcatgaaattaggaagaaaagggcccgaatattgccgcatatatttccccccctatacatatc

SEQ ID NO: 74396 - DNA, 718 bp, Triticum aestivum
  Clone ID: PAT_TA_74396
aattaaaattgatgatcatacgcctgctacataagatttcttctctgtataaaaatgccccaagaatacgttacatgatttttctcacatgtcgaaggtacttacggatgagaaaataagcatgcctttgccttggcagttagtgtcttcccaaatgattttaatttcatctcatcataggtgaaggcatttagtttaaatgtctcgcatatctcaccaaatagctgcacaagttggtatgttgatctcgtaagtttcaccattaggtatccggcccaaggaagtgaagatttctttagttgaccgaactcggccatggttgcgttgaacctgcaaaataacttagtacacaaaatgaaccaaaacttaaaacaaagactaaaagcgcttagctccccggcaacagcaccagatgatctgcaagtggcacatagtttggttgtagatttttttgaactaagaatatcgatcccaccaggaagactggtggtctatcactcttgtaaggatttatagaaatgtgcatgtaagtaagttacagcacaaagcaaagcgaaagagaaagttgaatatcttgcaaatgatttgttattgaaagtaaagtgtgagattatataaaagaacaacatagagtaaatggtggtgatgaaatcaatagggtaaggctttctcaaggagtctagattccccactagtatgtgtctaacaaaacttatgc

SEQ ID NO: 74397 - DNA, 603 bp, Triticum aestivum
  Clone ID: PAT_TA_74397
atagctaagtatcaagcatacaaactgagtgacacatgccacggttcagctcacagatcaccatgtaacactacaaacacaagtctgaaactgaacacatacactctagaaaacaagtacgaaactgagcaaacaacaggttttaagtactctacgaatctgaaccttacaaagtcttaaacatctcgcaatactacagaaatttagagagagagagagagagagagagagagagagagagagataaggcagcagcagcaggcaaggaggaagaagcgaggcagggggaggagcagcagcaggcaaggaggaagaagcagcagggggcgttgggaggaagaggagaggttcagagaagagggcagagcagcagcgaggtagggagaagaaagagcagcaggctggggttcagaaaagattaggagcagcaactagaggcaagggaagaagagagcagcgacaggagaagaagaaaacagcagcgtgatgagggaatgagcagcagcgtgagagatcagcaagggggcgcagtagaagaagagcagcagcaaggtttgggcaagaagaacagaggcgtggggaggttagaaagagagcagcagc

SEQ ID NO: 74398 - DNA, 226 bp, Triticum aestivum
  Clone ID: PAT_TA_74398
cggcctcgaccggggaatttttatgcacaaagacaacgggcgggttccaaaagtcatgcgagttccattcaaaaaacgatcatttattttcggccaccattgccaggcccagcaaaacaccaaacaagacatgaaggggcacgccggcgtaagctttcggggatgctgttgttcccgggacgtaacacgagctgttttgctgttgcacctgctgcgggccccccgg

SEQ ID NO: 74399 - DNA, 489 bp, Triticum aestivum
  Clone ID: PAT_TA_74399
tgccgctgtacactagtgcttgtgttctcgtcctctttgcttttcctttggcgacggcggcggccactggccatggacgatgcggcggcggctgccgcatccaagaagcggaggcgggatctgccagcacttggggatcctcccgccagcagggagggtgccggcggcggagacgatgcgagcctcgacctcatcagccgtctccccgacgagatcctcggcaccatcatctccctgctccccggcaccaaggacggcgcgcggacagccatcctctcctcccggtggcgccacctctggcgctccgcgcccctcaacctcgccgtcgacgacgccctctcctcgcaggagagcgagcgcatcgccgtcgtctccgagatcctcgccgcgcaccctggccccgcccgccgcctctgcatctctagcatctttctcggcggccaccatcacgccaggttcgacggctggttccggtcccccgccctcggc

SEQ ID NO: 74400 - DNA, 538 bp, Triticum aestivum
  Clone ID: PAT_TA_74400
gctacccaaagcagaacatttacaaaaatatttgaagtttttaacatttacagaagaaaaaatttgacgagcagcagcaaatgctatccggagcagaatttgatatctgcccagcaatggcttatcaaacatgcgaaacttgtgagtccagtttctgtctgtggcacaccaaatacatcgatgaacccaatacatatctgcctaataaaacgtcaagcaaccggaacttggcgacagatgccgaggacatcatccaagggtgcgtgatcgccggtcccttcatctctccatgcgtacagcagttcttttcctctgaacacaaacatcccaccctgctgcatgacgcccgtcaggtctgccggtgtgcctttcagcgtgtagttcttggtcgcctccttgatggagtcgagcctcgagtatatttttgcactggctggactgaagagtgtacggcctaatccgtggtacaggcccaagacattgtaagccttgcgctcggggtcggcgtacaagctatccacaggaaatggcagcccgt

SEQ ID NO: 74401 - DNA, 529 bp, Triticum aestivum
  Clone ID: PAT_TA_74401
agcagcccagtttttttttaagaaatttgcagcccagtgtatacactaaggagcctacggaagcccaagcccactacgaagcacccctgagtaaccctagcgagtgcgtgcacgagatgccggcacccctgacttcccccagcgcgccgccgttctcgccatgacctgacgaagtcgtcgtcctcctcgccgcgcccgatgttggacggctctctctctctcggcaccgccggcagacgcgcccgttcggcgccgtgtcggacgtcgtcttcgttgctcccgaggttcatcgccaagctcgccgcagtccctagtgtcctccgccccaagcacaagcaggttttacttccatggctccctctggcggcgcgcatgcactcacaccgactgctagcacgcacacttcacgcatgcattagcactagctgactcacgcacacatgcactgcagcactggcacactgaatcggcgcgcacacatacagcagggcacccacgagccgctcggtctgaaccgagccagatgcaa

SEQ ID NO: 74402 - DNA, 283 bp, Triticum aestivum
  Clone ID: PAT_TA_74402
aaaaaaaacccccccgggggggggccctttttccccggaaggggaacaaaattccccttccaaaaaggccaaggggtttaaaacccaaaaccggggaacttttttaaaggccaattggcccccaaaaaattggaaaaaaattttttggggggtgggggaaaaaaaaaatttccaaaacaaaccctttctaaaaattttcaacggcccccgggggggcccccttgggccaaattttttttcccttgggaaccccctggggaaagggggcttttggtttcaaaaa

SEQ ID NO: 74403 - DNA, 524 bp, Triticum aestivum
  Clone ID: PAT_TA_74403
gattcggcccgggagcggagtccgacaagatctccgtccggcgagactcatataaatggctctcagaggcttttgggttttgtcttgcaacaaatcgcaggctattacaacgttttgatcgatgtcgagctcaatttcatccgaggagcagcggaaggcgatgatagctgatacggccgtaattgacgatgatgcacccagcgcggggcagcaaaagggggtgataaagaaaaagacgaagaagaagacttttcggctgccaaacgacgagttggagctaatcttggctttcaagccatccgtacattaccctgatcccatcttttccccggtgctagaggaaaagctgcccgacaccgttcggggagtgcggcccaccatggcaaaggctgatgcgcaagccgaggtcaccgacgacgaggaagaaatcattcaagttcctagacgtggacggagaagacaccggccctgcatctcctgtagctgcaatcttatggacccatccaattcaatccctgccaacg

SEQ ID NO: 74404 - DNA, 635 bp, Triticum aestivum
  Clone ID: PAT_TA_74404
aaataaaccagatagctttatttcaaatgggagaaagatgcactttatacttgtatatcaacattgtgctccatgctggctgtctattctgaattttcttttacaaacgtaagagtgtatactcttaagatgaatggcatttctggaactccaacccataatggaagcagtttctggagcatatcaatcagaacatcttaccagtgccatctttgcgcgggactgattcttcaagatccattctgcgccagctcccagccaaagatgacatctgatcaaccttgtcatacaacccaagaagaccgcctgtatggacaaagaggacttttcgccctttccacttagatggattatcggccatgtcttttagcattgcatatgctcccttcccactgtagactggatcaagcacaatgcccgttgcagtagctatatctttaacaaacttaagctcctcggctgtgttcatggcataacctaagcccttagcattttgaatgctgactatatcatgtgaatccaagccagattgtagtccatcaatcaggccttgaacataatcatagaagtattcagggtcatcgcaaacagagaaagcatggacttttgccgttaagctactcaattttgatcct

SEQ ID NO: 74405 - DNA, 435 bp, Triticum aestivum
  Clone ID: PAT_TA_74405
aaaaccagcccaaaagggcattcggccactctcactggccgggagaactacctttcacagagtccatagagggaacctatatccaggggggggactaacaaccccccccaaaacattaatataccccatatgtggcaacgtcccccctccgcccaaaaaaaagggcccttccttcggcccaaaaggcaaaatagtatccggcaaagccaaaacttaactctgattggccttggcaaaacggcccttgattctaaacctgctgcccgaacaagctttggggaactaatatcgcaccggttggaaaaatcccctggccccccttttttttttatagcggaaaaggacaatgtcggggtcagggccagcaacaacataaaacccacttttttggggaaaagcttgcattggcatcccaaaaccagaattggccggggg

SEQ ID NO: 74406 - DNA, 568 bp, Triticum aestivum
  Clone ID: PAT_TA_74406
gactcgctctgtcacgacctgtctgaatcgtgccagttgtacattgcatacacgtcaacgttgaaagcttggacgaaaaccaacaaaaactattctttcgaagaaggaaggaaaaacaacaacaaagaaaatgatgagtttgtcctttttactttgtctttggatctccatccctcaagctgctatcatcttgttttgcaatgaacggcaaactgatgctgatggagactgattaaagcttcattggcttcatttggccagagagcagagcaccataataaacgaactcataaaaagcagaggccgagccaagaacggtgactaagccaagaacgccccgtcggcagcacgtgcaccggccggcgccgtcacctggccacatctccggcagctgctactccctgccacgacaactaccacggtgggcgtcgccgctggctgtacctgcatctgcatgggcgtggcaacgatggcggcccggcaggacgggcacgtggcgcgagtccggagccaggcgtcgacgcaggcgacgtggaagccgtggccgcatcccgggagcacgcgcacg

SEQ ID NO: 74407 - DNA, 578 bp, Triticum aestivum
  Clone ID: PAT_TA_74407
gaactccttcataactttatatttctacaacatgattggtgcaaaagtacataactaaagagtatcactaaatactgtaactgttcttccagcccaacgtttacaacaggtgctgacagtaaaagatattctactgcatgaagaacgggattacaaagttatccatcttctgttttctctcaagctcttccttctcagcgatctgcttcagtgtagtccacccttttcttttccgcttccttgaactaccagctggctgactagaatcacctggtgcagatttggtattcgaagctgacttgctataacttccaggggtcttcccagcaacggaaccacaattctgtcctttgctgttcagtgtacttttagtcttcaatggttcttctgaagctataggcgcagtcacgtccaccagtttgctcttccgaggagtaacaaagtttgacccaactagaaattctgcttgggaagtgacatcgggttcacatgttgtagtatttttggaagccgcgggctcaattccattcatacatttatctcctaacagaccacaatccaccattgaggaaactccc

SEQ ID NO: 74408 - DNA, 161 bp, Triticum aestivum
  Clone ID: PAT_TA_74408
atctagcagaacatgcttaaaagatgcactcgttgtacagaaatttgcatatagcagaaacatttatactgatcaagaaaactggactatgcaactatttttacatcttcaaaaagctttaaatgctacaaacaaatgccgaaaagaaggattatgtcttc

SEQ ID NO: 74409 - DNA, 714 bp, Triticum aestivum
  Clone ID: PAT_TA_74409
gaattcggcacgagcggggggcagctcaacaaatttgaagtcttaggcagccctggtttctttgctggttgggatcccaatcccagacgggctttggaggatgttgggactctacttgtttcatccacactgcgggagctctgcacggatgacgtcgcgggactcctcgcggcacccatctacagcttcctctcttcctccctcacaaaattgatacttcgtgggtggggctccaaggggatggagcgcttcagcaaggagcaagaggacgcccttcagcacctctcctccctccaggaacttgagttcagaaatttcagcgaccttcagcaactccctgcaacgctatgcaacctttccagactcaaggtattactaatctactgctgtccagccggttcgtcgttgctcagcgaattcagcctccccgaatcgttgcaagagctagatgtcagactctgccgcaacgagcagctaaaacagcagtgcagagggttagtgggaaccatcccaagaatcataatagactggtgatccaagagctttgccttgggagttccctgtacattcttcgaaccttgtagaactcaactcttttcatacaaaaatctggccactgtcttccttactgttcaaaaatctggtgtttgtttgatcttataggcttcttcatgttttgcatttaaacttggattattgtcatttatcaagatg

SEQ ID NO: 74410 - DNA, 555 bp, Triticum aestivum
  Clone ID: PAT_TA_74410
agcggcgagaagtgaatccgtagttgagtgttaacaatgtacactttacctctttagtcttcaccagttgcaatcaaccagaacaacgaacacaggcacagcaaacagaatgtacacacgacacacgacggctgatcagatcagctcaaatcaagcaagcaggtggtcgtggaaccagctcttcatcatcgcgaacgcgtcctcggcgtcgccgtcgtcctccagcgactccggccggtgcgcgaacccgtggcccctgccggcgtacacggccgccttggcgcccctcgcgctcctctccagctcccgcaccgtctccacggggcacagcgggtcgccgtcgccgcacacgaacagcaccggcgccgcgatccgtgccccgagcgacgcgtccatccgggacccgtagaagcagacgcccgctctgaagcaggcggcatcggcgtcgcgcgcaagcgtctccacgaggcggccgcccccgtagcagaacccgaccacgcccagcttcttggacggcgcggccgccaggaagtcgtcaaccagccatttcctgca

SEQ ID NO: 74411 - DNA, 620 bp, Triticum aestivum
  Clone ID: PAT_TA_74411
gaattcggcacgagcctgcacgtggcccccgcgcgcgccggagccctacgtcaccaagtgcctcgccaaggaccgcggctccaccagcgtgctcctcggcttccgcgtctcgggggtcatggtatccgacgccagcggcgccgtctggcgcccggacaggtccgagctcaaggggacggacatccccggcgtgcgccgcatgctccgccgctacgtgtcgtccgccggcggcgacggcgggggcgaggactgcgcgctcgcggcggccgtgtacgggggcgagggcggggtcctggcgcagctgcgcgagctcaaggcgtggttcgaggtgcagacgctgttccacttctactcggcgtcggtgctgctgagctacgacgccaacgcggtgaccgcgcccggcggcgcgccgagggtgaagctggtggacttcgcgcatgtggtggagagcgagggggtgatcgaccacaacttcttgggcggcctctgctccctcatcaagttcatagacgacattgtctcttctgacaaggcgcctccggttcaggtctgaggagatcctggtactctactttgggagctgatacagtacaaaaggtaatatatcgagtcactactag

SEQ ID NO: 74412 - DNA, 691 bp, Triticum aestivum
  Clone ID: PAT_TA_74412
gaattcggcacgagcaattattcattgcttggtcttccggccaccacggacttgttactgtgatgattttgtggtttagattgctccatgtgctggttagcgggttaggcccttgtactgatgccttagggtgaaaatagttattaataactgtttagactatcatgatatttatctgtggtacctcttacaagtttgataggtttttggagaagtttatcttacaagttgtaaaccaactgatgcacttgcgttttctgcttggtctatgttataccagtccaatatggctacggtgttcaaagatgttaccctgatacataccaagtcctttttacttgtggttgacccagccagacctcaggtctccaatgttcagatgtattattaccctgacatatccagtatatatatctacaatgttcaaatggttgaaaggtttgcttaaagtgttcttttgctggaaagtataaactttgttgctttcgactaagttctttcaattttataagtggtaaagattaaatttagctctgcataagcaaaccttttcttgtttcccggctgatttgagcaatcagcactccatggcacgagaaattgcggtgcatggttttccggctgacaacttcacaccagataagtcggttgtcccttggtgtggagattaatgaaccgacaacatcaaact

SEQ ID NO: 74413 - DNA, 620 bp, Triticum aestivum
  Clone ID: PAT_TA_74413
gaattcggcacgaggttcatctcactgaggtcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctaccc

SEQ ID NO: 74414 - DNA, 672 bp, Triticum aestivum
  Clone ID: PAT_TA_74414
tttgattcggcacgagggccgccgaggggagggggggggaggacgaggagggcggggtcctggtgccggcgctgctcgcgcggctcgccggcgcgggggacgccgaggtcagggtcctcgtcatggccgcgctgcggcgcctcgcgggctgcgccggcgccgagaccaaggagaggatggcaagcattgaggcactttcaagcatcgtacgttccttgtctagagacgtcgacgagagaaatgaagcaattgcgctgctattggatttgtcagacattccgcaggtccggcagaggattggcaggatcaagggatgtatagtgatgctggttacgctcaggaatgcacatgaatcaggcacctatgatgacgcagagaagttgctgcacattttgtcgtgcaacccacaaaatgtgctgctcatggcggaggctggctattttcgaccattgatacattacctgaaagaaggttcagatatgaacaagatcctaatggcaaccgctatttctaagatgttcctctctgaacagatgaaatcttcccttggagaagatggagcagtcgagccccttgtggagatgtttaaatctggaaaccatgaagccaagcactcggtgctagccgccttgcgtaatctctctagctctttgcaaaacgcagaaattttga

SEQ ID NO: 74415 - DNA, 491 bp, Triticum aestivum
  Clone ID: PAT_TA_74415
ggagtaagtatctggcccctttaatttctgggtaatttggtcgatacatcaccacgataaaacagtagcatcctacattcctctattcgaattcaaaattcaccttggattggatttggtgatgaaaaaaaaacagaacgggccaattactcttggcatccctgggataggttcaaaacaacacccaaataagcgaggcggggcaattgctcaacaagcactccagcaccaccggagtccctgaacctgaattcatgatggccactactaggcaccggggcgccggcccaactttgggccggtcgtaccaacagcgtccgattaaacaacccatagccggacgattctctccttttctttcaccaggcgtcttctttcttaaaaaaaaaaacttccaacgcgctgccatggatgaacgatgcgcccaacctgaaagtaccgccccggtgcgctcgcctgtaaccgccctccccgccggtcgtcgtcgtcac

SEQ ID NO: 74416 - DNA, 536 bp, Triticum aestivum
  Clone ID: PAT_TA_74416
gaattcggcacgagcgctggttctccaccgcccctccctctcctcgctacaggacgccgctgggcgaagctcggcccgcgtcggcggcgccggggtcactctcctgcctcaagcagcgtcggcggcgcgggacgcagcgggctcggcctgtcaccgacgcgagtgtccctctcgagcggcggcggtggcggattcagcggacgcgggccgtggcggcggcggcggcggtggacgcagcgggctcggcctgcgtcggcggcggcgggtccatctcctttctcgagtagcagcgggctcgcgccacacgatttattcgactctggtgatttgtcaacttctgctttagcggcggcacaacggagcactccgccgggccccttggcgggatcggcgtccggatcatctcccgcctccgcaaggggggtgggactgctcgggctcatctgcaagagcccctcgccgccatgccgcctgctgccgctgacgccgtcaacgggagcggacgaccacgagagatcctgtcgatctgatggcgg

SEQ ID NO: 74417 - DNA, 394 bp, Triticum aestivum
  Clone ID: PAT_TA_74417
gaattcggcacgaggcaagacgccactcggggcgctcggcctataagacgatttttggcttgcgcgcgtggtgggagagagagagaactagtctcgagttttttttttttttttttttttttttttttttttttttttttttttttttttttttttatgcccggggcggaaagcaaagtcggggacaaaagggaagttcacaaatgaccattttacattggccattgtttaaacttgtagtttaggccttggcggactccttgcaacctgggggcctgaaggggataaaattgacccactggacctggcgcaggttgtcaaacccgatgacacggacattggcatcagggtcctcctttttgacctcctccacctggttgagcacctggggggg

SEQ ID NO: 74418 - DNA, 643 bp, Triticum aestivum
  Clone ID: PAT_TA_74418
gaattcggcacgaggaaatactgtagatatacaagatgagcacggccatggcatcactggtgcttgcagtgctcgtgttgccgtcggcaacaactgccgcggtggccacggccagaagaaactgctccgacacctgtggtatggttggtgagataccttatccgtttggattaggtccgtcatgctccttacctggtttcagcctcacttgtgcggacaacaccagttaccccatgctgggcaacctacccatcgagagctttgacatctttggttccaacaacctgtacgccaatatctcgtactcctacaactacctgtacgccaggatctcctacaccgtgaagatgattcccagtgtccgcaactactctgttcactgggaagctccggcccggcactttgccatgtctggctcgtcaaacatgttgttcgttgttggctgcggcgtcaaggcctcgctgttcatcggcaactcgacctttgaggttgggaactgctacgtcctctgtgcggaagctcgaatcatggagaagctgcccaagggggtgtgcgatggcatcggatgctgtttcatcgacatacaggtgaacctaagggcgttcaccctcaacatctcacgcaccagcggttctgcacgctc

SEQ ID NO: 74419 - DNA, 538 bp, Triticum aestivum
  Clone ID: PAT_TA_74419
tgaattcggcacgagcccctcctcttcctccggggacttcctccaacttcccactcctttaattgaaggttaaagccgcgggggctcgtgagtcgtgattagctagcctgctgctcgcgctcggccggcaaggaggagggggaggaggacgagatctcttgcctgtgctgttggtctcttctctccttgcttcgggagggaggggaggggcgatggtggggtcgcccaccaagcggctggcgcggggggtgatgaggaggccgctggagaaggccgggatggtggggctcgccgtggtggccacggccaccgcagcgcttctgctgctcgtctgcgccgcctcgctccgctgctccgccgccgtcgactacgcgctcgcggcgcccaggaggctctggagcggcggggtctccatcgcggccgaggcgtcgccgtcgccgtcggcggagagggggcgcggcgccgttaagaagacagcggcggcggcggcgatggtggtaggggaggagtgcgacctgttcaacgggagttgggtgtg

SEQ ID NO: 74420 - DNA, 460 bp, Triticum aestivum
  Clone ID: PAT_TA_74420
gaattcggcacgagaagccatcttgcggggttccagctcaggcgagcagcgaccaccttccggcgagggcagtgggcagcagcgatggagggcaaggaggaggacgtgcggctcggggcgaacaagtactcggagcgtcagcccatcggcacggcggcgcaggggtccgaggacaaggactacaaggagcccccgccggcgccgcttttcgagcccggcgagctcaagtcctggtccttctaccgcgccggcatcgccgagttcatggccaccttcctcttcctctacgtcaccatcctcaccgtgatggggtacagcggcgccgcctccaagtgcgccaccgtcggcatccagggcatcgcctggtccttcggcggcatgatcttcgccctcgtctactgcaccgccggcatctccggcgggcacatcaacccggcggtgaccttcgggctgttcctgg

SEQ ID NO: 74421 - DNA, 654 bp, Triticum aestivum
  Clone ID: PAT_TA_74421
gaattcggcacgaggagatttgcagcagctgctgctgctgtgacatatgtcgacacatatggttgtttgccttgcccccttgattgcaaacaaacatatctcggacagggcagcagctagctacttccttcagtacatctcacggacgatgcatagagccgctgcccccctacaaaaattacatcccacagatctactggacggcagaaacctggttcccaaacatactattgtgaatactctgtggatgtggtagcttaaaaaattgacattctattgcgggccatgcatttcaagcaagaacgaaatcaaacatttgatgttcgatgcctttgccaaggggcttcctagaagaatcacactcacacctctaatcctggagggtggattttctgatattttatatttcagtatctcctatttttctgtagttttgtgatatatttgtcatgtcatcatctattaggacatgtatacagagtgataccttgttgaccatacatattctaaatttattcttaattctccaaaaataaaggagacgggaaactttaaactgacttggcttatattctcatgaactctaataatttgtatatgctatgtaagctcaatattccatttaaataagatagaatgtaatcatgaagaaaa

SEQ ID NO: 74422 - DNA, 667 bp, Triticum aestivum
  Clone ID: PAT_TA_74422
gaattcggcacgagcctcctcctcaactatggttctactgcatgccaataatgttgagtgccagaaaaagaatagtttggaaggtacaaggggaggaggtagcagccgccccctgccctccactcactcgtcagtcaccattacctactggccggccggcccggtgaccgtctcccccctccggcgccccgagaccagcggttcgtccagggagaagaatcgcgggaaccgtgcgtggaaccgctgaggggctgcggcctgatctgctccagaattttcggccttcgatctccccggcaggttcggtttcagacgctgaccttggtgatgtccattaattcggtaaatttcctcaccaatcagctgggagatggcgtactctggacagaggcatgccggtgccgccgggagctcgtcgcggcaggggaatggcttgaaggggcaggccagctcagttgagttcctaggaagggggatggtggggatgcagctcagagatgcaaagccagatgacgctgatgatgaaagggacaatgagccagatgtggttgcagattctggttctgaagctggtcaaataattgcaaccacaatccgtggtcgaaatggtctgcctaaacagtgcgtcagttacatcgcagaacatgtggttggaactggttctttt

SEQ ID NO: 74423 - DNA, 644 bp, Triticum aestivum
  unsure (1)..(644): unsure at all n locations
  Clone ID: PAT_TA_74423
gaattcggcacgagcctcagtgcgccgtctcgtcgccgcccgcccccaccaatgccgccaatgccgccggcggaggcaagggcaggacgcagctggcggtggcgcaggtgaagaagctctgcatgcaggggcggctcgagcaggcgcggcggctgctgctggacgcgctgccgcgcccgccgccgacgctgctctgcaacgtgctcctcatcgcctacgtcgccgccgcgctcccggaccacgcgctccgcctctacgcgctcctcaaccacgccgcgcgccccgcgccccgctccgaccactacacctactcgtgcgcgctcaccgcctgcgcccgctcccgccgcctgcgcctcgggaggtccgtccacgcgcacctcctccgccgcgcccgctcgctcccggacaccgccgtcctccgcaactcgctgctcaacctctacgcctcctgcgcgaggtaccgccacgacggcgtcgacgtcgtccgcaggctgttcgacgcaatgcccaagaagaacgtcgtttcgtggaacaccctctttggctggtacgtcaagacggngcgtcccgatgaagccctggagatgttcctgcgcatgctggaggatggcgttaggcccacgccggtcagcttcgtgaacgtc

SEQ ID NO: 74424 - DNA, 446 bp, Triticum aestivum
  Clone ID: PAT_TA_74424
gaattcggcacgagctcgaggcctaaccctatcccgccccccctacacccggaggaggccgcgacggcggcggcggcggcgcgatgctgttccaggtgggagggcagggcgcacggcccaccttcttcgagatgtccgcggcgcagcagctcccggccagcctccgcgcggcgctctcctactcgttcggggtttttgcactaaggaggccatccttgcataaagttttagattatgaagatgaattctttgctttgttaatgtctgttcttgagtcccatagtctacgaacaacagatggttccttttcagagtcgttatatggtctcaggcggaggcctgttaacgtttctgtgaacagaagtagtcctggtgcagaatctaatgtcaaagtctatgactctgcactaaggaagcgccagaaaaccctctctgttatatttttg

SEQ ID NO: 74425 - DNA, 618 bp, Triticum aestivum
  Clone ID: PAT_TA_74425
gaattcggcacgagcaccagttcatctcgctgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatca

SEQ ID NO: 74426 - DNA, 652 bp, Triticum aestivum
  Clone ID: PAT_TA_74426
gtgcgtctcctcctcctttccccaacccagaccaggagcgccctctctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgcggtggtgtcat

SEQ ID NO: 74427 - DNA, 593 bp, Triticum aestivum
  Clone ID: PAT_TA_74427
taagaattcggcacgagctgtgctgatgctggggcccatccccatggaatggaaggttgattgggcaccatggaatggacgacatggcaaaactaggaccccaaatcttgttcaactgctctgcttattataatctttattattattattattatgatataccatgtttttcttttttcccactccagttgattgtattgtatgcctccctcatcttgacataatatgcttgcttggtttattattattattattattattattattattattattattattattgctcctgcttattcttgccttgcccgtaaacacggatgttagttagtgtactactagtcaaaacttgagataatatgttggttggctggatgcactggtccttaacaagtcagactagaggatatgctcccatgtcgtttgatgacagttactgacggtgcttgcagaattagatagatattcagacttgtaccatgtgtatgtatgtatgtatgtactccctctgtcctataatacaagagcgttttttacactagtgtagtgtccaaaacgctcttatattatgggacggagggactgagggagta

SEQ ID NO: 74428 - DNA, 626 bp, Triticum aestivum
  Clone ID: PAT_TA_74428
gaattcggcacgagccttgatgagcccgagccagtcggcgatggcgatggcggcgagcaggaacgcgcaggtgaacgtgtacgtgcagaactcgaggttcctgaaggcggcgcgcgagctgctggacgaggtggtcagtgtccgggacgcgatcaagaggaagggggacaggaaggacgactcggccggcaacggcgagtgcggcaaggtcgagggcgacaagggcgaggagaacgaggggagctccgccgccgagctgtcgccggcggagaggcaggacctccagaacaaggtgacggcactgatggccatgctggaccaggtggaccggaggtacaggcactaccaccagcagatgcagatggtagtgtcgtcgttcgacgcggtggccggctccggcgcggcgaggccttacacggcgctggccctgcagacgatctcccggcacttccggtcgctgcgggacgcgatcggcgcgcaggtgcagtcggcgcggcggagcctcggcgagcctcaggacggctccggcgcggggggcctgtctcggctgcggtacatcgaccagcacctccggcagcagcgcgccatgcagcagttcggcatgatgcagcagccgcagcacgcgt

SEQ ID NO: 74429 - DNA, 540 bp, Triticum aestivum
  Clone ID: PAT_TA_74429
gaattcggcacgagccggaactaaccttaggaagcaggtgacctcgtccgcgaactaccatggcaagagctccaaggccaacaggttcacagtcatggcagcggaaaacctcgacgagaagaggaacacggacaagtggaagggtcttgcgtacgatatgtccgacgaccagcaggacatcaccagagggaagggcattgcggactcgctcttccaggcgcccacgggcgacggcacccactaggccgtcctcagctcctacgagtacgtcaaccagggactcaagaagtacgacttcgacaacaccatgggaggcttatacatgcggtcctgctttcatggacaagcttgttgtccatctctacaagaacttcatgaccctgcccaacatcaaggtacgtacgacgtgcatcatcacctactatttaatttaactggctagattagcagcatgaaagtcattctgattctgaaactgacctggaatcgaatttcagatcccactcatcttgggtatctggggaggcaagggtcaaggaa

SEQ ID NO: 74430 - DNA, 273 bp, Triticum aestivum
  Clone ID: PAT_TA_74430
gaattcggcacgagcgcacacggccacggggggcttctagattccgtcgaattccgcagccgccgaaccctaattccttcgcccggccgccccgatccgccccgcggcctcccggctcgcggcgccaatggccgacagggaggaggagaaggcggaggccgtgcgggaggcagaggaggagcaggagcagcaggaggaggagtacgagagcgacctcgacgacgctcccctcccggccgtgaggcgccgggctgcggcgagcgactaggaaga

SEQ ID NO: 74431 - DNA, 712 bp, Triticum aestivum
  Clone ID: PAT_TA_74431
gatccaaaaaattcggaccaaccaacaacaacgacggggctgcgtggtttcctcggcctgacaggatactatcgaaaattcgtgcacaattatggcttaatttccaagccgctgacccagttactcaccaaaacgggttttgagtggaatgatcaagcgactgaggcctttatgacattgaaatctgtgatggctcgtacccctgttctcgcccttccggatttctctgtgcctttcgccgtcgagacagatgcctgtgacacaggtgtgggggcagtactgatgcaacggggtcaccctattgcatacatgagcaaagccttgggtgttatgaatcgcaagttatcaatctacgagaaagaattcctcgcagtgatcatggcgatcgacaaatggcgtcagtacctacagcgaggtccattcaccatcttgacagaccataagagcctttgcaatctcactgatcagcaactcacgtccgatttgcaacgcaaagctatggcaaaattaattggtttgcaatttcagttcaaatacaagcgtggcgtggataatggggctgcatattctctgtcccgtgtcgctcatcggtttgaaacccaaaccctttcagtttgccggccagactgggtacaagaggttctgaattcgtaccacactgatactgaaatgatgacactattgcagcaactagccattcattctcctgatg

SEQ ID NO: 74432 - DNA, 538 bp, Triticum aestivum
  Clone ID: PAT_TA_74432
gaattcggcacgaggctaactggtgctacgcaaccgtcgcgccccgtgcccgctcctccaccatcgtcgccagcctcggcacccccgcgccctccaactcctcctccttccgccccaagctcatcaggaacacccccgtccaggccgcgcccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtcccgtcctactgcaagaacaagtacgctggtgttggatcggccatcgaatacgccgtctgtgctctcaaggttgaggtcatcgtggtgattggccacagccgctgcggtggaatcaaggctctcctctcactcaaggatggcgcagacgactccttcca

SEQ ID NO: 74433 - DNA, 596 bp, Triticum aestivum
  Clone ID: PAT_TA_74433
gaattcggcacgagccacgatgtacgggcagatttggcgcctcgtccccaacgcctgctcgccgctcccgccgatccgcgccggggcgggaaggggcagctggccggccggtcgccccgcgccgctccgccggccggcgctcgcctccgcctccgcctccacccgaggcctatgccgccccctcgccgtctccgcccagtcggccagcctcgacgccggtgtgagagtggataagtttttcgaagttgagatgaaggtgcgcgactatgaactcgaccagtatggagttgtcaataatgctatctatgccagctactgccagcatggccgtcatgagctacttgagagcgtaggaataagcgcagatgcagtagctcgcagcggtgagtcgctggccctctctgagatgcacctcaagtacttcgcgcctttgagaagtggtgataaatttgtcgtcaaggtgaggcttgcaagcatcaaaggtataaggatgatattcgagcactgcattgagaagctgcctaaccacgagttgattgtggaagcaaaggcaacagctgtttgtcttcacaaggactaccgccctacccgtgtgc

SEQ ID NO: 74434 - DNA, 618 bp, Triticum aestivum
  Clone ID: PAT_TA_74434
gaattcggcacgagcaggggagctggaggagggcaagctgagcagcacgaatggcaacggctcggatcaacaagcagctgagcaggacgcgcacgggccgtcggcgacgggccactcgacggcgtcgatgctgcggaacgccagcaccctcggcgacagcatactgctcatcgcagcgctctgcttccactccgtcttcgagggcatcgccatcggagtcgccggtaagagacaagtgggataggacgtccttgaatcgtctaaaactttgacttccatcttccatgagaagaagatatctgcatctcatgtctcgaccactggtttagtaggattagtagcgtagaattgtagatgcttgcaagttgcaagcatcaatcaactctgaaactgacatgctctagttcatatccagcttcgtctcagtccagtcattgtcacgcatacttttcctcgttccagcctttgaatcaacagatgctcgcagcttcctctttcgtccgtcgacgtccacttcaatcagcatttcagattccgtcaaaattaaccagaaaaatataaagtcctgataatcaatcttgaatcttcctacagcactgatcaacattggcattgcag

SEQ ID NO: 74435 - DNA, 524 bp, Triticum aestivum
  Clone ID: PAT_TA_74435
gaattcggcacgagccccacgccatcatcgcccatcaacgcgcagctcgcgtaacatttgcaggccctcgtcgccccttggaggtttcggtttgccatggcggaccagctcagcgaggagcagattggtgagttcaaggaggccttcagcctcttcgacaaggacggcgatggtaccgatttccgccccccttcccttcccccatctgcattaggtgatctcgcgtggacgccatctcggtcgatccggcccgggatcgggggtcccgccctgccaggcgtgcgtttgatctgcgccatgcgatgcgcacctagatctgatggcgtgccgggggcgattttgttttcgcgcagcgatttggttgtctcggcatggtttcttatggtaatcgaggcgcctgcgcggcggtgatttcatcaatctgttccgtggttcaggtcatgttctcgttagaggcgtgcaatttgtctgcagggaggggggttacgcattgtggtgtgcgttttgtgcttgtatgtaggcct

SEQ ID NO: 74436 - DNA, 412 bp, Triticum aestivum
  Clone ID: PAT_TA_74436
gaattcggcacgaggccaagccaccgaccagcatggcagcgtctctccaagccgcggctacgctgatgccggccaagatcggcgggcgggcctcctccgcgcggccgacgtcgcacgtcggccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtagactccttccccttcaaggccggcaagtacgagat

SEQ ID NO: 74437 - DNA, 500 bp, Triticum aestivum
  Clone ID: PAT_TA_74437
gaattcggcacgagcagaagctggcagtcacggccccgggcagatcgtcctttgtctgtcatcctgtcatctgctgccgccgcacggtcgcagccgccgtccatggcgacggcggaggaaggcgagggaggagaggtacaagtatcggcttatctttcttcaccttcggtgggtgggcgggtcgatctacatctttaacacggtgacctaaagatagtattttttttgctgagcagccaccaggattagggagggggaggtgtccaagattccggcgatctgaggcgacccgcggcatggccggaggcggcggcgttggggggaaggaggatggcggcacggagcccctactcctgtccgtcctcgctctccccgcaacggcgctccccgccgtcgtctcccgcctggaggccgccgtcccgcggaaggcgcgcagctacctcccccgcaacgtcccgtcggcctggtggtcactcaggatccccttcatccagccgctg

SEQ ID NO: 74438 - DNA, 714 bp, Triticum aestivum
  Clone ID: PAT_TA_74438
gattcggcacgaggtgagcaattttttaagtcatgaacattttttgatttttagaatattttttaaattcacaaacagtttaccattttcctactttttttcagaactcgcaattgtttgatattttggaaatccgaaattaattttgagataaaaaaccaaaacagaaataaaaaagtaaaaagaaataaaaaatagggggcgccatcaatccgaaatttatttttagggaaaaaacaaaatagaaataaaaaaaagatatagaaaacagggggcgccacgacccgcacatgggctggcccattactgcgcttggtaaaaagaaagagaaaaagcgtgagaaccagggatcgaaccctggtctcctgtgtggagcatcgttgcctcagccatcgcgctgctcatgcattggtgctatagcacacatgcccgtgcattgcaacgggatatacgcatttaagtgatttaacatgcatcatcggtaacgctacactctcaaacaaactccttttgtccctataatatttgtaaaatagagaaaagaaaacagtttccacattagaagataacactgcccctagcaatccaagcgttcatgacattctcggacagcaagcaggaagcaaaatctgcagcaagcaatacatggagcaaacaagaactttttggaattcagacacttgcatctttaaaatggtgtactactcctggagc

SEQ ID NO: 74439 - DNA, 661 bp, Triticum aestivum
  Clone ID: PAT_TA_74439
gaattcggcacgagccgaacgtgtccgacgtcttccccgcgctcgcggcggccgacctgcagggccttcgccggcagttggcccggctgttcgcgcggctgcacctcgtgttcgacagggaggtggaccagaggctgaggcgccgcgcgcgcgacgccgccggcgagcctaggaaggagaacgacgacaacgacggcggcgacttcctggacgtgctgctggatgtcgcggagcgggacgacgaccaggccgcgctgctggatcgcgacacgctgcggtcgctgttctcggacctgtttgctgctggcagtgacacaacctccagcacaatagagtgggcaatgacggagcttcttcaaaaccaatcatcaatggacaaagcgcacgatgaacttacaagagtcatcggctcagggagagacatcgaagaacctgacatcgacagcttgccctacctccaagctgtgatcaaagaaaccttccggctgcaccctcccgctccattgttgctaccgcgccaagctcagacgaccataacagtcgcgggttacacagtacccaaaggcgcacgtgtgctggtgaacgtgtgggcgatggggcgggacgaagctatatggtctgagcctgagaagttcatgccagagaggtttctcgggagggc

SEQ ID NO: 74440 - DNA, 409 bp, Triticum aestivum
  Clone ID: PAT_TA_74440
gaattcggcacgagggatggaggacgggggggggtacagcatcaccttcccggacttccccggcgggccggacaccttcgaggcggcggccaagttctgctacggcgtccgcgtcaagctcacgccctggaacgtcgcgccgctgcggtgcgcggacgagtacctggagatgacggaggagcactccgaggacaacctggccgcgcgcgccgaggcctacctgtcgcagtccgtgctccgccaccccggcgaggccaccaaggcgctcaagtcctgcgaggagctgctgccgcacaccgaggagctcggcattgtcgcccgctgcgtggagaccatcgccgcgcgctcgtcggcgacgtcgcgctcctggttcggcgacctggccgtgctcggcctgcacatgtacaag

SEQ ID NO: 74441 - DNA, 473 bp, Triticum aestivum
  Clone ID: PAT_TA_74441
gaattcggcacgagccacgctgccacgcagagcatccctctcccccctcccgttccggtagccaccgccgatgaatccatagacagtagtagtagctgtagagtagcagcaagagcactctacagctccgtgccaccagaaaaaggctcaccaaccagactagacagaagaggcatcgaggttccaccttccgtccgccctcctgcctgctgatttagctcctccaccagaaggcgccccaaaagtcagaaatagttttggcccacggtggccgaggagttaaggagaggtgtggtgagccgtggccgtcaggccgcgaggccgtcaatggcccagtacatatacgccaccacagctcgctgctgctgcagctccgcacgcgccctcccgctccacgctcccgcgctagccccctcgtcgtctcgatcgccgctccggtggaggtcggccatgggcgcgagcgatcgcctgac

SEQ ID NO: 74442 - DNA, 497 bp, Triticum aestivum
  Clone ID: PAT_TA_74442
aaattcggcacgagggggcggggcggttgagcggagctgtgtaggtggggtggctggatgctgtccgtgcggaggcggaaagaggatgctggcggagccaccggaatggcggaccacgcccagctgaaggacggggaggcctacgccgacgacatgccctctttcgacgacccgtacgtctccctcgcttacattgatgaaaaactacataatgtactatgccatttttaaaaggactttgaaggaggcgtttatgcagagaatctaggatcaaaatttgatggatatggctcatttttgccaacctaccagcgtttcacatcttctgccccacactaaaactccacctaaggtggcaaatgctagctcaagatctacttatcaccagtctactgaggatgtgtgtcagaaccctacggctatggccggtccatctgtttcccagaataatggttctgcggctgctttatctggtgattcaattaaaaaggaaagat

SEQ ID NO: 74443 - DNA, 106 bp, Triticum aestivum
  Clone ID: PAT_TA_74443
gaattcggcacgagcctaaaagaagggttgtgctcgtgctagattacgaggaacggccgttgctgtcggaacattgatggcaatggtaggaccaatattttgtacg

SEQ ID NO: 74444 - DNA, 408 bp, Triticum aestivum
  Clone ID: PAT_TA_74444
gaattcggcacgagcggctgtgccgccagcggtggccaccgcgcctcccccaccgtggctgaccccaccccgccctctcacgccccaccagcgaccagcgctgcaaaccaacccccaccggtgctgccgatggcggcgagaagtaacggagagccgcggcggccgacgttgaggcgttgcaaccacggcgacaagtgatggagatccatcattttcttttcttggaagcagccccaatttttgctgcagacacccttgatttttgctgcaaccagtacatgacgctgcaagttgacaatggcggcgagccggagacggggacgccagggatgctccaaccatgatgacagcgcgctggaatcctcctgtgtttgagttgcaaccatgacgagcagaggcagccaaggc

SEQ ID NO: 74445 - DNA, 373 bp, Triticum aestivum
  Clone ID: PAT_TA_74445
gaattcggcacgagctcctccgcgctccgggcccaatccccgcttcccaccggcgacgaaaccctcgcctccccttccctccctccccgccccatccaccggggagaccggcggatagctcgcagcgcggccgagaccgcgcgagcccggcgccgaccccaaccgcggcgaggagccgagcgtcgggagcggcgggcggccgggatcaccggcaagcctcgcggcgaggaacgagcggcggccgggcgagcctcgcgctgaggaagaaccgcgtcgcgagcggcggacgaagagggcgggcgcacggcagatggccaaggatttgctatggaagctggcgctcatggcgtggcctctcctcaaggaggaggcc

SEQ ID NO: 74446 - DNA, 472 bp, Triticum aestivum
  Clone ID: PAT_TA_74446
gaattcggcacgaggctttgttcttacggtggtccggccccgtgcgcgcgagagagagagagagagagagagagagagagagagagaggctatggaggcggtcatggaggcggcgatcggcgacgaccacacctggtacgagttcctccccatcctctcctggatcatcgccgacgccgcggtggctcgccagacgctggagcaggcggcgcagcagctcgaccttgccgccgcggaggcgaaccgactcgccgccatagcccattgggcctactacgcgacggtcctgtgtctcctccgccgcgacatctacgtcgacctcgacctcgaccgcgaccgggtcgctgacctccgtcgagaggagcccctcgccgccgccgtcgctgagccggacccgggcgccgacctgcgccccaactgtggccttgtggtcaacgtcggctgcggtatcgacctcctcctgcgcaccgag

SEQ ID NO: 74447 - DNA, 551 bp, Triticum aestivum
  Clone ID: PAT_TA_74447
gaattcggcacgagctgccttggattggatcgagtggctggtgaagcagcaatccatggcgcagccacatctgcacatgcattgcttcttctgttcctcgtcccactcgttctacttctcgtcggtgcgaaaagatggaaccggaggagcaagcagcggctgaacctgccgctcccaccttcccctccgcgcgcgctcccggtgatcgggcacctccaccatgtcggccccctccctcacgtctccttccgcgaactcgccagtaagcacggccgggacctcatgctcctccgcctcggcgcggtggacacggtggtcgtgtcctcgccgcgcgccgccgcggccgtcctgcgcacgcacgaccacgcgctcgcgtccaggtcgtgctccgccgtcgccgacatcatcttctacaagcggaccgacgtcgccttcgcgccctacggcgagccctggcgacaggccaggaaggtggtcaccacgcacatgctcagcgccaagaaggtgcactcgttccgccacgaccgcgaggaggaggcgcgcatagccat

SEQ ID NO: 74448 - DNA, 657 bp, Triticum aestivum
  Clone ID: PAT_TA_74448
gattcggcacgaggctgctctagtccccggctctcgccgccggcaggagcgactccttctgccgctttcctcggcccgtgcttcggagatgccggcgacggaggaggaaggcgcggcggcggcggcggcggcgggggcgtacgagcaggaggacggggacggggaggagtacgacgaggatgaggaggaggggtacgagttcggcgacgcggcggacgcggcgcagtgcgtggagatggcggagcgggggcccggcggcgccgtggccaccgtcagcatccgcgacttcgaggccctggcggcgctgtcgcgcaagcggaaggccctccccgaggagccgccgcagggggacgagccctccaagaagcggaggcagcagggcgagctctccgaggcggagtcggcgaacctcttcgaccagctgatggaggggttcggcctccggcggaagaagcggcggcggtccaaggacggcaagaggaaggggcgggcgagagggcggaggaaccggtgcagccccgaggtcatcaagaagctgggcgacgccaccctgctcttcaccgagaacaggttcaaggaggccatccccatcctgcacgagatcgtgcggatcgcgcccaacctgcccaactcgtacaacctgctcggcagcatcta

SEQ ID NO: 74449 - DNA, 541 bp, Triticum aestivum
  Clone ID: PAT_TA_74449
gaattcggcacgagcgccggcgcccgatccgacggcgaatcgactcgattcctcgccgctccgcccgattccggcccgtgccgtcgctgatttcgtgtttttcggcgcaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtcca

SEQ ID NO: 74450 - DNA, 565 bp, Triticum aestivum
  Clone ID: PAT_TA_74450
gaattcggcacgagtagtgatatgcttgtctaaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggacttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgcaacttctccacggccaacgggctcccgtccctctcgcacgcgcgcggcctgctggccgacgccgtcgcgctcgtccgccgggagatgccctactggaaccgctccgccggcgccg

SEQ ID NO: 74451 - DNA, 465 bp, Triticum aestivum
  Clone ID: PAT_TA_74451
gaattcggcacgaggaggcaacgacagtaactgacaactttgttgcagatctgaggtacaatcccacgagcacgctcttcgtcaacgtcccatgcgtctcgcggctccaatggcaccccttctcggtgacgtcgagcagcagcctcgagccggacacgctcagcgtcgtcatcaagaacagaggcggatggacgcagaagctgtacgagacggtctcgtctctgcccccgtcgggtggccacctcggcgtctcggtcgaggggccgtacagcccggccgccggggtcacgtccttcttgggccatgactcgctggtgatgatcagcggcggcatcggcatcacaccgttcatctccgtcatccgcgagctggtttaccagagcagcgtggcagaaacggcgtccacgccgaagctcctcctcgtctgcgtcttcaggacatcggccgagctcgacatgctggacc

SEQ ID NO: 74452 - DNA, 552 bp, Triticum aestivum
  Clone ID: PAT_TA_74452
tcggagtctgtgtgttcgtaggctgatatcagcggacttaaagaacctggtatgagtcagctctgagccccccccccccccccccgccacgacaaacatagaactgacgagcgcacacgcgcggatttaacaggacacggaacataacacggcgcagctggcgcgaaacacggctaaacggtgaaatgcgttggctgatagcatgtaaaacccactcatcatggtctattgcttttggttggatatatatggtcagtacttactccggtgtcgatgacgctgcaggcacagagcctgtggcaaccaccgtgcgtgccgtagcggacatccggtcagtacgtttggttgcgtgctagagatggtgacgactggtggcgggtgtgcctgcacgttgccggtctccgactatacgtctcgtagggggtgtttgaggtggctgtttctgacgaagacgcggccgtggacgacgctgtcgagtccggcgtatttgttgagtgttacggcgagtctgaatcttctttgtactacgtgtagtatgccctgtatcttggt

SEQ ID NO: 74453 - DNA, 509 bp, Triticum aestivum
  Clone ID: PAT_TA_74453
gaattcggcacgagcctctccgcaaaaccaaccagtcacgcacgcacgcacgcgaaatccgccgccggcggcgccccaaatgcgcgcccctcccctgctcgcgctgtccacgccgcatccggcacgtcctcctcctcaccgtccatcgcgcacggggcccggtcgcaccctgttcttctcgccgagaaggcggctgcttctcgccgtcgcgcggtccaagagcagggacgacgccagcttcaccgatcgcatcctcgactacatcgagggtggtccaaagttgaggaagtggtatggagcacccgatttgcttcccaaggatgggggtgctgagggcgaggaggatgagtcttcagatatcgaggagcctcgagatgccgtgctagttaccaatggcgagagtgagattggacagatggtgatattgtcactaattctgaaaagggccagaattaaagcattagtgaaggacaaacgatcaactgaagaagcttttggaacttacgtag

SEQ ID NO: 74454 - DNA, 559 bp, Triticum aestivum
  unsure (1)..(559): unsure at all n locations
  Clone ID: PAT_TA_74454
gaattcggcacgagatcacgaccgatttaaagcgtttccttggggcttatcgcgaaccacggccgccgacggcgccaccgcccactgctgccgcggcgccccgcgcaggtgcgttttcgattgttgctcctgctctcatctctgttaagaatagaatagttgcttacaattaagctaattaagctaattaggattaagtcaattgttagataggttgcttggttctcaagcaaccatgtacttccttggctcttaagacaactatgtaatttgtttacttgaccgccttcctataaatagcccacttctatcatcaataaagactgatgaatcatcttttattcaaactctctcgntctttactttctactttaaacacgttatcagcactttgccctgacagagagtgattaggccagagaaaagaatagtggtgctcagccatcgaggcgtgtacgcgcagacttcctcaacgcctcgagcgatccttggcggtgccggcgttgtccggcgcggcggtcttgcagcggtcttggcgcggataatgacaccggtcacg

SEQ ID NO: 74455 - DNA, 300 bp, Triticum aestivum
  Clone ID: PAT_TA_74455
ctcccccacccgcccgcccccggacccgcacacgccaccccatggaggcgccgctggagccggagcccatggcgctggacgcgccgaccccgctcgccgacgccgacccggcccacgcggacaccgagaagacgaggaccgaggggggcgaccctgtcaccggccacatcatctgacacaaccatcggcggaaagaacggcgagccgaacaggacaattaactacatggctgagcgggcggctggaactgggtcatttgggatggtcacacacgctaagtgcttggagaccggagagact

SEQ ID NO: 74456 - DNA, 500 bp, Triticum aestivum
  Clone ID: PAT_TA_74456
gaattcggcacgagcacaggcggtcgcgggcacggcaacgtgcagtcgccttctttttgccttgtttttgtgcaggagggccgaggaggggaaacggcggcccaagtaacgcctcgccttcgtcgtctgcctcgcattcccatagtcctcaaagcaggcaagcagccaccggagacggcatcaagtggttgcagaaggcagggcatagcatggggggcagaaggtggcagctggatgctgccgctgtgatcttcaggctcctacttctacacggcgccttcctcttccagttggcaacgtcgcagtcgttcatcggagtaaactacgggacgatcgcggacaacctgccgcccgcggcgtctacggccagcctgctcacgtcgacgtccatcggcaagctccgcctctacgagccccaaccggacctcgtcgccgcgctcgcggggtccaacatctccatcctcctcggcgtccccaactccgacgtcccgagcctcgcc

SEQ ID NO: 74457 - DNA, 387 bp, Triticum aestivum
  Clone ID: PAT_TA_74457
gaattcggcacgagcccgccccgacacagcgcgaccgaagccgccaggacacaaaccaccgccccgcctgcctcctccctctcctccccggcgccagccgccgcctccgtcctcctcctcgtcgtcgtctcctcctacccccgaaaaggctgagatcgccggttcgcgggccatttgattttggcgcgcggtttctactttctagccgtgcttcccatggccgggtccatcgcggccgcggccttcttcccggggccgccggggccgccgccgccgcccaagagcgccctgggcgagcgtccggacagcctggacgtccgcggcatcgccgcgaggcaggcctcggcgtcctccgccgtgagggccgccaggacgcgcgcccacgcg

SEQ ID NO: 74458 - DNA, 309 bp, Triticum aestivum
  Clone ID: PAT_TA_74458
gaattcggcacgagcgggcacgtcgctcgggagatcccaacagttcccactcctcgcaccgacgcagccatggccgagctgcggcacggcacggtggcggcggcggcggcccgcgcctccggctcgcccgcgaagcgcgacgcggaggccgcctccgcctccgcctcctcccccttcctctcctccccacgcggcggcggcgacggcggcaaggacggcgcgctgcgcccgccccctccactccaccagaggtacccgcttcccgccgccgtccgcgcccttcttacgctagaggacccccggtcgccc

SEQ ID NO: 74459 - DNA, 431 bp, Triticum aestivum
  Clone ID: PAT_TA_74459
gaattcggcacgagcagagaggcgtcggggtttcttagctgtcgccgccgccaagcctgcccgcccgcgttcgagcctcaccgccgggcgccggccggccctgactccggatccgcccgtcagttactcgagcctgcaccagaccccggcccaggccctgctccaacccatttgtcccctcctcttccaccggagcctcgagctgctgattttagtcgaccacctctacatcctcgagccacggtcgtccatctccatctctagccgccctggttcatctcaggcgttctctactggtctctctgcaagctcttactgtttgtctgaaggtttcacacactcctgtattctccggaacaacaaacaaacacacagtgaggagagcctttgtagcaaccaactgttatcttccacccagtactaccgcaatc

SEQ ID NO: 74460 - DNA, 520 bp, Triticum aestivum
  Clone ID: PAT_TA_74460
actatgacaaaacattcatatacgtacagtgacctatacaaatgatgctacacaaatgatggtagaaagataaccaaagttgctgtatgtatgtatgagaaagctaatcgaagttgttatatgtatgtatgtatgagaacaacactttgtatccgaacggaaactcattcatttttggtcgatggctcagcaggggcgagaagagaatacaaccatcaatcaactactcgtgctttgcttcagggtcgtcgttgcggtggcgattctcctgctcctgctccgtcaccggcggagacagccgcagcgaggagatgggcaggaggtggagcagcggcaacggtgcagcagaggacgacgaggcttgagaaggcgagctcgtcgtcgtctcgccgtggcagccggccccgtcgatgtcatcctcaccgagcgcgatgtcgaggtgccgcttcctgggctccatctggttcttgaaggcaaggaagacgatgcactgcgccctcatctgcctcagctgcggctg

SEQ ID NO: 74461 - DNA, 400 bp, Triticum aestivum
  Clone ID: PAT_TA_74461
gaattcggcacgaggccgccagggaggtgatgaggacccacgacgccgccttcgccagccgccacctcagcgccacgctcgacatcatcacctgcggcggcaagggcgtcctcttctccccctacgacgaccgctggcgcgagctccgcagggtctgcgtgcaggagctcttcagccagcgccgcgtgctctccttccgccccgcccgggaggacgaggtcgcgcgcctcctgcgcgccgtctccgacgggtgccgcggcggccgtgccgtcaacctcggcgagaagatgtgccgcatgaccaccgactccgtggtgcgcgcggccataggcgagaggtgcgaccaccgcgacgagttccttcacgagctcgacgtggccgtgcggctcaccggcggcat

SEQ ID NO: 74462 - DNA, 214 bp, Triticum aestivum
  Clone ID: PAT_TA_74462
gaattcggcacgagactaaaagcaccggagaacatggacataagcatggcgtccaagggtcttcttgtgtttgctctcctgctcgctgctgctatcctcgacgccttaactgaacaaactcacgccaagatggaggagaaagccggcgtatagggctacgacggcggcggtggctaccctggcggcggcggcggcggctacccaggccacggtg

SEQ ID NO: 74463 - DNA, 361 bp, Triticum aestivum
  Clone ID: PAT_TA_74463
gattcggcacgagctccaatcccccagctcctcagccttcagcagtcaacatggggatggccatgacctcctccccacagccaccgcctcccccgcgccgccgccgcagccgcttgcagtcggcaactacaatctccgcccccagtgccaatcccaaccccaaccccaaggccaaggtcatccccctcctctccgacgtcggccgccttcagtccgcaactcccactcccaccccaaatggcaatcctagccccaaccccaagagcaaggtactcccgctgctctccgacgtcggcagcaacccctccgccatcgactactactcccgcgtcgcctccaacctcgccggtgccggccgcct

SEQ ID NO: 74464 - DNA, 525 bp, Triticum aestivum
  Clone ID: PAT_TA_74464
gaattcggcacgagctgctttgcagaaacagcgcagcaacttgtttttatcgccaaggctaaacggctgaaccgaattgaatgaatgaccactcaaaaggatcatgggaacaacacctacaaaacattccacatgctcctcctctgatttttccatctaggaactcgaaatagctgatttctgaatctggacgcgcagaaacagcaacaataaccaattttgcttcaatccatcctgtatctgctactccctttcttaaccacccggaatccttcaccaaaacagagctatggtgcaggtaagaagagcgaggacctcaacttggtggtgggattggaggcgtttggtgaggggagtgttggggaggcctcctcctcccttgtttttctcttgcaacctcttcttctcctcctcctcttgttcttctcctcttggtcttcctgttcctcctcttatccttcctcacaaccagattagagggcttccctcgaggtggtgcaggatatggtgcagcttggagggcct

SEQ ID NO: 74465 - DNA, 524 bp, Triticum aestivum
  Clone ID: PAT_TA_74465
gaattcggcacgagcttgctctcatggttggggcttactcatagacgaacaagacaaggatttaaaggtttcttgcaagcaactttttgattcataagaaggcattgctctacctgtctaccactccactccattccccaccggcgagagagattgagagagagagattgagatagagctgaagacatggagggcaagcgcaccgaccaggtatgttctggtacccagacccccctccagttcctcaagatttgaaccaagatttttagtttagatagaagctagaacagacagagtgcaaaaaactcgagttattcagccatatatgaactttctaattcctgtttcttgtggtcacatgaaagaaaatctgctgagattctcatacagatgctaaaactagctgatttctgctgtctctggatcgattgcgcaatcagatacatgttctagatactactccctccgtcccataatataagagcgttttttagactagtgtagtgtcaaaaacactcttttat

SEQ ID NO: 74466 - DNA, 451 bp, Triticum aestivum
  Clone ID: PAT_TA_74466
gaattcggcacgaggcctctcctcttcctccagcccgcctctctctccctccaaaccctaaccctaaaccgcgcccgcctccctgccccgccggccgccgccatcgctcgcccaggcaaccgccccacactcgcgccgccgccgtcgccccctctcctcttcctcccgcccgtgcctcactgcggcctcctcccggctcctcgtccgcggcctcgacggcgcccccgtgctccacctcaaggcgcaccacgctggccgggcgcgctacgtgctctcctgcgacaccggccgccgcatctgcatcttcaccgagaacggcacgcgtccgtcacccgtgcggacaggactcctcctcttccctacctcgggggcacggaggtgctgacggagaagcccagctgggttcgccatgacggcctgcagatcttctccatcaacatccagcccagcg

SEQ ID NO: 74467 - DNA, 99 bp, Triticum aestivum
  Clone ID: PAT_TA_74467
gaattcggcacgagagcgagccaagcgaacacaagcggagcgagcgccctcccacggacctaggcgtacttctccatgctctatcgcgcacaccacggc

SEQ ID NO: 74468 - DNA, 491 bp, Triticum aestivum
  Clone ID: PAT_TA_74468
gaattcggcacgagctatcctttctccgtttcttcctctgcccatggctctgccaaacctcgccgccggacgctcccgtcgtcggcgcctgcccgccgccgggccgaccaggccttctcgacccgacgcatgcgtgcgctgggcgtcgctcgaagcacgccgctggatcggacgtgtgacgtcgccgtcgtcgtccaagcacggcacaccgccggatcgatccccccgtgtcgatgcaaggccggccgggccgtcgtcggtgcacgtcgccggatcggaagtcgccgccggcgaatcgccccgccggtgccgacgtatggctgggccggtcgtacaaccacgtgcgcgcacctggctggatcgattcggtgaagcacaacgtttgatccaagtcggggacgagaaggagggatcgccgtgcatcatcggcttgccgcgaggaagccaaattttcacagaggagtgtggcagcacatgttcaccaggtatgc

SEQ ID NO: 74469 - DNA, 543 bp, Triticum aestivum
  Clone ID: PAT_TA_74469
gaattcggcacgagcttaggcttggcatctcatctctctcccccgatccctttcttctccacctccggccgccgccgcggccaggccggcgtggcgtcgcgccaccgcgccatcaccagcaccaccgcgtcacgcagcacacccgccagcgccatcagctcctccccatgcctccactagctccaccgcaccaaatccatccaccatcaccaccatctccagccatcgctgcacctcgcacgcccgaccagacaagagggtcatgggcgtctggtcttccgcgtgagcgcccccgtgctgctgatcttcttctccttcccccctgctgcttcttcccttcacgttgatgctgttgcctttcttgcacccaagccgcttctcctcttctctgaaactgcttctgcctcttctctcgatctctgctgcttcttctccgggacctcaagctgctgctccattcccaaactgctgctcctctctccctagcgccaccatactgctgctccttctccttcgcctgctgctactcccttgccccacgcc

SEQ ID NO: 74470 - DNA, 471 bp, Triticum aestivum
  Clone ID: PAT_TA_74470
gaattcggcacgagacagaattgatagaagatcgatagatagaatagatggcccataagccactggtgcatccggtccaccagtttggctgttccacaggatatttccgttctctgtttcatgtgtcctaccaccatttcccccaacacagaacagaattgaacaaagctagcaatcactcataggtggccaccatggacgtggcctcggtgcttctccccttcgtcctggcgctggtggcgatcccgatcttgctcgcgctacacgactggccacgcctcccaccgggcccgtgcccgtggccggtggtgggcaacctgcgccagatcaagcccgtgcggtgccgctgcttccaggagtgggcggagcggtatgggccaatcttctctgtgtggttcggctcctccctcaccgtcgtcgtctccacgccagagctggcaaaggaggtgctcaaggaccacgaccagcagc

SEQ ID NO: 74471 - DNA, 530 bp, Triticum aestivum
  Clone ID: PAT_TA_74471
tgccgaagcttgattgctactaagtgtgccgaagcttcgactgtactaagtgggaactctgcttgtacatcaaaaaccttgaacccaaagttattccagatgagtccaccatacctacctatatacggtattaccctgtcgtcctacgtaaatttgcatgtgccacctctaaaaacttctaaaaattatcctttttgtgtgcctgggtcattcatggaacgacaggaggtggttgatatcttccgtgccaagtgggttattcttaggtcgagtgtttattcactcgccatcgcacgagaaaatgggcggtaatagggatgcccagtcccagactgcaaacatgaaaaagagttcatctctgaattaatcaaaaaaactcccaatggagtcaaaacctttacttttatcgcttgggaaccgccactagcgtgcttagcatggaagatgttgataactgatggtcgtgaagtggataataagggagcatgtctcaaaatatcatttatctttgtttcaaaaaaaaaaagctt

SEQ ID NO: 74472 - DNA, 489 bp, Triticum aestivum
  Clone ID: PAT_TA_74472
gggagtccgctagacgatcagatcatggtgactttgttgcagcggcaaactggtttataccacacattcgcgatactgaattagtagagtgccaggccatcaggaacggattatatctccagcaaacattggttgcaaatagtgttgaaactgagtctgattgtgtgctggcagtgaaagcaatgcaatcaatggatgagtatcttggagctgatgcagctgcggtattagagtgtaaacagatggctacgagtttcacgaaaattctaaaagattgcttccgagaagtgaatcaagttgctgatagtttagccagatattcattcgatagccgatcgtctggactgtggtagaattctaccccagacttatttctcttcttcttgtaaatgatatgatcattatctgatcatgtttggtcatattgttcaattgggtacaaagtggtatgcatgaacatctgcatttgtactgtgtcaaaaaaaaaaa

SEQ ID NO: 74473 - DNA, 550 bp, Triticum aestivum
  Clone ID: PAT_TA_74473
gatccagagcatcgagaacaagaacagccgccaggttactttctccaagcgcaaaaacggactgaagaagaaagttacagagctttccatcttgtgtggcgctgagatcgcgctggtcatattctcaaacaccggaaaactttacagcaattacggagaaggaatggggcaccttgtggagatagagaaaaagaagagagcccagggttatttttatagctcaaacccggtgtacgatgggcgaagttcaccagcattgctcgccgctcgattgccgatgttcaggaggcgaatctgcgagcagtgcccaaaaggcgctggtccgtgaggtgagtgctcgctgcactggtagcgagcacgcccgacactactactgtactgcctagatgccctacgcgctacacgccacaagtgggagacgtgcgggaaagggcgcgagtgagaagtagataaggcccggtgaagaagttcatcatcccttgcaatgcaaaacttacttacagtcaaaattaaaaagacctgtgtctgacccgcaaaaaaaaaaagcttc

SEQ ID NO: 74474 - DNA, 559 bp, Triticum aestivum
  Clone ID: PAT_TA_74474
aagcttttttttttatacaaaaacaatgaatggggcaatttccatactgcattatatcttaagagttggaaataattttgcaagttaagaaatataaagatgaatgtaagtgttcatatcaatgacgtttgctgattttttatgtttgcctagcatctactaaaactagggataattataaggtccaggaaacgctaaactctaaagcttatttttgtaaatgtctgaattcaaacaattggttattggctggatttgaccaagttgtttcttttttagtgttgctgttttcttaactattttgtgtatgtagacgtatcctaaaccttcatcaacaagatggcaaatatcttttataataaagcatttgaaagttatttaagagactagtagctcatttatttgcaatctgagagcattttggatatgttaaataattaagaaaactgtgtactttaaattatcatttcatgatcatctttaactttttctttattagtgcacatttgttttgacttggatatttaaaagtatgctttctcgatgctctggatcaatc

SEQ ID NO: 74475 - DNA, 549 bp, Triticum aestivum
  Clone ID: PAT_TA_74475
gattgatccagagcatcgagaagaagagatgagcgacgcgaatgacgagaatcgaaagctcacggaatcagatagactatgaaaccactccggttcgagaaagaagaagaacgaaagaattaggcagcactccggctgaacatggaatgaatagaacacgagcttcacaagatgggatggcacctttcgaaatgaccacgcaatgcctccggaagaattgaaagaattgaatgaaaagaacttagaaggaaggattgaatgaagttgttgagaaaatcaacaatgaaagaataagcttgttgtggacttataggtaacatctcaagatcatgaggtgataactgaccacaagcggaaatgattggatagctgagaagaacgaggagatgcaaaactccacttcaaaagaatacggagaattaattgcacttcgagacgcgagaagaaaagatacttgaactccgccaacaaaatcttgatgaactcttgaagaatgaattaaatcctgacgaaccaccatgaagaactccggcaaaaaaaaaaagcttc

SEQ ID NO: 74476 - DNA, 442 bp, Triticum aestivum
  unsure (1)..(442): unsure at all n locations
  Clone ID: PAT_TA_74476
tcatccgcccctcgctgccgctgcgtctcgtctccaccaccccacttgcccccggactcaggagtgatcgtcggagatgtcggacaccgataagcaccacttcngagtccaagggccgactcccggcgccctccaagacctacccgcagcaggccggcgccatccgcaagggtggacactatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagttggcaacacgaaggatgacctgaagcttcccact

SEQ ID NO: 74477 - DNA, 247 bp, Triticum aestivum
  Clone ID: PAT_TA_74477
gcacgagggtatacctcaaagcttccatggagaaggcgccaggcacgagcatcgaggctatcatccgacggcttagtgctccaccagtgcgcctccctccccttactccggcgaatccttccacagcggcgacccccgccgcagccaacctgtttcagccgcggagagccgccgtactggtctgcctcttccacgacgctaccggcgagctgcgtgtcctccttaccaagcgcgcttcctccctctc

SEQ ID NO: 74478 - DNA, 140 bp, Triticum aestivum
  Clone ID: PAT_TA_74478
aagtccctgatgatatacctgttgatcagagtggccgttgcattggaccaactccggcaaatgaaccggagcctcttttgtctcagaattcactgacaagaaaggcaggtggtagaaagccaacagggaaggatatgcag

SEQ ID NO: 74479 - DNA, 469 bp, Triticum aestivum
  Clone ID: PAT_TA_74479
tgcaggaattcggcacgaggatctgccattgcatcatagagtgttcagtcgttgctgtttcctctcctctcacaccactgctctccctgctcctgctccaccatgaggcaacaatggagcccctttgactttaaacaaccttgcggaggagtacggcaagcaagccgtggagagctcgacgaccaccgccgcatcgagcgccgccgcgcaccgacgcaaccaggacaaagaagaagagcatcggagggaaggatgaggccggcaaggtgtaccagtgcaggttctgctccctcaagttcggcaaatcccaagccctgggcggccacatgaaccgccatcgcctagagagggagaccgagaccctcaaccgcgcccggcagctcgtcttcggcaacgacaccctctccgccgtcggcgcacagataagtttcagggatgtgaacattggaggcagtgctccatcggccat

SEQ ID NO: 74480 - DNA, 391 bp, Triticum aestivum
  Clone ID: PAT_TA_74480
tgaagcagcctgcagcctgcagcgcgaccccgcgaggaaaccctaccgccgccgcagcaggagcagccatgggtatcgacctcgtcccggcgggaggaaccagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagactaaccgcccgccgctctccatgcgccgcctctccaacttcatgaagggaaaggaggagaagaacattgctgtggttgttggtacaatcacagatgacatgcggatccgagaggtcccagcaatgaaggttaccgctctgaggttcacagagaca

SEQ ID NO: 74481 - DNA, 191 bp, Triticum aestivum
  Clone ID: PAT_TA_74481
gagtcgttcgaggcccggcgggacgtggcggcggcgctgctggaggccctggtggacgaggccgtcgccgacctcctcctcgcgggctctggcggtgctgttccttcccgttgctgtttattgatttgttcattggtgctgctgttgtctgtgcgtcgtgtgtttgattgatgtatgtagagtcggtgatg

SEQ ID NO: 74482 - DNA, 357 bp, Triticum aestivum
  Clone ID: PAT_TA_74482
tggttttgggactttagcctcctgcgccgccgccgccgccgcccagcgaattcgacaagcccccgagctcgccggatccgatagccgtcacgttctccgacctccacaccgtcgacgggctcaatgccctcgaggcgcacctcgccggcaagacctacatctccggcgagttgggatcaccaaggacgacgtcaaggtgttcgcggcggtgcccgtgaagcccagcgccgagttcccgaacgctgcccgctggtacgacaccgtcgccgcggctgttgcttcaaggttccctggccagtcctctggggtgagtgcatcatcggctcctgctgcagctgctcctgccgcttccaagga

SEQ ID NO: 74483 - DNA, 341 bp, Triticum aestivum
  unsure (1)..(341): unsure at all n locations
  Clone ID: PAT_TA_74483
ggaccagaccgccagcaccctcggcgagaagacggaggcggccaagcagaaggccgccgagaccacggaggcggccaggcagaaggccgccgaggcgaccgaggcggccaagcagaaggcgtcggagacggcgcagtacaccaaggagtccgccgtcgccngcaaggacaagaccggcagcgtcctccagcaggcaggggagacggtggtgaacgccgtggtgggcgccaaggacgccgtggccaacacgctgggcattggcggggacaacaccaacaccaccaaggacaacaccaccggcgccaccaccaaggacaccatcagcaccaccaggaatcact

SEQ ID NO: 74484 - DNA, 272 bp, Triticum aestivum
  Clone ID: PAT_TA_74484
gcagtgctcattgctgtgctcaagctgacagtgtggtgagcaagacggcggcatcgacgtcagtccggtgggcgggtccagccgtcgacggcggcggcgtctctttccttgaacacggccgcaaggttcgccgtggccatggtggtgctggacgcgtggcagtacttcatgcaccgtggtgatgcactcgagccggtacatgtaccggcggttccactcgtggcaccaccgcgtcgtcgcgccatacgcgttcgcggcgcagtacaaccacc

SEQ ID NO: 74485 - DNA, 130 bp, Triticum aestivum
  Clone ID: PAT_TA_74485
ggcacgaggcaggattgcaagaagcactggcaaagtctatatggacttctttgcgtttgatggtggtatatcagagcacaaatcgacactacacagttcatgcaatcagctccagtggctgggattggta

SEQ ID NO: 74486 - DNA, 198 bp, Triticum aestivum
  Clone ID: PAT_TA_74486
ctatctcagacatgctgatgggacaacttgaatcacaaggattctaataactctgctcatgtggtaataaattctcatcaaggcccagaagatagtatcagacctagtcaatgtaagaacagatttagtcctcagctcaccttccggaggcgtgttaaaaggaaaattgatttggatgaggcagcagagggaaattat

SEQ ID NO: 74487 - DNA, 495 bp, Triticum aestivum
  Clone ID: PAT_TA_74487
gcgctgctgtccgcggatgaattccgccgttcatccatggcagcagccaaggctgcaaagcggcgggcaccaccacccaagctgctatacatctcgccgaccgccacattcgactccaccgcggtctactcgtgctccttctcaccatcatcatcatggggccgccccagagatcacggggacctactgttcaccatcgacggtgcccgcggcaactatgtggaggtagtgacgcccgcgccgtgcaatggcctcacccttctctacgatgctctcgacacagcctactacatctgcaatgcggccacacgggcagccactcgtcttctgccttctactgacgtagcatgcgactccagtgctgggctggggttagatgctcgcacagacgagcacaaggtggtgaggttgatcaatgggatgttgaatccgaaggacttggacccggtgaggtgcgaggtgtacacgcctagaggctcctatgtggattgccgc

SEQ ID NO: 74488 - DNA, 99 bp, Triticum aestivum
  Clone ID: PAT_TA_74488
ggcacgaggccgcctctacgaggccgacgcccgcagctatccacgccctcgcccagcacgacgtaccgtgtacgccgtggccaacatacacgccgggtt

SEQ ID NO: 74489 - DNA, 404 bp, Triticum aestivum
  Clone ID: PAT_TA_74489
gctccagccatggccgccaagtgctacccgacggtcagcgacgagtacctcgcggccgtcgcccaaggcaagcgccaacctccgcggcctcatcgccgagaagaactgcgcgcccctcatgctccgcctcgcgtggcactcggccgggaccttcgacgtggccaccaagacccggcggcccccttcggcaccatgaagtgccccgcggagctcgcgcacggcgccaacgccggcctcgacatcgccgtcaggctgctcgagcccatcaaggagcagttccccatcctctcctacgccgacttctaccagctcggctagagtcgtcgccgtacgaggtcaccggcgggcctgaggttcccttccacccggggagacaggacaagcccgagcctcctccagaaggc

SEQ ID NO: 74490 - DNA, 428 bp, Triticum aestivum
  Clone ID: PAT_TA_74490
cttctcggtgttcctcgccgtctccgtcgtcggctgggtcgtcttcacgtttgccgcaagattgttagcttggttcttgagccgtgtattacgtgcttccgttgtgtttcgagttgctggcttccattggcttgcgtgatgtaaccataaagttcagcaagggtcctcttgaagtctgtttcaattggtgaaataaaactaagtttccgcaagtcactggtcaaactaagtttcggtgtcctttccaaggatccaaaggtgcaactgctgattagtgatcttgaaattgtaactagatcatcttcgcgaagcaaaaagaccagcaaaccatcaaagcctcgctccacgggaaaagggaaatggttgataacatccagtatggctagacttttatcagtttctgtggcagatctgatgatcaaggtacc

SEQ ID NO: 74491 - DNA, 203 bp, Triticum aestivum
  Clone ID: PAT_TA_74491
cacagttcaccaccacccagcgtatcagtatcaccacccgctgcatgcagcatgcgcccgcgcgcgcgctaaataaaataaaggccaccgtctgtgttccttaattctgcatgccctgtgtgtgtacgaccagtgtccttcctcgtgcctccacttctaatgaatatatggcgcctcaactttgaaaaaaaaaaaaaaaaaaa

SEQ ID NO: 74492 - DNA, 192 bp, Triticum aestivum
  Clone ID: PAT_TA_74492
tcagtttcagtttccatctagattcgagtggtttgtcgatcggttgccgatcgcggacatcgcgatcctcgtggccgacgaggcgtacgagaacaggctgcagcgaggggcgcccttcgccggcgccggcgaggaggcgtccaaaggacgggagaactatcggggccgtgaccaaggtgtggggctcctggg

SEQ ID NO: 74493 - DNA, 478 bp, Triticum aestivum
  Clone ID: PAT_TA_74493
caggattcggcacgaggccaccaccacgcctccgccgccgacaaggaggcggcgaagaagcaccaccacctcgacgtcaacaccctgagtgggccacaccgactgtgtcaccgcgctcgacttctccagcgatgccttgaaactaagccaccgtatgcgcggatagggttgtgagagtgttcaggatcgatgatgcctcaagcaagagctttaagattctgaagataaacttgcctgctggggcacatcccactgccattgcttactcagaagggtcatcatccgttgttgtggcagcacaggcgctgttaggctcgtcgctctacatgtatgccgatgttggtgctcctccaactggtggaaaccaacagcagggcaagctttctcctcctgagatcacgtgggaccaccagaagattcacggcgaggaatcggtgctgaaccttgcggcagctcgtgcaactcatgggactggtga

SEQ ID NO: 74494 - DNA, 540 bp, Triticum aestivum
  Clone ID: PAT_TA_74494
cgaggaccttgagaattctggagcatctcaaggatgattgtttcaccatccggtgcgatttcatcatcgcccaagctgctgctgctgctcccttggtaaaggttccggccttctaacataagcgagcatctgagccatctcttaatgaccaaggtgggcgccgatgtgacgttcgaggtcggccatgagacgttcgccgcccaccggtgtgtgctcgcgtcccgttccgctgtattcatggcacagctctttggccccatgaaggaggggaccacggcggccgccatacgaatacaagacatggaaccggacatcttcaaggcactgcttggtttcatctacactgacttgatgccggagattgaggcggaaagagaagcagaagtagaagaaggtggagctgaggaggttacatggctgcgtcacttgcttgccgcggcggataggtttgatctccagaggctcaagtcgatgtgtgaagagaggttgctggagcacatagatttgagctcggtgtcggccatccttgcggtggcagcg

SEQ ID NO: 74495 - DNA, 449 bp, Triticum aestivum
  unsure (1)..(449): unsure at all n locations
  Clone ID: PAT_TA_74495
cctcaggacgctcggcggcgccacggcctcgaatcttgcagacggagaaactgatgtcggcgcctcccttgccggaaatcatgacggttcggttgttcctgggcagactggcttaccagatggttaataattccgagcgaagccaaggcaaaggattgaatcatgcaaagtgcagtggatctgaagatatggggatcaatcctttcggtgttcatttgggtgaggaaaatgccactgttgcgatctctaggcaagctggtggtgaaggatcagataatggggaaataagcaattgtgttttctctgatctggatcgagaagttggcggtggcattgaatgtgactctnatggtggtgagtgtttcagattcgacaaggcgaaaagcaatgaacatgctgaagattttgaaaggccagtctcagccgcaaatcagtcagaaagctatgtg

SEQ ID NO: 74496 - DNA, 462 bp, Triticum aestivum
  unsure (1)..(462): unsure at all n locations
  Clone ID: PAT_TA_74496
tttgatagaaatgccttcgaagtgtttgttgatcctgtcagcaacacattcatatgccaatgtgcaaagtttgccagagatagattactgtgctgccacatattcaggcttttcacgcagcttggaattcacgaaatacccgcgccaatacatcgtccccagattgaccgacnaattcaaggaagagaaggcaaagcagtacacagagaaatgcctagagaaagcagacagcacagcgagatatgaaatgttgatgagcaaaatggccgatctcagcaagaagatatgcagtgatggcacgaaatgcaacacattcatgctcgagttcgacagtattcaagagaaactgctagcaacagaaggagaaaatcctcgcaacaatgacaactgtatggagattattactaccagctaccttgtccagtctaggttagtaagttagagattcaggggaactcgata

SEQ ID NO: 74497 - DNA, 204 bp, Triticum aestivum
  Clone ID: PAT_TA_74497
gcatgactgggctcgacaagaagaaggcctctgatgttcttcaaagacttctgctgatgccatgtctcctgtgctagggagatgaccaagctctcttgtatctctgacatcatcccttagatggaggtctgtgacttcgacttcgagccctgctggctacgtccatgaacgccatcaacggatctgccttctccaccatccatg

SEQ ID NO: 74498 - DNA, 538 bp, Triticum aestivum
  unsure (1)..(538): unsure at all n locations
  Clone ID: PAT_TA_74498
gtcctcgctctccccggtgtcctcgtcgtctggtgcccccgttccttcgcaccctcggtcgttcctggaggtgttgatggcgcgcgacgctngagactgtcagcctcggccgaaacgcccctgcccgacgggttggctgggcgccccggatcgtcttcctctgctcgctccgacgaaggggagccgagccggcaggggcggccggctgtgacgtactccggcacctccctgcgtcggcccccgcccccgcaggaccctgtcagggatccgaggctcccgctgccggggtcaccgggagatgttcggcgtcgcgatgaggaccgtcggagacaggaagatttgcgccgtgagtcagcgctgcgggaggcgctcgtgacccggccgacgccggcggttcgttatagggagggcccggcgcccagcgccccggtcgcccgtgctactgcccccaggccttccaacggtaattggcggcgccgtgggtcgggttcgggcgattccggtgctgtgcgtgatgctccgtcccaccggcgtggtg

SEQ ID NO: 74499 - DNA, 284 bp, Triticum aestivum
  Clone ID: PAT_TA_74499
tcaggaagtttgcacagaaggccatgggaaccaacgatgtccgcattgacgtgaagctcaacaagcacatctggagcagcggcatcaggagtgtccctaggagagtccgtgtcaggattgcccgcaagaggaacgacaaggaggatgctaaggaggagctgtactctctggtcacagttgctgaagtcccccaggaaggtcttaaaggtttgggtaccaaggttgtggaggatgaggactaaaccccctgtctgtcgtatcgatcagttagaacttaatacata

SEQ ID NO: 74500 - DNA, 269 bp, Triticum aestivum
  Clone ID: PAT_TA_74500
ccaacatcacgccgggttctataaccgcgccctacctaaacacccagtcgttcaagctcgccgtcgtgctggaaggcgagggcgaagtggagatccgtctagccgcacctcggccgcgacagcgagcgccgcgagcaagagcacggcaagggcagggtggaggagcgaggaagaggaggacgaccggcggcagcaacgccgacgcgggtccggctccgagtcggaggaggagcaggaccagcagaggtacgagacggtccgcgcgcggg

SEQ ID NO: 74501 - DNA, 492 bp, Triticum aestivum
  Clone ID: PAT_TA_74501
ctctgaagatttaaggatgaagcaaatcccggtgtatgacatggatgagaacgtcaggcgtgaaagactcccagtggtcgctggagcttatgcacgacaattcaagaaagatttcacactttttcctgcagctgagagccaaagaattggtcccagaaggacggatggttgtttccctcccggggaggcgttctgatgagcctgtcaccgagacctctctcatctggggaactgcagctcagattttaggcgccatggcctcagagggtgtgattgacaaagaaaagcttgattctttgtacataccggtgcatggaccttccgatgaagagctgagagagatcatccaagaagagggctccttctcaatcacagagatacgggtgcacgaccctataagcggcatggaccgcgccctcctcaccccaaacaggatggtgaatagcctgagagctgctttcgagccgattatagtccagcattttggatcgc

SEQ ID NO: 74502 - DNA, 421 bp, Triticum aestivum
  Clone ID: PAT_TA_74502
cccgcgcagcttctcctcttcccgcgacactggcttcaccgacaccctcaccgatgccgcccattccgcagcgtccgcggcggtcccagcgagcttccccggcgaggtggcatgggccgcggaggactcatcaatggccgtcgcggcggtgcagcatctcatcgacgtgatccattccttcaccggtggatttctattgctctctccacagtgctgctacgctgtgggatgttcacaatttcgacgcttgtcaataaacgactatatggtatgcgtcaggaccttgaacaatacatcaagtgggtaaagaatactaagggtgagaaatcaatacaagaacttgcagatgcagcagatcctatggtcagaaagcttggttttctgccaactcttcacatcattgtgacaccatataccttta

SEQ ID NO: 74503 - DNA, 310 bp, Triticum aestivum
  Clone ID: PAT_TA_74503
cagcgacctggaaactcagtacaatggtggcgatcctgccattgactcactccctgcggcaggcacaagtgtggacaagtgtcgatgattttatgtccatgcacaccaattttggtagcttgacctctttggttcgttccgttgaaggtggtccaatgagcagacttattcaagatcagtgcgatttgcaacttggatttggtgcacagaagcagcaaatatatcctagttttgaggagcaccttcggatggcctcagcttgagcaccgcagttcgggaacattggcagacacaatcccatgcctttgcc

SEQ ID NO: 74504 - DNA, 513 bp, Triticum aestivum
  Clone ID: PAT_TA_74504
gcaggtaagaccccggcagctcttttaatccaaagaacctcaccaagcatgatgcagtgattagttagctagcctgctgtgttcgttttgatcccttaattacttctcttaagccaccagtagactactgaacgcttcttggcctgatgaagctaagcatacggagacctcttctttttcttgcttgcctgacttgaccatggcggcccggcttaagactttaagagcatggctgccacaccagccatggtggtctccgttctctgagagagagagggagaggagacggaggagcaggcggtggcgtgtgtatggcgcgagccacagacgcgtacacgtacgtacgtgtcagcaggcgcagcgggggcgggcgagggtctctctacagctggctcccgggtggacatctagctacgtcggcgaccggattaattagacgtgacccgaccccgaccagacctgcgcttaattaagcgccagggtggttgattaggcgccggatatgtatgtatg

SEQ ID NO: 74505 - DNA, 259 bp, Triticum aestivum
  Clone ID: PAT_TA_74505
ctgatggcaaagagggcattgctaaagcagccaacttactttgctccacttatttaaacggtgatagccatactcaagaggatgtcaaaagtgaagtgaatgtaaaaaatgagccagtatttacagaaactgacatggccagtgcactgaaatccataggttgtgctggaccagaacctgatcttctacttgtgtatggtcctgccagatgccatttaggctttcctacatggagattgcggtatactgagattatgca

SEQ ID NO: 74506 - DNA, 429 bp, Triticum aestivum
  Clone ID: PAT_TA_74506
tacacctggaactgagagggactccgtttgtaccccacccggtgcctccattgatcacttctgcagcccaggatgtagaaagatttataaacgactaaaaaagcttcttgggttcaagaataatatggaagccggattttcctggagtctggttcgctgttttgctgaaagtgaggctgcacccagtgaaaaggaaagcagaatttgtatattgcaactcaaagacagctgttgctttctcagttatgaatgagtgctttttgccacgtatcgatgagagaagtgggattaatataattcacaatgtcgtatacgattgtgggtcggatttcaatcgtttaaattttagtgacttctatacgtttattctggagcgtggagaagaagttatatctgcggcaactgtcaggattcatggaactgagttag

SEQ ID NO: 74507 - DNA, 359 bp, Triticum aestivum
  Clone ID: PAT_TA_74507
tccgtctccacacttggctactcacctctccctgtactgtgatcgctagctagcttcgcgcgttcccatggccagcctggtgcacccaaccggcggcgccgattgcgtgcagcgacgacgacttcatgccgcagagcttcgggtgcttcgggcgaggctcgctgtccggcgtcgtcggcccggcggctggagtacagggcgctgagcggcgagggcggggaggagatcaggcgcatcgcgcaggaggagcggtcggccagggcgaagctgcggtggaaggcggtggcgcaggagatcatggcgaggaggaggggcctcggcggaggcgcggcgcggaggaggaaggccgggttcagcta

SEQ ID NO: 74508 - DNA, 258 bp, Triticum aestivum
  Clone ID: PAT_TA_74508
tattaactcattgttgtaatctttttacgcctatgcttactgttaaaagaatgggccacttcacaaccaatcataaactggtggccacataaggctttgagcaagttttagggtcgggtcatccacaattaatcccgcttgtgattcatcctaatatttgatgttaaaatgtaaattgtatgtctatgcgcttaggctttctctttggttggtggtcgaataggacgttgctagcttcccttttaagtcatagttcac

SEQ ID NO: 74509 - DNA, 293 bp, Triticum aestivum
  Clone ID: PAT_TA_74509
ccgcccctacagccggcgggatggacgagatggaggcacggttcgcggcgctgaaaggcgcggcggtttgccctgagaaggagacgagggtgcggctggaggatctgggaggggaatcggacgaggaggacgaggtggagaaggtgatgcggtgggcgatggacgccgcgcggctcgacgtcgccactgccggcagtggtgccagcaacgccgaggagaaggaagagggagacaagagcagcacgagtagcgaggacgaggaagagagactggaactggaggagaagaggaag

SEQ ID NO: 74510 - DNA, 459 bp, Triticum aestivum
  unsure (1)..(459): unsure at all n locations
  Clone ID: PAT_TA_74510
gccgccacacgaacccccacccaacccgagcgagcgccggccgaggaggaagagaaggtgagatggctcgcggcgcggcggcgcggcagcggccgcgaagggcaagaagaaggggtccgtctccttcgtgatcgactgcnaccaagcccgtggaggacaagatcatggagatcgcgtcgctggagaagttcctccaggagcgcatcaaggtcgccggcggcaaggccgggaacctcggcgactccgtcaccgtcacgcgcgacaagagcaaggtcaccgtcacctccgacggcgccttctccaagaggtacctcaagtacttgaccaagaagtacttgaagaagcacaacgtgcgggactggcttcgtgtgatcgcagccaacaaggagcgcaacgtgtacgagctccggtacttcaacatcgctgagaatgagggcgaggaggaggattagagtgcat

SEQ ID NO: 74511 - DNA, 193 bp, Triticum aestivum
  Clone ID: PAT_TA_74511
taaccaacgggcaacgggctacggggagcgcatccttgtaagcatccaaaatggagtgcgaccctgttccgcaaagcctcacttcgtggtcatcccatggccaaccaccagccacatcatccccatcgtcgacatcggctgcctcctcgccctgcacggcgccgcggtcaccatcctcacgacgcccgccagc

SEQ ID NO: 74512 - DNA, 590 bp, Triticum aestivum
  unsure (1)..(590): unsure at all n locations
  Clone ID: PAT_TA_74512
tggatcccccgggctgcaggcggagcgccgccgcgccgccgcaccttctcccgtccccgccgacccgccgaacaccgaccctaggactcccatgccgctagcgcagtgcacgacccggccattcggatatcgtgctgggctcgccccgtcgtcatcagcaggcacagcggctcctgaatccagtagccacggccgcacacaacacacgccggtaggcggcacacttcacgcctccgagcgatggcgcagcttctgcaggtgtaacttcaaggtatcaccatggcgagatcctctttgctgataaccaggaacgtgagaatcgtttggatgctgaaaactctgaagtgagcactgtgaagtatgatatgcacttgacgctngatcattgcactaccccattgagttcgaatatnattctgctaactctgatgtagcgccagcatgtagaagctacaacatctacgctgatgttcgtaaccttcgttcctggtttatcacctgtgtaagttcctgaaaattggtaggcaacgcgctggttctgttcatgttcttgctgcccaggcacatcagattagaattagtaatctatc

SEQ ID NO: 74513 - DNA, 353 bp, Triticum aestivum
  Clone ID: PAT_TA_74513
actcagatgacagctgatggaaacatcaacagaaacagtgatggcaagcctatgctggtctccatcaggactaagggccgggggagctcttaatccccctcaatcgcgcaaccagagccacttcctaggtataacaggcatcggcatacaaggcatcggcagcagaaggtacactcgatgtttgtgtgcaccatgctgcgcaaccaagctcagttcttgcgtggaatggatcatgtaccactcccatatcggagtgcaacggtggttcatctatgacaacaacagcgattatggcatcgaggaagtcctcggttccatggatccatccacatacaatgtgacacgccacttgt

SEQ ID NO: 74514 - DNA, 325 bp, Triticum aestivum
  unsure (1)..(325): unsure at all n locations
  Clone ID: PAT_TA_74514
tgcagtgcatatctgctgctgcgggaacatccgcttctacgtgcaaggacttgcaggccctgccgaagcttgatgtaccccgtgcaagcttgccggagcaaaacttgtcgggacgtctgttcgacggaacaaaccataatgtttgccggagcagactactcctcagcatccttggtgtagatcttggggactttcttggncgccgcttcggggagctctgccggaaagtagtcaccggaaaccaacttcctcttcttattctgtccagttgatggtgtcacggatggttgagtcagcttgagcacaaatgatccctggttccaca

SEQ ID NO: 74515 - DNA, 567 bp, Triticum aestivum
  Clone ID: PAT_TA_74515
gcaggaattcggcacgagggtctgacaactgaggtcaagtctgttgagatgcaccacgagtccctcctggaggcgcttcctggtgacaatgtcggcttcaacgtgaagaacgttgctgtcaaagattctgaagcgtgggtttgttgcatccaactccaaggatgaccctgccaaggaggcagccaacttcacctctcaggtcatcatcatgaaccaccctggtcagatcggcaacggctacgccccagtgctggacttgccacacctcccacattgctttcaagtttgctgagctggtaaccaagattgacaggcgatctggtaaggagattgaggctgcgcccaagttcctgaagaacggtgacgctagtatcgtgaagattattcccaccaagcccatggttgtggagacctttgccacctaccctcctcttggccgcttcgctctgcgtgacatgagacaaacgtgttgctgttagtgtcatcaagggtgtggagaagaaggaccccaccggctcccaggttacctaggctggcatcaagaagaaataggcgcgctatcttgca

SEQ ID NO: 74516 - DNA, 565 bp, Triticum aestivum
  Clone ID: PAT_TA_74516
gcacgatgacggggcttcttaccagctgtctcctgtgggggaagagattgattgcatgagtaacttgtctgaaattgatgatcttgcaagcacgtttgcaaagttgaaccgaagtattagcggaacaaggaatcctggtgttattgggtgatagacgatcgatttccagggaaagttctttgactaccaccgactgggttcaggaagcagagttctcgaattgggtagatcatgatatactgggcagcgatgaattgcaggacagcaaacaattgtgtccacagccacagtatttgcctcagtttggagagtcgaagccattgagccgaacatcatcctatcccctggagccactacaacaccggtccagtgaacctattctgggacatagatctccttcatttacatcctattctccaccaagtggtggtgaattatcttatcctggacaaggtcttacgcggcactcgagcattccatcaccaggtgctggttacccaatgggttctccaagttcgtcgcttactggttctccatatgacatgcctggtctacctcatggact

SEQ ID NO: 74517 - DNA, 100 bp, Triticum aestivum
  Clone ID: PAT_TA_74517
aggatgtagagttggctgagctcacaccaactacggcagctctgaagaatccctgtgccaaaattgtgtacgatgagtataaccacgagaggtacccacc

SEQ ID NO: 74518 - DNA, 579 bp, Triticum aestivum
  Clone ID: PAT_TA_74518
tcagcaggtagcagtgcgtgcatcattggtcgtgtgtgcagtccgcatccctttcgcatgcctgcactacggttccctggtgtagttcaatgtttggctctgctccccctgtttgcagctcctttcaattattttgcagctcactggatatatttttgcagttcattgtgagaatccatggcgctggtcgcgccgcaccttttcctgcttcttctcgtctgaggcgagcaccagcgattaacatattcaagtcaagatggttaggtttgggaaaaagttgacggccggccaagttccaaagtggagaggttactatataaattacaagctgatgaagaagaaagtaaaacaatatgggcagcagctccaacagggagagaaagaccgttgccgtgttctcaagcatttctcaaagatgcttgatgatcaggtagaagatagcaacagagtgggaaggtttgtgtagagatcttacctcgaggttatcacagatgcgcataatatgacactgaattggcccaaaatagggggctacaagatgaacttttaaaggttaagacctcactgcctgcttcaacg

SEQ ID NO: 74519 - DNA, 370 bp, Triticum aestivum
  Clone ID: PAT_TA_74519
ctagtggatcccccgtggctgcaggtgagctgcagcgcaagatgccacccccagctgacggcggagtgccaggcctggttaccttcgtccccaagtactgcaaccagctccttgtgggagcaatatcggcctgtgctcacacaagttgtcaacattcaaccgcagctggcgcaatgaggcgttcaacgacaagatgctcgtcgatgcagtgcacaacattgttaaggccctggaggccaacttcgacacattggcaaaggcgtatgaggataagacactgtcatctctcttcatgatgaacacacattcgcacttcttcaagcaccttaagagcactaagatgggggagatcttaggcgatgagtggctc

SEQ ID NO: 74520 - DNA, 280 bp, Triticum aestivum
  Clone ID: PAT_TA_74520
ggtatgggagctgggcgcaatgctcaagacccaccgcaggaaccagaggtgggctagacaaggcatacaagaagagccacttgggtcacgagtggaagaaacccttcgccgggtcatctcacgccaagggcatcgtttcggagaagatcggtattgaggccaagcagcctaactctgccatcctgtaagtgtgctcgtgtgcagcttgtgaagaacggacaagaatgattgctgccttcgttcccaatgatggttgcctgaacttcatcgaggagaatga

SEQ ID NO: 74521 - DNA, 479 bp, Triticum aestivum
  Clone ID: PAT_TA_74521
ggtgccctgtgcgcgatggcttttccttgctctgtgagaatcctggcctgctcgtggggaattctctgctgtacttcctgtaccttgatgggcacaccctcgagtacaacttggcttagcattgtcctcaatgtgatcaacccaccggaaccggactttggtgctgctgcatatctcgcagagagttatgctggttcaggcggaggatggtgggctgggaatttgctctagctgatgacaatgggttcaatcatctctacctcttgtcaaggaaggtcagtgaaggaggtgatgcagaatgggtggagtgcccggtcatgtacctcggcgattcgcttccatttgctgctagtgtcgtcgtcctcaagaataatagcatttctgatgggctttgtcgagggggcaaataccattttggtgagcacggatgatggcttcttttcaatcgagctccagtccaagcgggggaggaagatgtg

SEQ ID NO: 74522 - DNA, 465 bp, Triticum aestivum
  unsure (1)..(465): unsure at all n locations
  Clone ID: PAT_TA_74522
atcaagatcttctgcaaggccgacgagggctactgcctctccgtccgtgacggcaacgtcgtcctcgccccgtccaacccccgtgacgagcaccagcactggttcaaggacatgcgcttcagcgcccagatcaaggacgaggagggtaaccccgccttcgccatcgtcaacaaggccactggcctcgccgtcaagcactcgctcggccagtcccacccggtgaagctcgtgccattcaacccggagtacctcgacgagtccgtgatgtggacggagagcggcgacgtcggcaagggcttccgctgcattcgcatggtgaacaacatccgcctcaacttcgacgccctccacggtgacnaggaccacggcggcgtgcacgacggcaccaccgtcgttctctgggagtgggccaagggcgacaaccagagctggaagatcctcccctggggcgaataggcctacgcc

SEQ ID NO: 74523 - DNA, 608 bp, Triticum aestivum
  unsure (1)..(608): unsure at all n locations
  Clone ID: PAT_TA_74523
cgaatcgagattcaccccggtcgtcctgactgtcagaggaaggacaagatgcggcggcggttcatcaacccggtgatgaaggattacgccgtcgacggctcctactggctcagccgcatgaggccccaagaaaacctcttctacgcgtccacggtggaagcaatggcggcgcaggcgcaggccaggaaggataaactcaacgcgatgctgccgttcgggagcaccctggagctgcccccgccggcggccagattcaagtcatcctgcacggactgcctgacgctcgacttcatgcctttctacgggcgagacagccccagcgagggcaggatcgtcgcgctcgactcgaccgggcacaccgtcctctacgacgccgacggcgacccttgctccgtcgaggcgctgccccgcgtcaactcctccaattggcgaactcccatctccctgtgcgtcaccggcgccgacgccnacgcagccgcccgggactccggtcgctccgacgtgctctacggcatccacatgttcaactcgggcgacttcgaggcgctcgtccactgcaacccccggaggattgatggagctaaagcttggcactggctcaagctccc

SEQ ID NO: 74524 - DNA, 236 bp, Triticum aestivum
  Clone ID: PAT_TA_74524
cctggccaggcgtcaagaaggcggagcaggctagcacaagactaaggagaccgcggaggcggccgccaagacgggcgccgagacgcacgagcggtcgaagcagggcaaggccaaggttgaggagacggccaaggagaaggccggacaggggtacgagacgctaaagcaaacggaggacgcggccgccgagaaggccggcgccgccgaggacacggctgcggagaaggcagcagcag

SEQ ID NO: 74525 - DNA, 558 bp, Triticum aestivum
  unsure (1)..(558): unsure at all n locations
  Clone ID: PAT_TA_74525
gctgcaggatcggcacgaggcgacctgtactgaaaggcatggatatcatttgtatactgatttttcttctaatgcctgtactttttctccatgaagtaattatttgcttgaagctaattttctggtcatggtccattcaacactactgggaactgctgaaaactagacaatgatgaagaccataagtgtcacagaatatttaaactatgaagcaagtatagtatcncacnattttgtttgaacctgtcacttgattataccgagtatgttccaaaatatttaaggtcatgtttgaaggtaattttcaggtcatgttccattcaacactactgggactgctgaaaactggacaatgatgaagaccagtgctacaaaatatttaaactatgatgcaagtatagtttccacatttttgtttgaacctaacacatgattataccgcgtcattttcttagtttgccttaggaaaatttggtggtatgtggttcaagtgattcagattattacttcctggattgacaaccattctttttccatgagtcacgtaatgtgaatcaa

SEQ ID NO: 74526 - DNA, 319 bp, Triticum aestivum
  Clone ID: PAT_TA_74526
ctcggggctcgagctatcaatggagaaggcgcaacacaaatatgtagggcttccggtgacgtgcgccatacttatatgcttgtttgctctgcaacactatggcacacacagagttgggtttatctttgcgccaatcgtctgcatttggcttctctgcataagcatgatcgggctctacaatatcatccactggaaccaccatgtgtatctgagccctttcgccgtactacatgtaccaatttctcaagaagacccaaaaaggtggctggttgtcactgggtggaatccttctctgtgtaacaggctcggaagctatgta

SEQ ID NO: 74527 - DNA, 467 bp, Triticum aestivum
  unsure (1)..(467): unsure at all n locations
  Clone ID: PAT_TA_74527
cacaaccagacgggaggaggaggagagcggcggcgaagattgtgtcgctgaagctgcagaagcgcctggcctcgagcgtcctcaagtgcggcaagggcaaggtctggctcgaccccnatgaggtcaacgagatctccatggccaactcccggcagaacatccggaagctggtaaaggatggtttcatcatcaggacagcctcagaagatccactccaggtctcgtgcaaggagggcacatgaggccaagcagaagggccgtcactctggatatggtaagcgtaggggtaccagggaggctaggctccccaccaagatcctgtggatacggaggatgcgcgtcctgaggcgccttctgcgcaagtaccgtgaggccaagaagatcgacaagcacatgtaccatgacatgtaccttaaggtcaaaggtaacatgttcaagaacaagagggtcctcatggagagtatcca

SEQ ID NO: 74528 - DNA, 487 bp, Triticum aestivum
  unsure (1)..(487): unsure at all n locations
  Clone ID: PAT_TA_74528
cggagtacgagagggcggtgttccgggcgctctcggcgctcgtcggcgaggacaggcacacggaggtgccgtcgaccggcatttcgagctgctcaaggagttccccaggggatctcatgtccctcaagagagcgcagctcctctgcttctatgtgggacggccggacacatccctcaaatttgttcaacaggttttgccggagaaccaagatcgggggaactatattacggcatgcttgctttccctttgctagagcttggacagaatggacgaagcttagatagctgctcggaaaggcttggctatnaacgagaacgacttctggtcacagcctaatatgtgccatgttttccagcaggaatgtcccttcagagaagctactgaattcatggaatcatgttctccatcatggacatcatgctcatcatttatgtttacccacaactggtggcatgttgcagtctgttacttggaaggcgaagcccc

SEQ ID NO: 74529 - DNA, 529 bp, Triticum aestivum
  Clone ID: PAT_TA_74529
tgtgcaagtcgaccaccactggccatctgatctacaagcttgtgagtgtattgacaagcgtgtagatcgagaggttcgagaaggaagccgctgagatgaacaagaggtctttcaagtacgcctgggtgcttgacaagctgaagggcgaagcggtaagagggggtatcaccattgatattgccctgtggaagtacgagaccaccaagtactactgcaccgtcgtttgatgccccttgtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggattccagcacccccaagtactcgaaggcccgttatgaggaaattgtcccggaagtctcttcctaccttaagaaggtcggatacaagccttaccaggttccctttgtcc

SEQ ID NO: 74530 - DNA, 477 bp, Triticum aestivum
  Clone ID: PAT_TA_74530
cctgccggcacatcccaccgccgaggagttcgacggcgatgcctcggaaatcgtccaagggggatgggaaggccgccgccgacgcactccgacgcctcgacctcgacgcctccgccgccgaggatgcacccgtggagacgccgcctccgcgtcccgaggcccccgcgccgccggtggaagcttcttcatccggcaccgccgcggtgggtggcggcccggaggaagaggacttgagaaggctccacgagctggtgggattcgatcgggagagagtggagttaactgaggaggaggtgcgcgccaaccatcagaggcaggaggacgagatatgtgccctggaagcgattttcggcgactacctagtcttgttcaatagaaaggagggtcagcgatctttccaggttcatgtgaatgttgagatcccagaagatggtaaagatgtttcggtgaggctcggttttggtactggagcactag

SEQ ID NO: 74531 - DNA, 485 bp, Triticum aestivum
  unsure (1)..(485): unsure at all n locations
  Clone ID: PAT_TA_74531
ctcgagtgctctctggctaaacctgatgccttttgtacatcaatggctctgaattttttaaggatcacaacttactttcaaagtaacaataatatttggaaaatatcagaggtgacagagaacaatttaataggaatagtggcaaataaggcccatttccttaaggtatcagcacataacacttttcactaatttggcccagttagcaatgctctggtttgtgccagtcaggaattgagagcgtcagtagtctttgcgtcaatnaccatcagactggaggtcaacacttagagagggactgcatacagttttgttcaagcataccccttcaagttataattgccatagactatgcttgataccaatgacctttcgatttgaactattcatattgtttaatttgattacctgggcaggatccaggttttggttgctagcaactgttatgatcagactctgttctctttttgtacgtatgctggtct

SEQ ID NO: 74532 - DNA, 482 bp, Triticum aestivum
  unsure (1)..(482): unsure at all n locations
  Clone ID: PAT_TA_74532
gactgctcgaccgtggtggcgcagttggtgggcggtgtgtttggtggcgcgggatggatcgtctggggtcgtggtntggttagtgggcgggagaaatccttgtcggccgggccggcaccgacgcggtgacgctcgtgggcgccgccgtgccttcctgaagggcgtcgggcataccccttccacctcacccctcgcgtaccgtgggaaaccctaggacatgtccgggcaacagcgtcgtcgtcgtcgcaatccttcttgagggtgttgtttggtatgcggcggtccggaatgctaggagcgtgcgcggcggtccggaatgctaggagcgtggtggtattttccggtgggcgcggcggttgcgggtcctcatcgttttcgttgatccgccggtnttggcattattttctcttcagttcctttttttgtttcttttgggcttgcttgtgctgtggccccagcatttgtatcgtgtggtcgttgct

SEQ ID NO: 74533 - DNA, 600 bp, Triticum aestivum
  Clone ID: PAT_TA_74533
cgggacgatggccagccacggagctgcgccggccgccggatccgacgccgcgcgcgtcgaggtcagcggcacaggccagacaaaccagcctgcttatccgcctttagtttctggggatcattcatggtccactacaactggcgcagcagcagcaggttcgtggaactatccagtggccaatcaaagtcaagatgcagtatactatgatccacagagggatgtatcggtttcaggagataatcaaaatgtggcaagcagtgcgcctcctgctgtacagtcgactatgggcttgacaaatgcaagtcattctcatgtgccttactcaagttcacttcagcatggctacaatcctgcagaatatgcaaactattactataactacccacaagcaacaaatagttgttctgtgcagcaaggaggagcaaaccaacattcaggtgcagcttatcagcctcttacttcatttcagaattctgggtcttacgttgatcctacaagtaacacatattacaatgctagtcgtcaccagactgcgccaggatatgcaagcaccaactattattatcagaccgacactcgtcatgatggaagctcaggaaa

SEQ ID NO: 74534 - DNA, 649 bp, Triticum aestivum
  Clone ID: PAT_TA_74534
aaacacccggggagcgaagcaagaaaccgagggctctcctcccaggcgcggatctaccagcctaccagggcgcggaccgcgcgaggctctggccttccgctcctccagcatgaggggaaaaaagatgatatatggattctccatttcccttatcctcatcaacctggcttccataatggagcgggctgatgagaatctcctccccgctgttttacaaggaagtcagtgccgccttcgatgctggtcctactgatctggggtaccttacgtttataatgaactttctgaagtccatagcatctcccttggcaggtgtccttgctcttcagtatgatcgccccactattcttgcggtcggaactgtcttctgggctctatcaacaggggccgttggtgtcagccagtattttcagcaggttgcattctggagaggtgtaaatggtgttggacttgccattgtcataccatcacttcagtccttcattgctgatagctacagagagggcacccgtgtgcgccagatttggtttgttgagtctcattggctcaataggtggtataggaggaagtattgtggcgaccgttatggctggaagggattattggggatttcctggattgcggtttgcatttattgtggtcgcgtttg

SEQ ID NO: 74535 - DNA, 511 bp, Triticum aestivum
  unsure (1)..(511): unsure at all n locations
  Clone ID: PAT_TA_74535
gtcaagcttcaggaatcggaaaaggaaacccgtttgcttgtggaagcattgatggtccaagctggaagactctcgtgaaagccttgtaacatctgagaaaaaagtgcgagaactggaaactcaactccaggatgagcaactcgtgtctgctaaaagtcaaaagaaatctgataatctggaaactgaactgcgaaagctcanagaaagaacttgaaaacgaaaaggctgctcgggaagaagcgtgggccaaggtctcatctcttgagcttgaagtagctgctacaatgagagatctatcaattgaaaaacgtaggtatcaaggggccagagaaagagttattttacgagagacccaactgcgtgctttctattcaactacggaagagatctcttctctatttgcgaaacagcaggaacagcttaaggctatgcagagaactttagaggacgaagagaactagtgagagcaccttgctgggtcttgatctcagtgaagtaccagtagcaaatg

SEQ ID NO: 74536 - DNA, 204 bp, Triticum aestivum
  Clone ID: PAT_TA_74536
tggggctgtcagtgtatgatttacagagcaaacaatgttttacttagtatgggcaatttgaaccctcacccatccaagaaggtgatttcacttcaagtccttgcacttggtgaggtattgtctctatctacctcatctgagggtccaagactttgtgcggatgctttatgccatcatgtttaagatctatgccgaggatcatta

SEQ ID NO: 74537 - DNA, 345 bp, Triticum aestivum
  Clone ID: PAT_TA_74537
gttgaaactagctgggagtagttcatccttaacggcttaaccggtcggtcttttggtcaccgtcctgctgcgattggtggtctgctgaaatcatcaggacggtgaccaaaagaccaccaatcgcagcaggagtgactttcaagtttggaaggcgaaaaagcgggagggatcctttttgtgctgtgcctgctgccttgcaaaactgaaagtctcagaggatgtaattagcgcacctcctgaaaaaacgccttagcgcgtagcctcgctccctgtttaaattactacaagtactagtatgctgtagagttccaggcagcatgttatggaaaaaaaaaaaaaaaaaaa

SEQ ID NO: 74538 - DNA, 434 bp, Triticum aestivum
  Clone ID: PAT_TA_74538
tgcaggaattcggccaggcctgggccgagagggatggtggtggtgcgccacggcgacgagaggcggcctggcacgaaggcgctcgaagcatccatggcggcaggcacgagggtagtgcggtccgtgtacctgccggtcgacaagggcgtcgaggtcctccacgtcggcgtaagcaaggggccgagcctacagtgccggcgcagccggagcgcgtcgagccgttggatccggcacgtcgaccacaaaaccggcgaggagcacctcttccgccggccgtaaattcaaccgctagcttttctgtacatcaatcggttgtaacttgtactagtaccgtaccgtccaagggaattagctaggttgccatggtcatggtgtccagattctttgaatctgccggcatgtttaagatggagggaaactgcggtgagccatgg

SEQ ID NO: 74539 - DNA, 422 bp, Triticum aestivum
  unsure (1)..(422): unsure at all n locations
  Clone ID: PAT_TA_74539
ctgatagcgagattggtacacgctgagcacctgcttgacgctgtactaacaaggagatgcttgggaagcgcatgtggaagttccctgccccgtatcctgatgaacacggtgcatttcaccatagcagggctgttgcgtactagggtgatcgtagtggttccagncaacggggcatggaggccgagcgttctacaatgtcatggaaagattactttcagcgagttgtaccaacagctttggctactgctcttgatataaatttgaccaacatttcgcttgtggtcattactgtgacattcgctacaatgtgtaaatctggggctcccatttacattcttctctttgcttaatttattcaggctagagaagccgagctttaacattcttggaatcatgctgattgtctctgttggagttctact

SEQ ID NO: 74540 - DNA, 601 bp, Triticum aestivum
  Clone ID: PAT_TA_74540
aatctcaagaggcggcaccatgctcgtgtaccaggacaagctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaggccgtgaaggtggttgacattgttgacaccttccgtcttcaggagcaacctgcttttgacaagaagcagtttatctctcacatgaagcgctacatcaagaacctcactgccaagcttgaaggggatgacctagatgttttcaagaagaatgttgagtctgccacgaagtatcttcttagcaagctcaaggaccttcagttctttgttggcgagagcatgcatgatgatcgcggcgtggtgttcgcgtactacaaggagggagctgctgatccaactttcctgtactttgcacatgggctgaaagaggtcaagtgctaatggcacagtatgctaaaatctttggggtcgtcagtatttttgctctgctctatgtatggttgtcagtcgactctc

SEQ ID NO: 74541 - DNA, 572 bp, Triticum aestivum
  Clone ID: PAT_TA_74541
gcaggaattcggcacgagggcgaagggtgccctcaaacgagtctcaaatgcagaggaaatccgaatgacttccttcatgaggataaagaggttatggacttcaaaacttttgatcctttgtttccaaagaaaccaaagaaggcatgctatgagatggatccaccttgggaacaagagaggaagtgtcagccctggtggcaagtagctgatgaggaaggactggcttcggcttgttgcagaaagagcaatgcagcacattgagaacaatgatctgccaaaacccactcagattgtgcgtattcatggggcaaaattgaacggtcatgaaaacgaggatggctgtgggaattcattatcttcttctggtaaagagtcgcggccgcaaccacacgacactatgatgtgcagctatagcctctcaagcaccaatgagacgaattcatctgacggtggaggctggcaacagtctcacaaaaatgatgcacattggggcacgcaggattcctatagtagtggtgatcatacgccacgcaggaagcccatatttcagaatcagaaagacgccgagaggg

SEQ ID NO: 74542 - DNA, 622 bp, Triticum aestivum
  Clone ID: PAT_TA_74542
caagttcggctccctagcttccaagatcagcagcggcaatggccgacagggccatgctaggttcagacaaaggatcaagaagcccatgcctctctttgacagcaacctcttccgggacagccccgcatcggcatccgggtggccggatgctgctgccgctgcacccaagacgtccagtcctggcccgagcaccggtctccagctgtttccgaggtaccagcagatggaggcctcctcctccaaggaccctgtcaggatcccagcagcccagttcccccagaggatggttgtggagaacccgtcggtcggttcgaacgggccgccgctccagctcgtccagccggtgtctgtcgcgcccccggcggggacgccggcaccggcattgccggcagcgcatctccatttcatccagcagcagcagagctaccagaggttccagctcatgcatcagatgaagctgcagagcgagatgatgaagaggggcggccatggtgatcatcagggtggcagcactggtgctggcaagggtgtcaacctcaagtttgatggctcttactgtacgggctcatcctcccgttcgttcctgacatctctgagcatggaggggagcattgcgagcttg

SEQ ID NO: 74543 - DNA, 110 bp, Triticum aestivum
  Clone ID: PAT_TA_74543
ctcggtcctagattagaaaccatgatacaatcgacgtgggcgtatccaactcgacgtgcttccgtgctcattggcggcgaaaccccgggagggggagagcgaatcgcccg

SEQ ID NO: 74544 - DNA, 527 bp, Triticum aestivum
  unsure (1)..(527): unsure at all n locations
  Clone ID: PAT_TA_74544
ccacaggttccccgaggaacaacaagatacatttgaattcgttgccgatgagttatcaattcttcgaaagagactacgatccatggtggttgttgaggttagtaattagtgcatgctactcatatcaacactctggtgctatgctgctgatggcatgttgtttggatgtttcttttaagactttttttgacaaatacaaattgattattaagaaatatactaattctgtgtgaagctccacaacataaatttgcaatgtgtagatngaagatgaaatcataagcagcaatgcaacataggatagtttacctgtagattgaggtgtctccggacagatatgaggaagttatttatcttccactgagaaagaacagatttttgtgagtttccactccaaaaagctatctagaataggattagcatcttttaatcctgttgagtcggtgtattgatactgttcataatcatggcacacttgtactgtttgcagaaatcctcactttggaaccgagtttgattttcactcc

SEQ ID NO: 74545 - DNA, 251 bp, Triticum aestivum
  Clone ID: PAT_TA_74545
ggcgttctacggggatctttgggcaaggcgaggagggggacgcgatggccgcacgcgcgcacaacaacgtcgctgccgctcagcagcagaacagagctttaggtggtggtggtggtggtggtgtacccgccatgggcgagcagcagaaggcgggcatggcaggcaggcccgaccccaagaacacccgccgcgcccttggcgacatcggcaacttcgaggccaacaaccggcgcgccccccttggcgacatc

SEQ ID NO: 74546 - DNA, 537 bp, Triticum aestivum
  Clone ID: PAT_TA_74546
gcggagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaacccggatgagatgatcaaggctggcaggctctctgagccatacaagggtattggtgactgctttggccgcaccatcaaggatgaaggctttggctcattgtggagaggaaacactgctaacgtcatccgttacttcccaac

SEQ ID NO: 74547 - DNA, 165 bp, Triticum aestivum
  Clone ID: PAT_TA_74547
agtaagcaaactgatactgatagagtagaagcagccgcttcagtggttgcccaaaccaatctatagttcttgctgctgctgctgctgctgagttgaaccaaccaatgggtagaggaagaggcagaggcagaggaaggacggcggccattgccaggagccatgaag

SEQ ID NO: 74548 - DNA, 500 bp, Triticum aestivum
  Clone ID: PAT_TA_74548
gcggtcagacaaggaagaaccatatttgattcctggtggtgacacactaaggttttcacacaacatcccttttcataggttgtcagaagctgataagccacatatccctaatggcgcctttgagctggatcctgcatctatgccttctaacttggaagaagcatcttcgtctgcagaccttaacaggagtagcactcaagaaggtaatattggaggcaatgtttcgtctaccagagactcttttaagtgtgaaatgccagctggtaagaccaaacagggactggatactgctgctacaaatgagggtaatgttcacaatggagtgaagaagcccaatatcaatgcagattgcaagcacgatgatggctcagaggcttctgtaattgatgctcatactgttgaccaatgggatgatagctttcaatctgaatctccagcaacttttgtgtatcccgaaccttagtttttccactttggtgatattaggtcctttgacaaat

SEQ ID NO: 74549 - DNA, 118 bp, Triticum aestivum
  Clone ID: PAT_TA_74549
ggcaaagcgtgtgttatcccatgaagcaggccctcctttgcaaggctgacgacgatagcttcaacttcgccgcctattctggtcgatgatgtcattgataataaccaggaagttttca

SEQ ID NO: 74550 - DNA, 289 bp, Triticum aestivum
  Clone ID: PAT_TA_74550
caccagcacagctgccggcggctgggagcatgatggcgcgggtggaccggctggacctggtggtggggtacttggaggagctgcgccacagcggcagcggcagcggcaggtcttccaccaccgccacaagcaccttgtcatcgtcgtccccgaccacgcctcgggctcgacctcacgggtgccggtcggcggaggagctgctgcgggagaccaatgccaaggggagcctggtggagcgcatcgcgttccttgaggaccgggtgctccggatggaggaggagcgcatgga

SEQ ID NO: 74551 - DNA, 570 bp, Triticum aestivum
  unsure (1)..(570): unsure at all n locations
  Clone ID: PAT_TA_74551
cgaaggttttataaatccaagcatcgctggacttgcggtgacttatgcactgaacctcaatgggcagttgtcatctataacctggaacatttgcaacacagagaataaaatgatttcagttgaaagaataatgcagtactcaaggatccctagtgaggctcctctaatagttgatgatcaccggcccccaaacagctggccaaaggatggcancttataatataagaaatttggaggttcgatatgcagagcatctcccatctgttttaagaaatatatcatgtacaattccaggacggaagaaggtggggattgttggacgtaccggaagtggaaagtcaactttgattcaagcacttttccggattgttgaaccaagggtaggaacaatagaaattgacgatgttgatctcagcaaaatcgggttgcatgatttacgaggcagacttagcatcatcccacaagatccaaccatgtttgagggcacagtgagaggaaatcttgatccactgaatgaatattctgacccacatatattggagacacttggacaaatgccagcttggtgac

SEQ ID NO: 74552 - DNA, 613 bp, Triticum aestivum
  unsure (1)..(613): unsure at all n locations
  Clone ID: PAT_TA_74552
ttagcatcaatttctaatttaagttcagttcattttctaatttaagtaaagtgagcactggaaaatcaattagtttgtttttacttatactccatgaacttgtagtaacctaattgatttggtgcttatggtcatataaaacccctagaaaaaaatcaaatacattattaacggtacaatttgtattctgtcattagttcatatagatcccccagaaaaaatattgtatgccagttaggtgtatgttaaatgtcgtagcctcgctcctccaaaaatcaaatacactattatcagtacaaattgtattatgtcattagttcatgtagaagcccccagaanaaatattgtatgctagttaggtgtatgttcaatgtcgtaaccccgctccccctcctggccaggaggcccattgccccgtttgttgcttaataccatagtcatttgtttctttatttctttatgcccgtcaggtgtctgcttgacatcggtagtctaaatgagctttggacttcaggtagcttcaaacacatgtatggttttacttagtgctggcgtgttccccttcttgcgtgttgatcattatctgcttatgaatagccgcgcctttcgtaca

SEQ ID NO: 74553 - DNA, 506 bp, Triticum aestivum
  Clone ID: PAT_TA_74553
ccttcccatggctcctccgacagctcaccgccggccctccccctccccttctctcacatcacagctccggcagctgtcagatccactacattccccaaccattcaattcttttgggaacccaattttttttttaatgcaaccctcacgccgcgaccaacgccatcgattccggcgacgtccaccagctcgcagcacaccgacgagctagtctccgaccctccatcctctggtccggctggatccaccacttctggtctccagcactcgcccacgacccctcgcctatagctagggtttcggctgcggcgtcccgtccatcaccggctcgtctccggcggctcctccccgtcggacaccgcgccctctccacccctgggtggcgccccctagctaggtgcgctcgtgcgcgttggtctgtatggcgttgaccccgacctcctttgttgcatctccggcgcggccgtgcattccgtgcatcatgtgatggcctcctctgccgcgcgac

SEQ ID NO: 74554 - DNA, 238 bp, Triticum aestivum
  Clone ID: PAT_TA_74554
ccaacttcgtcagcgcataccagtcggcgtcgctccccagcacgtccttcgtcaaggtctgcttccccggccagcccaacccgcccctcagcagcggcggctcgtcctcctcggggtcctccggtctgcgcgggtgggtcgtggccctggtcgtcctcggcgtggtgtccgggctggtgctcgccgagtgggcgctgtgtgtgggcgttctgccggaacagcccgaagtacgggccgg

SEQ ID NO: 74555 - DNA, 446 bp, Triticum aestivum
  Clone ID: PAT_TA_74555
tctcggacaccaaagctcatctacttctccttgaaaatctattagggttcatcagatttcggaggatgtcttgcaactgtggatccggttgcagctgcggctcagactgcaagtgcgggaaggtgtaccctgatctgacggagcagggcagtgcctggccgcccaggtcgccgccgtggtcgtcctcggactgtggcagcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaagtacgagcgtctgatctgagtggagtccagcaagggtgcgtgtgcgtgtgcgtgtggtttacttcgctcgctctccgcctatgctctgccct

SEQ ID NO: 74556 - DNA, 498 bp, Triticum aestivum
  Clone ID: PAT_TA_74556
acgccacgtcgacgcccacggcggcggcccggctgccgctccaccgcacctgttcggaggtgccacggcggccaccacggaggggtcagcggcgtcttcggccggccaggacacgggcgccttcgtcgccgccgatgccgatgccgaccgcctgacaccacggcggcggcgcgcatcccgccccaccgcagcacctgtacggaggcgtgggcgggacggcgtcggtgctggaccaggcggtgttcgtccgggaggaggagatggaggacgtggagaggccagccgccgtcgacatggccaacgccaacgcagacgtcgacggcagcatcaagaactactagtgcaacttacacttagctccagcgatcagtcggtgctctgtagtttcagtaagctagttactactgcccctgcctccctagtggagtagaaagaataaatcacaggtaaagctattctgtaacgttcacttgcttgcttacctatttagagcatctc

SEQ ID NO: 74557 - DNA, 478 bp, Triticum aestivum
  unsure (1)..(478): unsure at all n locations
  Clone ID: PAT_TA_74557
atcatttcatacgactctcctgcgcaacgagatcgaggtatggcttcccgatccctcacgattcacatccgtgctttcgtagtcgtaggtccggtattgctgcatcccacttgcatctcttgcgccggggattataatttgttagtacctccgatttctcttggtntttgttctcggttgattgttcatttgagacgcaacggatatgcgtttgtgcgcatggaaatgagactccggaaaattcatgaagggacggtataatcgaatttttaggatggggtgtgctagttcatggttttgttgatgcctccaagattttgttgttcgtcgcaaacttggcccgtttcttgttgctctctgaattcctgtgcaaggttaattgttctttctgcatgaccctttctgtataattgaccgtatatgtatttgtggtacgtttggagataccaaacatatcacttgttgcatgcttattccc

SEQ ID NO: 74558 - DNA, 250 bp, Triticum aestivum
  Clone ID: PAT_TA_74558
tcagagccttgtccgctggttcaacagcgtagctgcagcactatgcagacgcgctagatgaagttacatctgcttatgttggaaaacgcggaattggcaaatctcctgcgccaagcttgaaagaaaaggtgcctggtttgaaggagaatacgtcaggtcatgaaatggatctcccaggtgcaaaagtcggggaggtttgcgttcgttttgccccagagcctagtgggtatctccacataggtcatgcaaa

SEQ ID NO: 74559 - DNA, 471 bp, Triticum aestivum
  Clone ID: PAT_TA_74559
ccgctgccttctctactgcaccgccgcagccatggtgaagtactcgacggatcccgccaatcccaccaagtccgccaaggccatgggccgggacctgcgtgttcatttcaagaacactagggaaacagcgtttgccctgaggaagatgtcgctcaacaaggccaagaggtaccttgaggatgtgttggcacacaagcaagccatccccttccggaggtactgccgtggtgttggacgcacagcccaggtgaagaaccgtcagcccaatggtcagggacgctggcctgccaagtctgctaagttcgttctggatcttctaaagaatgctgagagcaatgctgaggtgaaaggtcttgatgttgatgctctctacatttcacacatccgagtgaaccaggcccagaagcagcggcgccggacctaccgtgcccatggacgcatcaacccctacatgtccaacccatgccacat

SEQ ID NO: 74560 - DNA, 556 bp, Triticum aestivum
  Clone ID: PAT_TA_74560
gactacgtcgttcttcttcttcgagttgggtagtttagctctacccaccagccatgggtaaggagaagactcacatcaacatcgtggtcattggccacgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctggaagtttgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggacggccagacacgtgagcatgccctccttgctttcactcttggagtgaagcagatgatctgctgctgcaacaagatggacgccaccactcccaagtactcgaaggcgcgttatga

SEQ ID NO: 74561 - DNA, 303 bp, Triticum aestivum
  Clone ID: PAT_TA_74561
tgcaggcgacaagcccccgagctcgccggatccgatggccgtcacgttctccgacctccacaccgccgacgggctcaaggccctcgaggcgcacctcgccggcaagacctacatctccggcgatgggatcaccaaggacgacgtccaggtgttcgcggcggtgcccgtgaagcccagcgccgagttcccgagcgctgcccgctggtacgacaccgtcgccgcggctgttgcttcacggttccctggccagtcctctggggtgagtgcatcatcggctcctgctgcagctgctcctgccgcttc

SEQ ID NO: 74562 - DNA, 382 bp, Triticum aestivum
  Clone ID: PAT_TA_74562
cccgggctgcggattcgcacgaggggaaaaaaaatggaaactcgaacccttcgtgctctgttgccgccgtctttggaggtggaggatggtgctggcggcgggggcgatgaggtacacgaggcacgagctggaggcgctcagcggcgcgccgtcgcgggaggcgcaggcgctgcggtgggccgaggtgtacgcggccctcgccgccgcgggcttctccggggactacgacggcctcctcgcctccgacgagccgctgaccaagagggggaagaaggtctccgggggcgggaagaagaggcccgaggcagcggctcaccagttgtccgagatgggtgcctggaggaatggtgattcgggggttcatcaggcgaccggggagccg

SEQ ID NO: 74563 - DNA, 113 bp, Triticum aestivum
  Clone ID: PAT_TA_74563
ccgggctgcaggctctatatctgcttgtccgaaagaacatgagaacattggaataaacttctgatgacaattggtggtggcaattccgatcgtaatcggactgatggtgattc

SEQ ID NO: 74564 - DNA, 136 bp, Triticum aestivum
  Clone ID: PAT_TA_74564
gcgccgccaggagaggaggaacctgggctctacccctcctctgcccgagtacccatctccctcgagtctctctttctctctcacagtagacagctctcctcgatcctcccctacccttgctactgcctactccttc

SEQ ID NO: 74565 - DNA, 615 bp, Triticum aestivum
  Clone ID: PAT_TA_74565
gtggatccccgggctgcaggcgacgcgcaacctccaccacagcccccgtctgtcgagcccgcactcctccgcgcctatctcagtcctccgcgcgcgcctccgatggcgccgtccgcgacgccttccgcttcctcctctccctcatggccaagccccactcccacgtgcggctcctggccttcagcatcgtggacgagctcttcatgcgctccaagctcttccgctccctcctcgctgacgggctcgacggattcgtcccgctggccgtcggcttccgcaccaacgagcagctcccgccgccggccgcctcggccgccacgctccggaaggccgccatccaggcgctcgagcgctggcaccacctcttcggcgtgcactaccgccagctccgtctcgcagtcgactacctcaagtcgtccgcgcgcatccagttccccggtctccgcgcggcacgtgccgcgcgggaggcacgcacgcaggagatcttgactgccaaggtcgaacagttgcggtccacgattggatccataaaggctgaaatccggtccaccatcgaagagatccgcaacgggctgggcatcatccgggctgagtatgagaaattcgagcgttatg

SEQ ID NO: 74566 - DNA, 247 bp, Triticum aestivum
  Clone ID: PAT_TA_74566
agaggccgaggaatttctgaactcgaaaatttggattcctggatgttgtctaatgaatccagcccgccgcctgactctaatgttcaggtcttgagtgatatcctcccctccacgggtatccggcttggagggatcgggaatcccgggaatgtagcgagtccttaagatagatgaagggtcgccacattgtctctctaccacggcaacgtgaggggtgactatggggagagttaatctctctcagacc

SEQ ID NO: 74567 - DNA, 174 bp, Triticum aestivum
  Clone ID: PAT_TA_74567
ctgccttcctccacgcccgtagggttaccggatctggaggagcccaagccgccgccagccatggtatcgcgagatcgctcgggagtgttggcgtacgcgcaccctctccgatcgccggcaaatggcagcaccagcagctccgccgcctcaacatccacgagtaccagggcgcgg

SEQ ID NO: 74568 - DNA, 107 bp, Triticum aestivum
  Clone ID: PAT_TA_74568
gcaggcagaacatgcgatcatttttactcgcaggtgaaggcctgcaaaccatagacatgaatcaggagcattatatggaggagacattgaaaatgagaaacctgttg

SEQ ID NO: 74569 - DNA, 219 bp, Triticum aestivum
  Clone ID: PAT_TA_74569
ctagtggatccccgggctgcaggaccgaattcttcgcgattcctctcccctcgcctcctcgtcctccccctcctagtgggatcgccggagaggaatcgcgacgaggtgcttcctcctatcagttaaatacaaagtcatggagcacaaggagaccggctgccagtctcgtaagggccccatcctttgcgtcaataactgcgtgcttcttcggcagtgcgg

SEQ ID NO: 74570 - DNA, 312 bp, Triticum aestivum
  Clone ID: PAT_TA_74570
cggcgcctttcattgccgcagcggagcaagatcgctaggctcgcgttgcccgccggcgtgacggcgaatgcggccggcacaggggtggaacgcggtgcaaggcgcgcacgaggagttcgattggcatggacgaactcggcgccttcgtcgccgtagcggagcgagatcgtcaggcctgtgctgcccgtcggcgcgacggcaaaggggccggaaaggaggtggaagcggcccaaggcgcgtgcgaaggacgacgcgcgctgttcgaccgggcggaggcttgcgcaggaggacgccattctggctgtagcccat

SEQ ID NO: 74571 - DNA, 410 bp, Triticum aestivum
  Clone ID: PAT_TA_74571
cgtccgcaattacctcatgctcctctgccccggattcctcctctcctcgcagcagcctctgcccccttctcaaagctccgccatccccgtcctgtactcccttgtgaaaagatcgatttttttcgacgtggaggagtcattccggctatgatccgtcctgtactcccttggaaaagatcgatttttttcgacgggaggagtcattccggcttgatccggtagtggcgatgccggccagatcctgcgactgcgccgacgcgagccaccaagggccgtgtactccctctctggctgcgcttccgccaaaccctagcggctcggtgtcccggcgaccatctccgaggctggtttctttctgcagcagccagcccatggagaaggcccggacaaattctcggagcagtacgccc

SEQ ID NO: 74572 - DNA, 149 bp, Triticum aestivum
  Clone ID: PAT_TA_74572
tgcagtgaatcggcacgaggggtctccgtggcgggctgccacgaggccaactacgtggccctcatgcaacgcaccttgctgccacttctacacacaccctcgccggccgacctgctcctataaaagcagctccccgtgtgaatcctcgc

SEQ ID NO: 74573 - DNA, 374 bp, Triticum aestivum
  Clone ID: PAT_TA_74573
ttcgcacgagggtcacactccactccactccactgacggcagcggcagcaggagcggcgccggcgcggacggcgagacgaccccagctacggcaccgggacgacggcgctgctctctctgggcagattgcagcggagaaagaagcccgcactcgcagccggcgctgtcgtggtcgtccatcccgctcgacctggccggcctggtgctccgcctgctccccacgtacgccgaccgcgcccgcttcgctgcggtgtgcccacagtggcgtgccgccgcgaagcggaagcagctgctgcccccaccactgccactgctcgcgcttgccggatggcaccttctacagcctaccgtataccaaagcccttccggttccc

SEQ ID NO: 74574 - DNA, 109 bp, Triticum aestivum
  Clone ID: PAT_TA_74574
gaggtcccagtgttgtcttacaaaacatgtttttaagatgagcaagcagtatcttgcaaatgtagctctcaaaatcaatgttaaggtggggggaaggaatactgttctt

SEQ ID NO: 74575 - DNA, 152 bp, Triticum aestivum
  Clone ID: PAT_TA_74575
ccgggctgcaggcggaaggccgaaaggccccggccgggaagaagcggctgccaggctggcaagaagaccgcctccaacggagggcggcggcgagaagaggggccggcaacaagggcaagcaagagcgtccagacctacaagatctacatctt

SEQ ID NO: 74576 - DNA, 433 bp, Triticum aestivum
  Clone ID: PAT_TA_74576
ccgccgacaggctttgactccatcgcctctccctcctcttcgtctccggccggccaggtagttaacagctccagcagccatggggaaggagaagatccacatcagcattgtggtcattggccatgtcgactctggcatgtcaaccacgaccggccacctcatctaccagcttggaggcattgacaagcgtgtgatcgagaggtttgagaaggaagccgctgagatgaacaagaggtctttcaggtatgcctgggtgcttgacaagctcaaggctgagcgtgagaggggtatcaccatagatgttgctctgtggaagttcgagaccaccaagtactcctgcactgtcattgatgctcctggtcaccgtgatttcatccagaacatgatcactgggacctcccaggctgattgtgctgagcttatcattgactcc

SEQ ID NO: 74577 - DNA, 465 bp, Triticum aestivum
  unsure (1)..(465): unsure at all n locations
  Clone ID: PAT_TA_74577
catcccatcccccaagtcataaacccaagtcggactcgccttcctcctcccccaactactcctcctcgcctccgcgcatcgcaccgcaccgggggttcaccctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctagtcatgtgcatngggcacccgaagattaaatccgccatgctggtgatcttggaaatgtgacagctggagcggatggtgttgctnacatcaatgttactgactgccatatcccccttactggaccaaattcaattgttggccgtgctgt

SEQ ID NO: 74578 - DNA, 103 bp, Triticum aestivum
  Clone ID: PAT_TA_74578
tagctcgtgccatttcatcgaccagaaagccgaacaatagatatccatccatttctctgccgcgtctcagaacatcatcatcctagtgcacaagcacaaactt

SEQ ID NO: 74579 - DNA, 356 bp, Triticum aestivum
  Clone ID: PAT_TA_74579
cagaagggtagtggaagcgagaaaacaaaggagcaggaggaacggaaagtgaaaactgaacatagtaaagtgaacccttctcaagagatgaagggtagtggaagtgagaaaacaaaagggcaggaaatacagaaaatggaaactgaacatagtagagtgaacccttcgcaagagttgaagggtagtggaagcaagaaaacagaggagcaggaggaacagaaagtgaaaactgaacatagtacagtgagctcttctaaagagttgaagggtaatgtaggagaaaaaatagaagagcaagaggatcagcaactggtgcaatgtgatcaagtcagtaagccagaagtggcacctcctat

SEQ ID NO: 74580 - DNA, 555 bp, Triticum aestivum
  Clone ID: PAT_TA_74580
ctcccctctctctgtcaggttttttttgcagtcccatgtatctcccttccctatagctcgctgctttgctcgtgcatctcgaaggtcgcaatacttgcccgaagctgagaacttcttgtgtgtgtgcattgccaaactgatggcgtctcggggaggaggaggaggagcgcatgctagccggccgccgctgagggtcgggcgcaccaaggagtaccgcatgggcagggacacgcagctactcgccgcccagggctcgccggtgagcctcttcgttctctgtggcgaccggttcgagggctcgcagctgttccgctccggcgaactgtcggtgcacatgatccgggtcgagggccaccccgtgtccatggcctcttgcaccgttcgagaccacccgtggatgctcgccagggacgcactcgttgcgcgtgttgacgcccgcgtcttcgtcttcgagctgccggggttcttctacgcagtcgtcgtgccgccggacgaagcttttggcgcccgcgccgcggagaggaaatgtgccacactggccgagatcttctctcg

SEQ ID NO: 74581 - DNA, 415 bp, Triticum aestivum
  Clone ID: PAT_TA_74581
gcggctctcatccatttctctcctcctcctcctgccaccgatcccgaaccaggaggaacccggcgcgaggagggcaaaggaagagaagaggagatcaccgagcccagcgcgcgcacaggacagcaggcgccgcgatctcgcgcaggagcggagatggggctcaccgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgttggggatgtcgggggtcaggacaagatcaggcccctgtggaggcactacttccagaacacccagggt

SEQ ID NO: 74582 - DNA, 494 bp, Triticum aestivum
  Clone ID: PAT_TA_74582
catatttggttagtacaaagaaattcaagaaaaagaaccaactttatgccccaagaattgactgattcaggaacgatgttatcttatgatggaaacaaattggttgttagtgggtatagcgatgctttggcctcccgcaatctggataaagtagaagatatgactgtcggaaggtgcgatggtttgttccctgaagagttggatgacagttttgtcttctgttcagttaagagtctccaattacatgcatctcatcttaccagcagcaaatcatcatcttcaaaagtgttaaactgtttcccagctctttctgtgttgcacatagctggagatggagaccatgactattaggaatgtgtaagggccttctcatggtgtaaggaactttccttcgcatggtgtaagggcctggttcttgtgcctgtggagaatgagaatggaggaggaattcaggaggacaagtcattgctccaatcattaagcatattgagatg

SEQ ID NO: 74583 - DNA, 457 bp, Triticum aestivum
  Clone ID: PAT_TA_74583
ctcacgtcaatctatctcatcaatggagcaggaggtggttgcggggataagcagaagaagtgctgcccgctccggcggtcgcgcaagggctgcatgaaggggcaagggccggccgggacaccagcagtgcccctttcgcggcgtccgccagcgcacctggggcaaagtgggtcgccgagatccgcgagcccaaccgcggcgcccgcctctggctcggcaccttcgccaccgcgctcgacgccgcccgcgcatacgacgccgcggccagggcgctctacggcgactgcgcccgcctcaacctctcggcgtcgccgtcccagatgcagcaccctccagcgcaaggcagtggcgcgaacggtaattcggcgcccgggacgccgtgctgctcctccaacaactccgactccagcgcgtcgaccccgaccgggactcccacggacatggactgcagtgcctg

SEQ ID NO: 74584 - DNA, 504 bp, Triticum aestivum
  unsure (1)..(504): unsure at all n locations
  Clone ID: PAT_TA_74584
caagagcctcaaggcatgtgcgatagatgttgattttttctttttaaatttcttctccctgccttccccgtttcctttttaattgctacgacttcagtcaaccaaaatcatgttggttgcacagttcaagttaacaatgccaaatgcagccacaactagacagtaagttccgtgagatcttaattgtacaagcagtttgctggctacacatttcggaatctagaanaccaaggcgaagccgaaagcaagcgatggcttgtgcagccgaagaaatcgctgggcaaacatgagaggaactggcagctagtaggatgcagcaaatgctagtaatggaagaaggcaccaggtaaaaaagggccgagcaaatcagggagcagagtgggatgcctgcaagggagattcttgaatacccctgttggcaaaatgcttccatctctggaggcgacccacaccaagttaagtgcaagcctagggattcccatctcttgcatccccctttttggt

SEQ ID NO: 74585 - DNA, 310 bp, Triticum aestivum
  Clone ID: PAT_TA_74585
cttacaccggcgggagaggagcgtgcttctccgctcgctgaaatctcgcggcgcctgctggttgatgttctgctccgggtctggcacagcaagaggccaatgggggaggccggtggtaggtaggcttctgcttctccgtcgtcctcggggtcgagcagattctcttggccggtgtgctgctctgatgccgtcttccccgtgcgaactcaacactgcacagtatactacaatagagatggacactgagaatggttttcttgctgctaagctaactgatgatctagtggtggagatcctctcccggctgccg

SEQ ID NO: 74586 - DNA, 207 bp, Triticum aestivum
  Clone ID: PAT_TA_74586
tcggccttcttccttcgagtttcagccatgggtaaggagaagactcacatcaacatcgtggtcattggccatagtcgactccgcgcaagtcgaccaccactggccatctagatctacaagcttggaggtattgacaagcgtgtgatcgaaaggttcgagaaggatgccgctgagatgaacaagcggtcgttcaagtacgcctgggtg

SEQ ID NO: 74587 - DNA, 468 bp, Triticum aestivum
  Clone ID: PAT_TA_74587
ggtgaagagttgctggcagccatatctagaagcttgtgggaataaggatggaggtgttcgcattgaggtagcgtctcctccacatagctacttcttggttttcagttctagcacgtactgcgcacgtgtcctgaatgcatctagtaatattaagtgcggaggtgattacgtagaattctgccgatggagtaatgcagttagaggacagcgtgcagaattagcatttaaagcaagaatttcattagaaggtcttcctgacactggtcttgaatttggcacatatgaagtaatgattgcttcttttggtggagatcttatcgatgtattaccgccaaaagatcagtggtcggcagagatagatctatgggtacggaatccaagcaaaatcccgaagcaaattgttacagatgttccttttcctgatcctgagccatggcaagccgattcagactatgaaggccaatctcc

SEQ ID NO: 74588 - DNA, 520 bp, Triticum aestivum
  unsure (1)..(520): unsure at all n locations
  Clone ID: PAT_TA_74588
ccgccgcgactagagtttcctcgctagggtttcgtctcccggtccggatcagcagcagcagcgggcgatggcggccgcgggagacgccggcgagaagaagatgatcacactcaagagctcggacggcgaggagttcgaggtggaggaggcggtggccatggagtcgcagacgatccgccacatgatcgaggacgactgcgccgacnacggcatcccgctccccaacgtcgactccaagatcctctccaaggtcatcgagtactgcaacaagcacgtccaggccaagcccgccgatagggctgccgccggagccggagccggagcctcggacgccgcccccgccgcccccgccgaggacctcaagaactgggacgccgagttcgtcaaggtcgaccaggccaccctcttcgacctcatcctggctgccaactacctgaacatcaaggggctgctggacctgacctgccagactgttgctgacatgatcaagggcaagaccccagaggagatccgcaagacc

SEQ ID NO: 74589 - DNA, 176 bp, Triticum aestivum
  Clone ID: PAT_TA_74589
cggcgtctgccggcgcggggattgcgctcaaggggggctccgacggcatgcgaggaagcggaaggccgccggcggcagcaaggggaagggcaaggacgcctccatgtccaccacctccgccaaggatctcctcgaccaaggaggactcggcagtcgaagcgctgcaagtccacgtc

SEQ ID NO: 74590 - DNA, 435 bp, Triticum aestivum
  Clone ID: PAT_TA_74590
cacagcctccacaaaacgatttgggacagccaaaatgtctcaaagcggaatcgatggggaatcggcgaaggagaggaggaggggcacgtggtcggagccgatcctggtgatggcacgaagggaggcaagatggcaacggaggtcccatttcggggaaactagaaccttgtccagcacggactgggttggggaggcctgacgattggtccaggtaaacctggcaccaattctatcaatctcgcggaggccgagatcggcaatgaaatcattaaacatttgcatccatgcaaagttaacgttcgcgttgctcttgtcctccgcgaaacggaggagattgaaatcgcctccaacgaccaccggaagagaagctgcctaaattttccggtggatctccttgaggaaggaagcagacctactatggtcggccggtccgta

SEQ ID NO: 74591 - DNA, 504 bp, Triticum aestivum
  unsure (1)..(504): unsure at all n locations
  Clone ID: PAT_TA_74591
ggtgcgcgccttgcggccggccagtggccggcgttccaccaggcgccgaggaacgtgacggtgctctccacgacgcntagggggaccggcgtgagcttcagcgacgagcagaggaagcagcttgccgcggagcaggcggcgcgcgcggtgccgctgacggtggaggcgcgggtgcccgtgcggctgcggttcgggaaggtgctgccggacgtggacggtggacgtgaaggcgacgtgccaggtgacggttgacaggctggccggcgaggcagcggcggccaacagaggatgccgggtcaaggtcaggccgttcttgtggtggtggtggtgactgctgatcgccaccggcgccggcgccgcttgtggttaccaatgtgtcaacggctagcaacagtaacagcggccgagcattaactgggaagttatttggcggtggggtgaattaaactttgtaaatttcggatatgtctcttgtggtgtgatttcaattgtttgattttgatg

SEQ ID NO: 74592 - DNA, 253 bp, Triticum aestivum
  Clone ID: PAT_TA_74592
cagagccagatacggctggggtggtgaaactcatcacagcgtgggaaaaataatcgacatcgagagtgatggtctgctcataattgatatccctaatcgatctgcatcttggcaggcggatccatcagacatggagaagatcgatgattttaaggttggtgattgggttagagtcaaagcaacagtcccatccccaaaatatggctgggaggatgtgactcgtagcagtatcggtgtagttcatagtctggaa

SEQ ID NO: 74593 - DNA, 579 bp, Triticum aestivum
  Clone ID: PAT_TA_74593
ccgtggtcggggtcatgggctgcctcctgctcgccgcctccctcgtcatgtcctgcgcttcaccaggtgcagttccggaacggcgccatctccgtcaacttcaggggcctccaggagctcaagcacaatttcgtcaagaaggagcagtcagagcagataatgcatgaaagacttctacagatggcaactttagccaccaccaagaacgagtcagatgatggaaatttcgcattatgggaggaaccctacaaacaggcgcgcaaatggacgccctgcgccgccaaatacaccttggaagaagagcctagcgacgacgacgatggattcattctgatcagcgcaaacggtggcctgaaccaacagcgcgtcgccgtgtgcaatgctgttgtcgttgcagctctgcttaatgccacactggttctgccccggtttcttcacagcagcgtgtggaaggacaaaagtcagttcggtgacatctaccaggaagactacttcgtgaactatatgaagagcgatgtgctcatcgtgaaagatttaccgccccatctccagtcgctggacctcgaggcaatcggtagc

SEQ ID NO: 74594 - DNA, 631 bp, Triticum aestivum
  unsure (1)..(631): unsure at all n locations
  Clone ID: PAT_TA_74594
ctggtctggccggaggcctctccatccccacccgaaggtcgcagattccggtgtggcaatggcgagggccccgaccatggtcgtccaggacgactacatcgacatggacctctccccctcctcgccccagtgcgcgctcctcgagttcgagtttcagagcgctggtggaggtggaggtggcggtgtgtccaggcgcagggaggaggcggcctacgcgtcgccggcggacgagctgttctacaggggcaagctcctgccgctgcacctgcccccgcggctgcagctcgtgcagaagctgctgcaggagcagcaggtgaatgtgccggagatcaagccggcggtggcggggccggcggcgcctagtgtgagcgcaagcgcggatgtgaaggacggcggcgacggccaggtgggcgccaagaggtactcttggtccaagaggctgaagctgatgaagcggtggacgtctagggagtacatcaagtccctcttcctcgccnaggcaggcgacctcggcatcgtcaacggctgctgcggccggagggagagggcgagcctgctggaccaagacgagctctgcagccaccgcaggtccttctccggcatcatccggcgggtgcgcctggtggtggcg

SEQ ID NO: 74595 - DNA, 503 bp, Triticum aestivum
  Clone ID: PAT_TA_74595
tgcgaatatcctcactcagccagatcccaccacgacaaccaccgcaatcatgtcgactcagagcgttcagtgcttcggcaagaagaagacggccaccgccgtcgcccactgcaaggctggcaatggcctcattaaggtcaacggccgccctctcaacctcctccagcccgaggtccttcgcttcaaggtctacgagcctgtcctcattgtcggtctcgacaagttcgcccaggtcgacatccggatccgggtgaccggtggtggccacacctcgcaggtctacgccgtccgtcaggccctctccaaggccctgatcgcctactaccagaagttcgtcgacgagcacagcaagaacctgctcaagcaggccctcacacaatacgaccgcacccttctcgttgccgacaaccgcagatgcgagcccaagaagttcggtggtcagggtgcccgctccagattccagaagtcttaccgttcagcggtcatttcacgacgactactac

SEQ ID NO: 74596 - DNA, 436 bp, Triticum aestivum
  Clone ID: PAT_TA_74596
acatagagttgtacgcaagctaagaaatctgtgtcgctgcaatagataaaattggttctttactaattaaccattgtttgttgatgttttatttgtgaaatttgattactactattttgatcttgagaagaacatggcaggttgttgtgcttctggatgagagggatagccatgaggcaaggagcagcaaggtctcattttcttccccagtttttactcctcgatttatggtttttctaaacacatgtgtgcaggtctgagagaaaaggagaaggggatgaatctagaggaagtagcttggtgaagaaaaagatggtctctctctctctacatactcgtgtttatttgttctgcagcaggctatgttgttttggagtgccagatagtagtaatagccagaagattacattcttcatgtgttacatatgtcttcttc

SEQ ID NO: 74597 - DNA, 200 bp, Triticum aestivum
  Clone ID: PAT_TA_74597
catccaggagctcctccattgtcgtctcctattgccctcgcataagggcccgagctagggaggcgccgtacgctcgccatacgccgtcatacttcgcccacagccgccgcatctcgtcgtcgagttcttcgtgtccggccaccaccgcgctaccccgaccacgtccacaagctccgcggggagcatctcctccgattccc

SEQ ID NO: 74598 - DNA, 276 bp, Triticum aestivum
  Clone ID: PAT_TA_74598
gaggctgaagaatgctgaagcttcaggaaacgatttgatgatgaattaaaacgacatcagctgaaacacaggctcgcgaagagattagaagatcacttgagcgctgaagtaaggaggctgacacataacagttggacaaaccgagggagaaaagaaagaaaaagaagatcaaatgtctcgctgcgaagcttacattgattgagtggagtcgaaattgcgagtttgccagcgatatgttcgtactcttggaaacgtcacttcaagaagagatggctc

SEQ ID NO: 74599 - DNA, 199 bp, Triticum aestivum
  Clone ID: PAT_TA_74599
ccagtatcctgaaggggagggggaccagagccaggcacctgaaagaccagcaagcaccccaagagcaacaaaggagtgaagaaaagtagtggccctaaaagtgctgaaatgaacggagatagaaaggaacacgcgatgaacaaacagagcatgtcaagagtcagaagggttccaagaaaagtaaaggccctaaaaatgc

SEQ ID NO: 74600 - DNA, 519 bp, Triticum aestivum
  Clone ID: PAT_TA_74600
ccgggctgcaggaatcggcacgagggtcattgctttactttcactcaagaagaaagaaacatcgccagattggtagaagcaaagacgcaggaggaggaggaattcatagtagatgcgtgcgcgtggatgaggattcgggggttggcgattaacgggcggcagggaggtggcgatctccgccgtcttcacggcgctcctcgtcgtctccatcctctttctcccctcggtcctgctcaccagcggcaggctcggcccatcgtccgccaaggagtggccgttcctcacggcggccaaggacggcggcggctacccggtgtcgttcgcgtacctcatctctgcgtcgaccggggacgcggagcgagcgacgagtctgctggcggcgctgtaccacccggccaacagctacctgctgcacctggaccgcgatgcccccgccgaggagcaccgccggctggctgagctggtgtccgggcagcccgtgtacgggcgcgtggggaacgtgtggatcgtcgggaagcc

SEQ ID NO: 74601 - DNA, 445 bp, Triticum aestivum
  Clone ID: PAT_TA_74601
ctagagtgcacaattgatgatttgatgaaatacggggcacggtttgtttcattttttaatgagtgtacgaatacatttgctggtctcacgcgcctctacctggagaatttaagattcgctgaatcggacttcgtctgcaacatccttgatcacttgcaagcagattaaaacatttaggttttctcaattgcgacacagagagttggataacgctccaaatggaacacgcagaactcagtgagctcagtattgtcaattgtcgttttgacatggtcaaagtcgactgggttccgaagctaacccgtatggtgtttgagtattggatgtctttcaaagaaccgccactgtcatttggctatgtcccattgcttgatgttctgagtgtttcagatgttggtcttagttggcatgaaatggtcaagttaagtacatttcttcatgagac

SEQ ID NO: 74602 - DNA, 439 bp, Triticum aestivum
  Clone ID: PAT_TA_74602
cccccccccgccgccgccgccgtgacgacctccctgatctgtgcggccgcgcgacctcccggacctcccgccgtcgcgaccagacccccgacctccctaccaccgccgcggctgcaccccacctccaaccacatcgccggcaaccaccgtccctcttccacaccggcctccagccacctcgctccccctccatcgccggcgaggcttctcctctcccttgtttctcggcctgatccagtgggaatgaggcaccgatcgaccaagcagacacggcctcctctgcttccaacacgagggcgccctcccgcccgcgcgctgctgtcaaattaccggtcgtcacctgctgctactcctgggtggtggtgcggtctccctgcttggccaccgtggggagcttgctggatggctcacgtgcctccccaactgcagcgtcaagggc

SEQ ID NO: 74603 - DNA, 459 bp, Triticum aestivum
  Clone ID: PAT_TA_74603
ccacagagcagacaggcagtgagagagaagcagagagagctaggagcagagatggtgaagattccgagcccgaggaggctgttcaggagccggtcgaggaacacagtgggcggcatcggcggggtggacatgtgcgccatggtggccgagcacgagcgcatcgagtgggaggtgcggccgggcgggatgctggtgcagaagcgccgggcgccccacgacgacggctgcgacgacgccgtcgaggccatcctggtgcgggtctccgccggctgcggcgggtggcagcacgacgtgtccatcgacgccaccgccaccttcggcgacctcaaggtgctgctgtcgctggccaccgggctgtggcccagggagcagcggctgctgtacaggggccgggagcgggacgacggcaaccacctgcacatggccggcgtccaggacaaggacaaggtgctcctcctg

SEQ ID NO: 74604 - DNA, 494 bp, Triticum aestivum
  Clone ID: PAT_TA_74604
gcaagaccggaaggagcggagccgccgagccgggaagagccaccatcccatcgcctccgtttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggcaggctctctgagccatacaagggtattggtgactgctttgggcgcaccatcaaggatgaaggct

SEQ ID NO: 74605 - DNA, 324 bp, Triticum aestivum
  unsure (1)..(324): unsure at all n locations
  Clone ID: PAT_TA_74605
cagaatacagtcagactacagagagatgggaaagggagaaaagcagcagggcggcgagctaggtttaggtctttgaccacggcgatgatcggcgcggctctacttccttctcttctccnggcagctgccggcgaccactttagcccgcctccgccatctccatccgcttgcccatggaacgggcgcgagcgaccaccggctgcaggcgtcactccaagcatggagtctaagatccagaagaaggtggtgaggaagaggacttcggcctccgattcagcatcacgggagtctccttcgacggccacaaagccttctcgtcctcgg

SEQ ID NO: 74606 - DNA, 251 bp, Triticum aestivum
  Clone ID: PAT_TA_74606
ccggctcgaggaaggagtgcgctgtcgcctcgcactctccagcgccaccgatttgcgggccgcgcctcccctcccaccacgcggccgtgagcgaggggccctccggctcccccaccgccgaggatcccatcctcctcggcgtccgtgacgactgcgtggtgtcatccagatcgagaggcccggccaagccgacgcccagttgcaagcccgtcttctacgcgaagatacggcttctgaccagagaggatctg

SEQ ID NO: 74607 - DNA, 467 bp, Triticum aestivum
  Clone ID: PAT_TA_74607
agctcactgagacagctcaaagaaatcaaatcagctctgttcaacttcgcaagtccactagtagtactacacacaagggatcacaagtcagtttccactccagcagcgcagcaagaacaagaagtataggagaagcgtatggctgctccggcgaaggcgtcgtggatggtggcaatgagcgtgggcgcagtggaggccctcaaggaccaagccgggctctgccgctggaactacgcgctcaggtccatccaccgggctgccaaggccagcgtccgcggcggcgtctcgcatggcaagaagcagcttccggccaccgcggtggtggagacgtggcgagcggagaaggctgaggaggggctgaggaccgtcatgtacctcagctgctggggcccaaattaggagtactagtacttagggttgctgtgtttgttgcagcttgtgcttatgcgacaaccccatgatcgatg

SEQ ID NO: 74608 - DNA, 489 bp, Triticum aestivum
  Clone ID: PAT_TA_74608
ccctaattgggcgaccattgttccgagcaaacatggccactgaaaggcatgctggcaagatatacactagggcaatgtttgagcagtttggccacatcatatatgaatgcggtgcttaccaggtggaagaggttgagaaagggaaaacatatgtggcaatacatacggacgcaacaaggagagagagatggtgtagggtttcatacaaagtgaccgtcatagacggtggtgatgaatttgattgtgagtgcgggcaattctcccacatggggatgctgtgcagccatgttctaaaggttctcgacttcatccgagtaatggagataccacataagcatattgtgaagcggtggacaagagacgcacggggcatcctgcctccgcatcttagtcaataccagagggacaatgctagcagcaacaacccattcagttacaggcatttcaacatgtacatgcaggccatggagcttgtaagaatgggggatg

SEQ ID NO: 74609 - DNA, 385 bp, Triticum aestivum
  Clone ID: PAT_TA_74609
aggcggcggggcttggtgcgggccggttcctctggatcgagccttggctgtcccgaggcgtgctcttgcgggcttggatcggggggtgctctgctgtcccaactaatcaactacaggtccagaacaaatcggcgctagaattcgtcgacgtagccgccacccagcgccggccatctcgcccgagcacgcgacaaatcaagggatgccaaggaggagcgaataagcgaagcaaggggcgagcgttctgctgcagtcaaacagggccgatgggacgctgctcgctgcaggtcatacaacaaatacaaggctgcagttgagcctgttcaacaatggttcctgctcattgtggaaatgccgcacgccgtgtctgccagccaagccacat

SEQ ID NO: 74610 - DNA, 403 bp, Triticum aestivum
  unsure (1)..(403): unsure at all n locations
  Clone ID: PAT_TA_74610
ccaaaagctcgcatggaggaaacgcgaaccacgaatggagtgatgaataaacgatgccgggatggaacttctgttggtgcaaggagcttttctgcatcatcatcaggggtgcaaaggattaagtcggaaatggaggatcatgnggttttgttatctgccgccaaggaagtggcttaggtcaaatgggtaccttcactatagaaggaagacaataaccggtagtcttgtttgcatcggacatgctgattattacgtgttgatacgctcatttgcaaagcttgcagaagttgatgttagggttctgcataccagtgtgctaaaacttgagaggagacttgcctggatagaagagcgaataggcagaagcttggatgccttgcagaatccacctattagctaagtg

SEQ ID NO: 74611 - DNA, 492 bp, Triticum aestivum
  Clone ID: PAT_TA_74611
caaggaactacccagtgcacaggtcaacaacagttcccatccgttcctccgcaacagctagtcgcactgtcatctccgttccctttcaccagtcctctatcagggggtgggtacgtctcgacgtcccacggagggggaagcggccactccttccaggccatgacctttccacagtttgatggggaaaacctgcggctgtggaagattatgtgcgagcagtattttgcgatgtatgggatcgacaagtccttttggttgcccatggccacgctcaatttttccaacaccaccactatctagctgcagtccgtccaacgcaaagtatctggactaaattgggaggggtttgtgagtttttatgtgggaagtttgggatcgatcagcaccagcagttaattagactgttttaccacagttcgtgcaggggctatgcgacgacttcggggcggtggtgctcatccggcggccgacggaccttgacacggccggttc

SEQ ID NO: 74612 - DNA, 306 bp, Triticum aestivum
  Clone ID: PAT_TA_74612
acttgatgaccataagagctttccacagcaagatattgaagcgtttcagtctcggaaccgcagtgggcttcctgcataacaaaaggggttctcacagaaacccccgccattcttgtcttcgttgctcgaaagggtcacaagacatggcttaatccgaaccaatgccttcctgcgattcttgcgggtccaggaggtgtttggtgtgatgtcgatgtcgtagaattttcatactatggtgcaccggctcaaacacctaaagaacagatgtttagtgagcttgttaataagctgtgtggcagtgacgaa

SEQ ID NO: 74613 - DNA, 179 bp, Triticum aestivum
  Clone ID: PAT_TA_74613
caatggcagtggacccatttttgggcagcagacagatgatgaagttagctcagaagcgataccttcttgatacacaacaaagagatgcgagtttcactggttacggcatgctcaactcttctatttcggatgaggaatgaagatccagtttgttcggaaaaagggagcataaaaacacc

SEQ ID NO: 74614 - DNA, 546 bp, Triticum aestivum
  Clone ID: PAT_TA_74614
agcagtagtagtacgtgagctcctctatcactagtgcatgtgagcgtgtgttcactgattcagctacatatctatgcagctgctgtatcttctctcttagcttgtcctccaattctcttcgcttgatcctgggaagctagataccctgtagtctagctaacagtgattgtggtgcacgggatcggcatggttgacctcctggcgtccaaactgctgcagttcgcggcgtggagagccggccaaatcaagaacggccccggtctagcccatcctcctcctcgtcttcccctccgcgactggatctcgctgcccatgcgtggctcgcgccgcggccaacaccagctctatttgggcacggactgaagcggcacttgtggctagggcttttggcgccgccggcggtctccatggttgtgttgcggttgccgtgtctgcgccaatcgttgtctggactggttgatttgttggatctgacttcgccatctccggcaccctgctgcggattgtggtggtcatcgaaagatctttgtgagggtttctttctcc

SEQ ID NO: 74615 - DNA, 111 bp, Triticum aestivum
  Clone ID: PAT_TA_74615
aagggagggcttcttagtgcgtatcatttgagctggtggagaccaagcaggaggaggtgattctggtgatatgcagtagcacctaacaagactaatccatatcgtctgctg

SEQ ID NO: 74616 - DNA, 447 bp, Triticum aestivum
  Clone ID: PAT_TA_74616
gtttaataaatagctggctcgatcacattaacattcccatatttcaactgcaacataccttgtcgataagtttctgttgcactccatatcagttattggacttgtgccttagttagtgaaccaactacgagatgaagggatgattctatgatgaagagcaccttatgaacatcatcatttttgtcaagatttctgtgcagtggaagcgcagagattcatatatttgcttccttattacttcagatgcatttaactgtagtccacttgtccgactggaaaactttgtgtccaatgggctggtatggtatggtagggtacacatgtctgaatatcttatgatgttaccaaattgtagttcttgacagagatttcatgatgtctcagatgatagctcatcattgaagcacacacattttaagtgtatgatcacgacactttctctgctga

SEQ ID NO: 74617 - DNA, 526 bp, Triticum aestivum
  unsure (1)..(526): unsure at all n locations
  Clone ID: PAT_TA_74617
aggagttccaagctcttagaggcgttccacgtcggtacttcttcccttggctaagctggatgggccggcggggcttcgaccggcgccttcgcaccgtgcgcgcgctctaggaacgtttgtggacaagatcattgacgagcacgtgaggaggggcaagaaccccgacgacgccgacgctgacatggtagacggcctactcgcgctcctcgctgatgccaaccaagccagcggggaggacgacctccgcttcacccgcgacaacgttngggccatgatgatggacatgttgtttggcgggccggacacggtggggttcaccattgagtgggcgatggcagagatnatgcattgccctgacatccttctgcggctgcagcaggagctcgtcgacattgtggggcttgatcggactgttgacgaatcggaccttggcaagctccccttcctcaagtgtgtcatccaggagacgctccgaatgcacccaccgatccctattcacctccacgggaacaccacagattgcgtc

SEQ ID NO: 74618 - DNA, 516 bp, Triticum aestivum
  Clone ID: PAT_TA_74618
cgcacattgcgcattggcaactccgtcgccatacatctaggttggctagctagcaatcccggcccgcctcgatcgatagatctctcctcgctggtaaacatggagctggcgacgatggtgacgctgacgctgttggccctctcggcggcgacgctggcgcggctgctggtggagcgggcgcggaggcggcggtgctatctgctggactacgtgtgctacaaggggacggacgaccgcaagctccccacggatctgtgcggcgagatcatccagcggaacaagctgctggggctggaggagtacaagttcctgctcaaggtcatcgtcaactccggcatcggcgaggagacgtacggcccgcgcaacatcatcgcggggggcgacgcgagccccgaccgcgtcgccgagggcatggaggagatggacgagacgttccacgccgtgctcgacgagctgttcgccaggtcggccgcgccgggcgggctgggcctgcgccccgccgacgtggacctgctc

SEQ ID NO: 74619 - DNA, 431 bp, Triticum aestivum
  Clone ID: PAT_TA_74619
atataaggcatggtatttgggtgaaaactaagccaaaccatcgctagtggcatgggaggaagtatatgtagtacatgcggggttaaggtttgtattgtcttttgtaacttggttgtatggtagataggcgactgatgactctatgaaaggtaagatgaataaatagagctactgatggtgaatggtactccctccgccccgaatcacttgtcatgcaaatggatgtatctagaattaaatatacatttaaatacattcatttatgtgacaagtaattcgggacggagggagcacctacttacgctagcttaggaataaggtgcaggggactcttcaagagaaacatgtatccttcaccttatatctcgagttgtagttcttgtagaggataataacagctggcaatagaggagtaaaaaaaaaaaaaaaaa

SEQ ID NO: 74620 - DNA, 297 bp, Triticum aestivum
  Clone ID: PAT_TA_74620
accaaccccgacgtcacagactcccacagctccggcccccaaaccaaaaccctataaaccgtctggtctggcctctccccaccccacccaaaggttgcagattccggtgtggcaatggcgagggccccgaccatggtcgtccaggacgactacatcgacatggacctctccgcctcctcgcccaaatgcgcgcttcctcgagttcgagttccagagcgccggctggggcggcgctagtgtgtccaggcgtagggaggaggcggcctacgcgtcgccggcggacgagctgttctacag

SEQ ID NO: 74621 - DNA, 346 bp, Triticum aestivum
  Clone ID: PAT_TA_74621
gatcaacggttactgcaaggagggcaaggagaagaaagcaatgaagatgtttgaacatatggctgcgaaagggattcgtacgaccgtggtgacctatacgtcattgatgtatgccttgtccaagaaggggatggtccaggaggccgataggctgttcaagtgaggctgtgaggagaggcatcaggcctgaccttgtcatgtacaatgccctgatcaatagccactgcacaggtggagatatggaccgggcatttgagatcatgggagaaatggagaagaagagaatcacaccagatgacgtgacatacaatactctaatgagggggctgtgcttgctggggcgtct

SEQ ID NO: 74622 - DNA, 441 bp, Triticum aestivum
  Clone ID: PAT_TA_74622
gagagaagaggaggaagatgtcgggccgcggcaagggaggcaagggctcggcaagggcggcgcgaagcgccaccggaaggtgctccgcgacaacatccagggcatcaccaagccggcgatccggcggctggcgcgcaggggcggcgtgaagcgcatctcggggctcatctacgaggagacccgcggcgtgctcaagatcttcctcgagaacgtcatcccgcgacgccgtcacctacaccgagcacgcccgccgcaagaccgtcaccgccatggacgtcgtctacgcgctcaagcgccagggccgcaccctctacggcttcggcggctaggccgagggcccagccgtccagctcgccacgccgccgtccgaccgagagtagtagtggtatctatctggttgctgtctagggttcgtggctctccgtgtatgcgcagtgtttc

SEQ ID NO: 74623 - DNA, 501 bp, Triticum aestivum
  Clone ID: PAT_TA_74623
gctgcgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttgatggaaagaagcttgaggatatcgttccttcatcccacaactgtgacgtcccccatgttgaccgccaagattatcagctgattgacataactgatcatggatatctcagccttctcactgagagtggtaacactgaggatgacctgaagcttcccactgatcatgttctgcttggccagatcaagactggatttgctgatggcaaggacctgatcctgtctgtgatgtccgccatggg

SEQ ID NO: 74624 - DNA, 465 bp, Triticum aestivum
  Clone ID: PAT_TA_74624
gtcctcatcctctcgcctctctccccccacacagatttagcaatctaggtttagcgcctccgtccatctcgtagctgctgcgatggcgatcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtctccgcggtgactccatcgtgctcatgggcaagaacaccctcatccgccgctgcatcaaggtgcactcggagaagaccggcaacaaggacttccttgagctcagcaacctcctcgtcggtgacgttggcctcatcttcaccaagggtgacctcaaggaggttcgcgaggaggtcgcctagtacaaggttggtgctcctgctcgtgttgggctagttgcacctgttgatgtggtggttccccc

SEQ ID NO: 74625 - DNA, 348 bp, Triticum aestivum
  Clone ID: PAT_TA_74625
gccaggaaggttttggaattggagaggattccaaggtttgaaaccaattttgttcttgaaggtggaagcattcatgtcgacggagaaggaacctgtatcaccactgagcagtgtttatgccatgggaacagaaatccccacatgagtaaggatgagatagagaaccagctgaagactcatcttggtgtgtcgaaggtcatatggttacccaaagggctttacggggatgaaatgatcagtgggcatgttgacaacatatgctgctttactggtccatccactgttctcttatcatggatcgacgacaaatctgatcctcagtatgagcattcaggtgccgcattcgac

SEQ ID NO: 74626 - DNA, 656 bp, Triticum aestivum
  Clone ID: PAT_TA_74626
cctttcttcttggtcggcggcgggagcagcagcagtagccgcgcgcgcccccgcgagccgtcctcctctcccctcctccccggccacgccgccgcccaagcccgggtccaggttcatggcctcgtccggcgccggagccggccgcgtccgccttgcggtcgtcggcgatgtgcatgatgattggatccttgatgaagatacaaaggcactccattttcttcagccagatctggtgctttttacaggtgattatggcaacgagaatgtccaacttgtcaaaagcatttcggatcttcagtttccgaaggcggcaattcttggtaatcatgattgctggcgtacgcatcaattttcagagaagaaggtagattgtgtccggcttcagcttgaaagccttggtgagcagcatgttggatatcaatgtttggattttccaacaataaagctgagtgttgttggtgggcgaccattttcttgtgggggtgacaggttatttagaccaaagcttctgtcacaacggttggtaagagatgtactaacctatagatatctgagttcctcgaactttctgtgtatatctttgtcatagaatttatttctataatcttgtccttcacttctgctatttctgaattatgtttttcaagctgtcatgt

SEQ ID NO: 74627 - DNA, 477 bp, Triticum aestivum
  Clone ID: PAT_TA_74627
cgcgaaccaccgtgggagtcgacaggagaaccggagcttgtcgaagataaaggagaaccggagcttgtcgaagataaaggagaaccggagcttgtcgaagaggagaacacacggaggcagagaactgagagaagatgacggtgaggacgacgattaagcgcgccttggaccgattcctttggcgggagggtcctggggcgaggcagagcgctaggacatggcagcttggctcgggaagccgttggccacgaggacgaaggacgacgtcggcggcgtgctctggtcgcgaagccgcggtgactgtgagccgggaggtacgggctcacagacggcctccttcccatctcccttctccacctccacatacgcagaccagagtgcacattttgaagttcattttgtagttgaaagaatacgtactcgtgcacaaatactccaagaaaccagagtgaatgaattatagtactgtatctttta

SEQ ID NO: 74628 - DNA, 316 bp, Triticum aestivum
  Clone ID: PAT_TA_74628
gctaggtgtagtttgcttgagccaagatgttgggggtgtacagcggcgaggtggtggaggtgccggcggagctggtggcggccgggagccggacgccgtcgcccaagacgcgggcgtcggagctggtgaagcgcttcctcgccggcgcctagcccgccgtgtccgtggagcttggaatcgttgggcaacctcgcctactcccacgcccaccagtccctcctcctcccaaggtctttcgctgcagaggatgagatcttctgcctattcgagggagtcctggacaacttggggcggctgagccagcagtacggcctct

SEQ ID NO: 74629 - DNA, 564 bp, Triticum aestivum
  Clone ID: PAT_TA_74629
aatgttgttcaggcatgtcattggttacagatgtgagaacacgtttggtcactggagaaatgatggttgggagccactcttggaagatgtcaaagtgttttgcaccaaaaacgacattccaataccaagtatggatgacatctttacaaagtggggtaaatcaagaaaaggtggacgaaacaatgtgacggctgatcatttttttcgtgtggacaccttctatgctgctatagactccatcaccacggagtttgatcatcgttttaatgaggtatcttcagagctgctccagaacttctcttgtcttgacccaagaaactcgttttctaggttcaacttgaataagcttgctaggctcacagagatttatcatgatgatttctctgactctgaacgtgaacatatagaacataaccttgatctattcattatccatatgagaagaattgaagactttagagcttgtcatgatattgcaagcctagctcaaatgatcgttgaacttgaaaggcatgtcatgtttcctactgtttatcgcctcattgaattggcattgctactacc

SEQ ID NO: 74630 - DNA, 206 bp, Triticum aestivum
  Clone ID: PAT_TA_74630
ggcgggagcgtctccgggagcgcacgctgggcgccatgaggagggccaaggtaggcgctggccgcgggcggggagtcggacgtgacgctcaccaagtctggtggagggctggatgggagacgataaggtgcaacgcccataatggaggtcaagcgactacctgcgaacatcaaacatctgtatcagtccactgttatggcaatcta

SEQ ID NO: 74631 - DNA, 360 bp, Triticum aestivum
  Clone ID: PAT_TA_74631
actgtttacacatacccccttatcttggcatcggcgactcggcgccagcagcagctgcccccgacgtgacagcgacttggtggccgtgacgctcccccgtgcgacggaggttcagcggccgtggtgctgccctcatgcgacggtcattggcggtcggtgtgctgcctatcgccatggcgactcagcgagccgcagctatagtctgaattttgaagctccatctgaatgctgcaattttttctgctgttgaagcttcaggcaggccatcgaagcttgattctgtagtctcgtttctcatgtgggcagtctgtaatctttggatctatcatcctcagaaacatttgaaatgttattatcaag

SEQ ID NO: 74632 - DNA, 554 bp, Triticum aestivum
  Clone ID: PAT_TA_74632
cctggactccggcgagaccatcgccgtgaagaagctgtggccagccacgacggccgcggccgccgcgttcaaggacgccggccgggactcgttctcggcggaggtgcgcacgctgggctccatccggcacaagaacatcgtgaggttcctcgagctgctgctggaacaagagcacgcgcctgctcatgtacgactacatggccaacggcagcctcggcgccgtgctccacgagtgcggcggcggcggcgcgcagctcgagtgggacgtccggtaccggatcgtgctcgggtcggcgcagggcctcgcgtacctccaccacggctgctcgccgccgatcgtccaccgagacatcaaagccaacaacatcctcatcggccttgacttcgaggcctacatcgccgacttcggcctcgccaagctcgtcgacgagggcgccgacttcggccggtcctccaacaccgtcgacggctcctacggctacatcgcccccgagtatgggtacatgctcaagatcacggagaagagcgacgtgtacagctacggggtggtggtg

SEQ ID NO: 74633 - DNA, 507 bp, Triticum aestivum
  Clone ID: PAT_TA_74633
atttgccgctttttaggccgaacagcggaggtagtctgcgcttggtatgggatcgcctttcagattccatttatggagacatattaattcaggtgatgggagaacaaagacaccattgagccctactgtcgctgggtcagagccccatccattcagcatgactcatggattaggaggcagcagcgtccagcttatggaatcttccaggcaatctttgggtgtatatcatagctattcagttgggagcttgggtcagatgcagttttctagtgaattacggaaccctaccagaggtcagacaacacttcagagccggagatcccaatcgagagaagatctcacgtcttcgttagctgatcttcatattccaaaggtgtagagcattacatttcaggatggcatgactagtatgtgatcccatgccataacagactccatgtaaataatagctccagactgcttgatttcttcttgtctagccagaaggcaattttgtcggcacactga

SEQ ID NO: 74634 - DNA, 332 bp, Triticum aestivum
  Clone ID: PAT_TA_74634
ggagcgcgattcgtcgctgctgcggtcccggagtgacccaggaacataacttgcactctcaaagctatttttcccagtgggttcgcatgctttcccacccaccatttcgcttcggaatcgtggaggaagtttcgcgctgaatttcgcaaaggaggcaatgaaaaacgaagtagtacaaaaagaattgttcaagcttgaagagcatgcggtggtttaggcaagggaagctagcgagatcttcttttgtgtgtgagtgagttcttttgtaagtagtttaggcagtggggaaaggccgaaagagctccttttaggctcttttaaccacctcccac

SEQ ID NO: 74635 - DNA, 532 bp, Triticum aestivum
  Clone ID: PAT_TA_74635
cacgaccaccacgttccggccgcgcacaggcttggacccgtcgccgcgcccgacgcacaagtcaccgccctcgtcggctccgtcccccgccacctcacgctcccatctccctcttcctcgacgaccctcgccggtgccccgtcgcctgttaccgaccaccgccgctccggatcgcgggctccctggcgcgagcgcccgtccttgacgcccgatctcccttcccctcgcgctccttctgcgccgccgtgcttccacgatgcaggcgcacgccagcgccttggcatcgccgcggcgcccggagccacctcgccggaccactgcaccgccggcctccccgagcgctccctcgacacgctccgagctcgcccctacgctccgctactacgagaccgacgctgatgccaccgagtacgactacgtcatcgacgacccctccttgtctgagcaaccagatgctggagtccaggagccagacgccaccgtcggccattattcctactacactggaggtgcctactactacgtgcaggcc

SEQ ID NO: 74636 - DNA, 341 bp, Triticum aestivum
  Clone ID: PAT_TA_74636
gccgccgagataggtcgcgtgatcgcgctcagcgtaagggtgcgggctccgtcttcaagtcccacacccaccaccgcaagggccccgcccggttcaggtcgctcgacttcggcgagcgcaacgggtacctcaagggcgttgtcacagatgttatccacgacccggggcgtggtgcgccgctagccaaggtgaccttccgccacccgttcaggtacaagcaccagaaggagctcttcgtcgccgccgagggtatgtacaccggccagttcgtctactgcggacgccgcgccacgctctccgtcgggcacgtcctcccgctccgctccgtgccttagggaggc

SEQ ID NO: 74637 - DNA, 110 bp, Triticum aestivum
  Clone ID: PAT_TA_74637
caccaagtatgggaaggagtttgttgctgctgctatggaatagcgccctgattgcggtgttaatcgcacaataattgagaagctttcagttaaggctaccatacagcgga

SEQ ID NO: 74638 - DNA, 194 bp, Triticum aestivum
  Clone ID: PAT_TA_74638
gcgctgacggagcatcagttctcggagctcaccccggtcctgtcccggaggtggtcgaggccctggaccgcggcggcttccggacggtgcacgccgtgtgcaggcggcgaccatcccgctgctgctgacgcacacggacgtggccgtagacgccgccagcggctccggcaagaccctcgccttcgtcgtccccg

SEQ ID NO: 74639 - DNA, 528 bp, Triticum aestivum
  Clone ID: PAT_TA_74639
tcttcccttccctctaaggcttacattgaagaggttgtccaagaactgcagaaaggtgagggggaatgccctatttgcctggaagcctttgaggatgctgtattaactccctgtgctcatcgattatgccgagagtgtattttatctagttggcagagtccagcagcaggtctttgtcctgtttgtagaaagttagatgaccaagcaagatcttattactgctccaactaacagtcgcttccaagttgatgttgagaagaactgggttgaatcttcgaagatatcttttcttctacaggaattagaatctcttcgcagttcaggcgccaagagtatcgtgtttagtcagtggactgcatttctagatctcctggaaattccactttccaggcatggcatttcatttaccagactggatgggacattaaatcttcagcagagagagaaagtaatccgtgagttttctgaggacaaacgaattctggttttacttatgtctctgaaggctggtggtgttggaataaacct

SEQ ID NO: 74640 - DNA, 514 bp, Triticum aestivum
  Clone ID: PAT_TA_74640
gatctattactatcactgatgttcaacaatggttggatgagagaaacgttgtcattgaatcagtccggcaatacttactgtgtgctcagaaccgcatgaaagtttaggctgacaagcaccgaacaaaacgtgagtttcaagagggagatttggtgttccttaaactccagccgtatgtgcaatcatttgttgtccaccgagctcaccataagctagcatttcgctactatggtccatatcctattacggccaagattggctctgttgcttatcgcatggccttacctgctgcaagcaagatccatccagtattccatgtgtcacagctcaagaaattcgttgcccctcatcagcaagttctttctaaattacctgttcctaactccttgttgctcgtgcccatgcacattctacagtgtcgcgttcgacaggaaggcaaacgcacaattgctcaggtccttatcctatgtaatgatcgtgccccggatgctgcaacctgggaagatctcgaatc

SEQ ID NO: 74641 - DNA, 186 bp, Triticum aestivum
  Clone ID: PAT_TA_74641
cttctcctctcgcagcggcgtcatattggatcatcctcgcctgcaggttcttcgccaagcgctgcaatgcccatgctgcctctcaaggaggtccctaaatactaagtaatgtacaccttttgcttctgcccgtctaccatgtgctccccctcttccattttctccccccccttcctcttacctacc

SEQ ID NO: 74642 - DNA, 371 bp, Triticum aestivum
  unsure (1)..(371): unsure at all n locations
  Clone ID: PAT_TA_74642
gtggcaagtggttgatttgccggccttcaatcagtctcctgaggagcgagagggagggatcttggggaacagtgggggattttcttccctggagccattgggtgtgcctcctccctggtgcgagcatgaggagccggcgccctctgttgtcgccgatgatgttcttcctgctatggatgtagctctacacgagatggtatgtcaaggtgaggaggagcaagctaaggttgctgagaaagtcacatcaagcaatgatttggagcattttgaggaggccttacctnatggtttggttggagaggtgcctccctttgtctcctcttcggtgacgtttgcttcagggggcattaccaatattgtgtcctctgggt

SEQ ID NO: 74643 - DNA, 369 bp, Triticum aestivum
  Clone ID: PAT_TA_74643
atagaagagggcttatacataagatccaagataataagtattaggccctgttcggatatccaccagatccgtggaattagaagagttgtggagcacctaatttgcagctccagtaatttagcctacaactccgccggctccgcggagccgagtctgggagcggagggactctgaacaccccctaaatatattactccatcagccattatgttttagagaaaaattcactcgtggtcactaaacttgtcgctgaattcactttgcttactgattcctaagatactgtcagcgaattgtcttgaagtggctcacatgttaagtggtcacatatattgtcacttatgaattgatatatgtagcgcttgctgt

SEQ ID NO: 74644 - DNA, 509 bp, Triticum aestivum
  Clone ID: PAT_TA_74644
caggtatggaagtgcttatggctttgcaggaactccaatggaaacagatgatccgataaccagctacatgttgcaggcttgggccaggctatgcaaatgtcttggacaggattttcttccttacatgcatgttgttatgccaccactgcttcagtctgctcagctgaagcctgatgtcacaattacttcagccgaatcagatgatgaaatagaatcagatgacgacagcattgaaacgatcacacttggtgacaaaagaattggaattcgaactagtgtgctggaagagaaagcaacggcttgcaacatgctgtgttgctatgctgatgagctcaaggagggtttctttccatggattgatcaggttgctcctacattggtccctcttcttaagttttacttccatgaagaagtgagaagagctgctgttgcagctattcctgaactgtaacgttcggcaccattggctgttgagaaggggcaggctccaggacgcgatgagtcttacg

SEQ ID NO: 74645 - DNA, 299 bp, Triticum aestivum
  Clone ID: PAT_TA_74645
tgggtacaccaaaaaaatgaaaggattacaacataaatggaaaaggtaagaaaagccagtctgtgcttcttcagttctaaaattcccagagcgtcagtgcaactacatatcagggtatgctatgttgattctataattttccgtatgcttgtatgtacaaaaatatggtatatttactgcttgcaactttcaattatgttttgttctaaagctacttgctgtaaagtagtgtatgtgctagggtttcagtacagcttccaaaataaaactgtggttcaagttctcaaattgtttagaag

SEQ ID NO: 74646 - DNA, 409 bp, Triticum aestivum
  unsure (1)..(409): unsure at all n locations
  Clone ID: PAT_TA_74646
ttgtttgcgatccgaaactggtgatggggaatttatgttggactgtggaaccaaattttcttcacaattcacaccttcaagttcgccccaacaaaattcttaggtgcaacttaaccatttccacatgatagttctccatacatggtggaggccgtgtgatggcgttcatgccggagctggggccattcgatgtctctagtagctagctagtgttctgctcattgtggctgctgttgctgtgcaccggtagcactaaattcctggcagcagtatttcaagcttactcttttgttcttgtaataaaacgtttgttgaatgtacctcgctcaaatnagtgctcttagttagaactatcgcatggcggtgtaatcccaaatcttatgcgagtgtagtgatgcttctatatctg

SEQ ID NO: 74647 - DNA, 147 bp, Triticum aestivum
  Clone ID: PAT_TA_74647
tctgtttgacttctttgaacagaactttgggggcaaatcttcgacaattagttccagtcaaactgcaaatgattttgttgctcctgacgatgctgaagtggaagcgtttataggttcctttaatatgatattccctccgttcataaa

SEQ ID NO: 74648 - DNA, 560 bp, Triticum aestivum
  Clone ID: PAT_TA_74648
agggcacattgtgcgctccacggggcggaaagaccggcacagcaaggtctgcacggcgcgcgggcctcgcgaccggcgtgttcggctgtcggcacacacggccatccagttctacgacgtgcaagaccggctaggctacgaccgccccagcaaggccgtcgattggctcatcaagaacgccaaggacgccatcgacaacctcgacacccttcccgcttggcagcccacggccgtcgcccctgccgccagcaatgccgccgcgccgccgtcctcctcgacccagcctgactccgccgacaactcggacgaccaggcgcaggccatcaccatcgcgcactcgtcgttcgacttcgccggctctggtggcgctggaggagccacgggcggcatcagcttcctcccgccgtcgctcgactcggactccatcgcggacacgatcaagtcgttcttccccatgggcgggaccacaggtggggagccgtcgtcgtccactgtggctgcgcactcgtcggccatgggttttcaaggctacacgccggacctcctgtcccgaaccggaa

SEQ ID NO: 74649 - DNA, 529 bp, Triticum aestivum
  Clone ID: PAT_TA_74649
atgtcaaccccaaggttttcttcgacaccaccattggcggccagcccgctggcaggatcgtcatggagctcttcgccgaccaggtccccaagaccgctgagaacttccgcgctctctgcaccggcgagaagggcactggaaagagcggcaagcccctccactacaagggctccagcttccaccgcgctcatcccccagttcatgctccagggtggtgacttcacccgcggcaacggcaccggaggtgagagcatctacggcgagaagttcgaggacgagaacttcaacctgaggcacactggccccggtatcctctccatggctaacgcccgacctggaaccaacggctcccagttcttcatctgcaccgtcaagacctcctggttagacggcaagcacgtcgtcttcggccaggttgttcagggtcttgaggtcgtccaggccatctagaaggtcggctcccaaaacggctccactaagcagaccgtccccattgcggactgcggtcagttttagatcgactggaggc

SEQ ID NO: 74650 - DNA, 339 bp, Triticum aestivum
  Clone ID: PAT_TA_74650
cagcccagcccccatcaccggcgaagataagaccatcctggcgtcggagacgatggagatcccggaggaggtgaccgtgaaggtgtcggcgaagatatctcggtgacggggccgcgggggacgctgacccgcaacttcaagcacctcaacctcgagttccagctgcaggagggcgggcgcaagctcaaggtggacgcctggttcggcacccgcaagaccatggccgacatccgcaccgccatctcccacgtccagaacctcatcaccggggtcaccaagggcttccgctacaagatgcgcttcgtgtatgctcacttccccatcaacgcctccatcacc

SEQ ID NO: 74651 - DNA, 315 bp, Triticum aestivum
  Clone ID: PAT_TA_74651
ctggatcgggggcgctggcccccgagccctgtgtaacgcgccgctccgccccctcgtagcgctagctgcccaccccggcgacgccgactccgtcaacgccgacgcctcctcgcctcgcgctggactgcctcggcccggccaccaaccgacgccacgccgtcgcccgaccttctccccctcaccggatcttccccgtcctcctcaccagcggctccatcgcgtcgtcctcgtcttccaccaccgcagccccgagctccggcgcctccccgagctcacggtagcacaactacagggccccacctcgggaccactgcc

SEQ ID NO: 74652 - DNA, 202 bp, Triticum aestivum
  Clone ID: PAT_TA_74652
cggcacgaggcagtgacagaaaaatacagtagctgtttgcgggtcaaaatagtgtgccgtctaccaaggccttcattatgtccgacagatattcttatttgctttgctgcacttgacttgtttgtatgaacttagaaaacacgcaactaggttactgaatctagcataagtgggagactgttgaaaataaaaaaaaaaaaaa

SEQ ID NO: 74653 - DNA, 139 bp, Triticum aestivum
  unsure (1)..(139): unsure at all n locations
  Clone ID: PAT_TA_74653
cactgtggtggcngctgggtttaacaactagtgtgcatccccgtgtgctgcngtgtgttcaccagccagccacgccgctccctcccnngcttcgcgatcccctcccttcctccccctcccccgcggttgcctggcggta

SEQ ID NO: 74654 - DNA, 200 bp, Triticum aestivum
  Clone ID: PAT_TA_74654
agctgctccgagtctagctacggcggcgacggccattctggccgtcctggccgcggcgctcgccacggccgctcgcgcccagacctgcggctcgcaggccggcggcgcgacgtgccccaactgcctctgctgcagccgtttcgggttctgcggcagcggctctgagtggtgcggagccggctgccagagccagtgcagcg

SEQ ID NO: 74655 - DNA, 163 bp, Triticum aestivum
  unsure (1)..(163): unsure at all n locations
  Clone ID: PAT_TA_74655
acgggtggccgctggtttaataactagctggatccccgtggctgcagtggttttgatcttgttcttactacagtggcaccctgagtgaacgccaacggcagcagtgagngatgaacgctgctggcagccccagagctaattggccttgcccctaatactacct

SEQ ID NO: 74656 - DNA, 596 bp, Triticum aestivum
  Clone ID: PAT_TA_74656
ggcacgaggctcatcgccgcgcaggctttgactccatcgcctcctccctcctcctcttcgtctccggcaggccaggtagttaacagctccagcagccatgggaaaggagaagatccacatcagcattgtggtcattggccatgttgactctggcaagtcaaccacgactggccacctcatctacaagcttggaggcatcgacaagcgtgtgatcgagaggttcgagaaggaagccgctgagatgaacaagaggtctttcaagtatgcctgggtgcttgacaagctcaaggctgagcgtgagaggggtatcaccattgatattgctctctggaagttcgagaccaccaagtactcctgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcacgctctccttgcgttcactcttggtgtgaagcacatgatctgctgctgcaacaagatggatgccaccactcctaagtactcgaaggcccgtt

SEQ ID NO: 74657 - DNA, 416 bp, Triticum aestivum
  unsure (1)..(416): unsure at all n locations
  Clone ID: PAT_TA_74657
ggaggggggggtttttttcccccccggggtggggggggggccccgtgggccccgggggggccggggaaatttgattgaattgtgatcgtggagccgcgtatccggcgcgcccaatgaacactttagttcaacgtccccgcaaattccaacaaccttgcccctttccttactaccaacgaggcgcgccttaccccccggagaggcctttttccccgggcttttatcccccgggctaattttcccccaaaagtttccccggggcgcctttccttggggcgccacaccgcgccttttttccccttacccggaaaacccgggcagggttcacccaggntttcccttttccccaaaatttggggggggcaggaaaaggcggaaaacaggacaaaggggtgggcctaggacccccaggttac

SEQ ID NO: 74658 - DNA, 105 bp, Triticum aestivum
  unsure (1)..(105): unsure at all n locations
  Clone ID: PAT_TA_74658
aaaacaaggtacagccatagcactatacgaacaaaggcctatactaggcctaaatagtaccaggtagctaagggcataggtacnaggccctaacagccagaaaag

SEQ ID NO: 74659 - DNA, 461 bp, Triticum aestivum
  unsure (1)..(461): unsure at all n locations
  Clone ID: PAT_TA_74659
ggtttgcagatcaacatgaaaggtagatggcattcaggtccaatgtatgtcgggacaggatgctgtttcaacaggcaggccttgtatggctatgatcctgtattaactgaggctgattggaacctaacatgttgttaagagctgntgcggtggcagaaagaaaaagagcaagagctatatggataacaagaaccgtatgatgaagagatttttcttctgtctcccatcttcaacatggaagatatagaagagggtatagaaggtatgtgcttgcaatttttaccttaacatttattcttggcatctgaagacaaggtgccgtatatactgcatcactaaaaacatatgcttctatttgtcttcgctttggttcttgagattctgagtatgacttgcttcagctaaccaccctgtctgaatctcatcaggttatgatggatgaaaggtcaatgcttttggtc

SEQ ID NO: 74660 - DNA, 585 bp, Triticum aestivum
  unsure (1)..(585): unsure at all n locations
  Clone ID: PAT_TA_74660
cacgaggctggcttggacggacgtttggacgccatggacggagccaggcagagccgtggctcaagatgtcgccggcgtcctgatctatggatcagatccggtgctatatccggtagtaggcggcagggcacgcagtaaatagcagaagttgggcgctgagggcaagctatcccctacccagtgaagttggatcttgcattctatcaaggcggggaaccggtttagaaatttcctagcgggaaaggggagtgggcggtccagcgagctcccaggtcctccggcgagcatggagttcttgttgcagccattaaacagtaccacaacactgctagagaaggttaacgagaacaacaacaccattgagcctcttcactacctagtcatggcgccgcgcggaggttgagctgccggccccggcggcctcaagtgcagacggccaaatctgtgttgacggcgccgctccagagtccggccagtgcagacaagggtcaaggttcagngcctctatagagcaatgtggatccaaaaactccggggcggacgcaaagagtgcgtgttggcgctgccgcactaggctgctgctcc

SEQ ID NO: 74661 - DNA, 588 bp, Triticum aestivum
  Clone ID: PAT_TA_74661
cggcacgaggccaacaccaaccgtcgccggccacatttaatcccgcaccaccaccgccgccgcgcgccccggcgactgatccccacggacgcagcgcgatcccgccggacgccaggccggacgaggaggaggagggggcggacaggtggacacgcagattgagaagggggacggggcgggcatcgcgatgatggagaccaagccgccgtcgccggggagcgggggcggatcggcgccgggggtgcaccaccacaggcggtgggcggcgccgctgctggcgtccgtgctgctctcatcgctcctcatctcggcctccctcttcttctcctcgtcgcgggcgctgctcctctccttctccccgctcccctccgcggcccccggggagccgctcttcgtcgaggccaagctgcggcagcagcagcaggaggcgcgcgcccgcccgcaccgcgccgtgcccaggatcgcctacctcgtgtccggctccgccggggacggggtcgcgctgcgccggacgctcagggcgctctaccacccggccaaccgctacgtcctgcacctcgacctcgaggcgcccgccgccgagcgcgc

SEQ ID NO: 74662 - DNA, 150 bp, Triticum aestivum
  unsure (1)..(150): unsure at all n locations
  Clone ID: PAT_TA_74662
tggtgcangatcttccctcgacgcccactacctactgcggacgcatcgtgtgcgagcgcccagttgngtggcaaagtggcgcaggagccgcgtcagggtagcacagcactgacaggtcccagggcgctggtgcgagtagtggcgttngta

SEQ ID NO: 74663 - DNA, 477 bp, Triticum aestivum
  unsure (1)..(477): unsure at all n locations
  Clone ID: PAT_TA_74663
aggttatactactacctactatacgccgccgccgcgccaccgccgtacagccataggcaccgaagaaggagaaggccccggcggcgtacgtacgaagccggccaagtacgggcggcggcaagcagaagaagaagaagtaggagcaagggncaagcaaaaggagaaggtagaacaacgcggtagctactatacgaccaggtccacctacgacaagctagctcaccgaggtagcccaagtacaagtcagatacatcgccctaccgtacctactaccgatgtcgcctacaggatacaacggctacgctacgtctacgcagggccantacaaggatcctagataggatgaagggggctacatacaggataggtagtacantaccatctactcatgctcatgtcagatactatacatccangaggctcacaaacacctaagatatcataaccctacatagtaagtataaggctagcnctagt

SEQ ID NO: 74664 - DNA, 455 bp, Triticum aestivum
  unsure (1)..(455): unsure at all n locations
  Clone ID: PAT_TA_74664
ggtgccccggttaatagtggatccccgtggctgcaggatttttggactgaggctcttccgtctcccgccgccgccgcagcctgccgcctgcctcgagccgccgtcgccatggggagaagacctgcgaggtgctatctggcagatcaagaaccaagcccatcacccccaagtccaagggtcattgcctgtgtgtgttgcctgcaccctcaagcatccagtgcatctcatgcattgtcgtgccatgcacagcacagcaagtgtgttgtcgcatagcagttctctcacttggtggttccacccttgtttttccatgnggcagcacagggcagcacattgtagtccacagatagcagtgctccttagcaggtgctngcacctggtacatttgctttgcaaccacagtacaccattgcactcaagccattgccagtgcacacaggcattgccttatccaa

SEQ ID NO: 74665 - DNA, 324 bp, Triticum aestivum
  Clone ID: PAT_TA_74665
cggcacgaggagtcattgaagatcatatcaccatgggtagtcattgcagatcatatcaccatgggaaataatggaattcttatcagtactttctgttcagacttgatacacctctctgacacttctgtgatgacattgtgatgcatttctttttttgtgatgtagcacttgctagcattttcccatttgggtgtggttatatggtattccctctgcaccaaaatgtaagacattttttagttttgcatagggcataaaaacgtcttacattttgttacggagggagttgttatgactctcgatattgtttggaatatttctcca

SEQ ID NO: 74666 - DNA, 405 bp, Triticum aestivum
  Clone ID: PAT_TA_74666
tggcacgagatatgtttccatgataccctgacgggttgaacctatgccttcctttatatgtgtgaactcagaagtttcacaagtcatactcatctggtatttcaccaggtaaaactttcaacactaatgcctttatcaaagcgagaagtgaatggacggttatacattgaagaagtgggagtcgaccttgaactttgtgttcatgcccacggacacgatgtagatcctatcatggaagcttcttgtaataataactatttccttgttataatatcatttggaatctgtgaattgatcctttgcaatcatggatccgaccatattttctatttgattccatttctcggacaagttaaaccacttgtcctctacagatcaatacacccatccaacctctattttgat

SEQ ID NO: 74667 - DNA, 258 bp, Triticum aestivum
  Clone ID: PAT_TA_74667
ggccacgggtggccgcgtttagagagagagaactagtctcagttttttttttttttttttagcacaaatgccgtttcaaagaattaatatctgcacatttctccaattttgtcacaccacatcatccttgtcagtgtcaccaccaccagcaatgtgccatccatcctctcactcaccacatcctttcctcccacacctctcacccaacacactgcatccacatcacactcagctgtgcacacaacacatttccacagc

SEQ ID NO: 74668 - DNA, 100 bp, Triticum aestivum
  Clone ID: PAT_TA_74668
tagctttaaacatgacccctcatctgtgtgcccacaagttgattccaaggaaggggcagatggtttgcaagtgaatggggactctgggtcaacaaacctg

SEQ ID NO: 74669 - DNA, 124 bp, Triticum aestivum
  Clone ID: PAT_TA_74669
tggttggtattttgggacatttcaggtatacagcctcagttatctcctacaagtttcactattatttattccagcttattctttatttggctgtttgtggtatgtaattgtatgcagttagctg

SEQ ID NO: 74670 - DNA, 793 bp, Triticum aestivum
  Clone ID: PAT_TA_74670
tgacgaggcgccgcgcaggctttgaccccatcgcccctccgtcctcttcgtctccggtaggccaggtagttaacagctccagcagccatgggaaaggagaagatccacatcagcattgtggtcattggccatgtcgactctggcaagtcaaccactgactggccacctcatctacaagcttggaggcattgacaagcgtgtgattgagaggtttgagaagtgtttccgctgagatgaacaagaggtctttcaagtatgcctgggtgcttgacaagctcaaggctgagcgtgagaggggtatcaccattgatattgctctgtggaaattcgagaccaccaagtactcctgcactgtcattgatgctcctggtcaccgtgatttcatcaagaacatgatcaccgggacctcccaggctgattgtgctgtgcttatcattgactccaccactggtggtttgaggctggtatctccaaggatggccagacccgtgagcacgctctccttgctttcactcttggtgtgaagcagatgatctgctgctgcaacaagatggatgccaccatcccaagtactcgaaggcccgttatgaagaaattgtcaaggaagtctcttcatacctgaagaaggttggttacaaccctgacaaggttccctttgttcccatctctgggttcgagggtgacaaatgattgagaggtccaccaacttgactggtacaagggcccacccttctcgaggcctgacagatcaatgagccagaggcctcagacaagccctccgtcttccccttca

SEQ ID NO: 74671 - DNA, 252 bp, Triticum aestivum
  unsure (1)..(252): unsure at all n locations
  Clone ID: PAT_TA_74671
ttgggcctncacttggaaccggaagaaacttaagacacggcttggaaccggaagccttgggagtgttgcttgggagtgtcccaaggttgaaccaagggncaaccaacaaacccctnccggttttccaaccaaacttanccttaggcgcctaatttatncttaagaaacaagtgcgttangcccaccgccggcgagctttgcccaacgccttgcccaggaagccctttaccctttgggaaccggttttntccc

SEQ ID NO: 74672 - DNA, 387 bp, Triticum aestivum
  Clone ID: PAT_TA_74672
cggcacgaggctccccaacccccagatcccaaccgccccacagattcctccccaagccgcgccgcgcacgccagatcggatcgccccgccgcccagaccccgcggacgaatctccattgcatctcccgatgctggcggcggcaatctagccagcaagcagcaagatcgagacgagggctaggaggatgatgaagccgcagcacggcgcggccggcggcggcgggcacgggcggcggacgccgttcctgacctcgtacgcgctcacgctcgccttcatcaccttcgtctccctgctctacttcaaggacttctcctccacgctccaccagcccttcctccaccacccgccgccccgccaccgccccaggccccatccccatgtcccca

SEQ ID NO: 74673 - DNA, 383 bp, Triticum aestivum
  unsure (1)..(383): unsure at all n locations
  Clone ID: PAT_TA_74673
gttttttttnataaaaaacctttaaaggtttggggggaattttccccccccccgggggggggggcgcctctttgggcgcaaagggggcaaaatattttcgggggcacgcagggctcttgacagccagcgtgtaccactaacctgcaagcggtgcccgtcggccaatgggcaccaattccaaccaaggnaaaggcactaaactaaactacaccggttactacctagctaactccattcattcccgactaaagcatgggttacagaagccttcgccaccagccaaccggcatcagccaaaatggcaagcagtcaggctacccgcgcctacacctccccggccaaaggctaacccaatcatccggcccaccttccaacctgtattc

SEQ ID NO: 74674 - DNA, 751 bp, Triticum aestivum
  Clone ID: PAT_TA_74674
ttggcacgaggctcagatggagggcggcaagccatccactcagcggcactcgtccggcgccgttcgcccgattgtgctagtagtggtcgcggtgagcctggttgtcgtgctcttcatggccacgcgggtctcgcccggatgccgtccactcttaaaagctgtgtaccaacaaggcctaggccgtgccggcccctccgcgacggcggatccgctcctcggykktkyctcctctcgccggacttcgatgaccgctcctgcctcagccgctaccgcgcctcgctctaccgccagccgtcgctccacaacctgtcatcgcacctcgtctcgcgcctccgacgctacgagtccctccaccagctctgcgggcctggcacaccggcctactcgcgcgccgtcgcccgcctgcgcgaggccatggatgggcatgcgtcatcgaacagtaccagcagctccgacaccgagtgcagctacatcatctggacccccgtagaggggctcggcaaccgcatcctctccaccgcctccgctttcctctacgcgctgctcactgaccgtgtcctccttgtccaccaccccgccgatgacctcaacgacatgttctgcgagccgttcccgggctctaacacacctgggtgctcccggaggaaggctttgccatccagggcatycaaggggctcaacgtccgacccgggagagcctcgggcaacgcgggtggggccgtggcagggaacccgccggggcccgtgggtg

SEQ ID NO: 74675 - DNA, 198 bp, Triticum aestivum
  Clone ID: PAT_TA_74675
ctcctagcaaactcgccgccgccgctccgctgccatgaatcccgaatatgactacctcttcaagctgctgctcattggggactcgggcgtggggaagtcttgcctgctgctgaggtttgcggatgattcatatctggagagctatatcagtactattggtgttgacttcaaaatccgcaccgttgagcaagatggaaa

SEQ ID NO: 74676 - DNA, 117 bp, Triticum aestivum
  unsure (1)..(117): unsure at all n locations
  Clone ID: PAT_TA_74676
tgagccacgcggtggcccccgngtttatcaactagtggcatccccgggctgcggcaatttggccgagggtactcctgcactgtcattgcatgctcctggtcaccgtgcntttcctca

SEQ ID NO: 74677 - DNA, 446 bp, Triticum aestivum
  Clone ID: PAT_TA_74677
ggcacgaggtggaggcgtgggtgcggcgagccttcaaggaggagcggccgctgtcggaggtggtggacccgtcgctgctcggcgaggtgcacgccaagaagcaggtcctcgccgtgttccacgtggcgctcggctgcaccgagcccgaccccgagctgcgcccccgcatgcgcgccgtcgccgagagcctcgaccgggtgaactagtccggcgatccatcatcattcattccgggaaacggaagccatggcccgtcattctcatcgaccatcagcagcagtagttcctaaaatcattagctccgcagattagcatttgccaacgttattaggtttagagacggtgaagaaaccagccaagaatcgttcactgatgtgcgtttggtactcgtttttttgtagctgcaaccttcgcggccgtgtatgtatgtaaccgatgatcatgat

SEQ ID NO: 74678 - DNA, 170 bp, Triticum aestivum
  unsure (1)..(170): unsure at all n locations
  Clone ID: PAT_TA_74678
cctctctctccaaggtaagtccgcnggcaggcgagcaagagatgacgagcggtggctagtgcagcgagcactgncttcgacggagagtcagaccnggagagangagagacgtcaggacgcaacgatgatgcagtgcgaggccacgggcgggtgagtgggaccaaggcgac

SEQ ID NO: 74679 - DNA, 215 bp, Triticum aestivum
  unsure (1)..(215): unsure at all n locations
  Clone ID: PAT_TA_74679
ccaggcaatcggaatccggaaattcgaaagttgttnctgtggctcgcgggtaactcccggtccctggctccaattgggaggggaaagggccctttacaaagcacaaaggaaaggccttgtgggggcctcggttgaaaaaccaaaagggggcccgggtttcgcggttattccgnggccccgggggccaaacccccgcggggcttcccccgggggcg

SEQ ID NO: 74680 - DNA, 588 bp, Triticum aestivum
  Clone ID: PAT_TA_74680
cgctgcttcgtgggcggctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccagtcccgccgctccggcggaggcggcggcggcttcggcggcggcggcggcggcggcggctacggcggccagcgtcgtgaaggaggaggcggcggcggctacggcggcggcggcggtggctacggaggtggccgcagcggcggcggcggtggctacggcagccgtgagggcggcggcggctacggcagcggcggcggcggccgcggctacggcggccgccgcggcggctccggcggcggcaactggagggagtgaatggtggggccgctcgctggccagttatcctagttaccgatccttttttcacctgtctaccaaaagtgttatcgctcgcctcccgagtaccctagatctcgctcca

SEQ ID NO: 74681 - DNA, 760 bp, Triticum aestivum
  unsure (1)..(760): unsure at all n locations
  Clone ID: PAT_TA_74681
ggcacgaggaaggagaagggggacgcgccgcagccggccgcgaggagggccgccgccgctggtgggagggggatggagtcgttcgcggccgaggggttcgaggccgacctcgaggtctccttcggcgacaacgtgctggactgggacgccaccgacaggggcgccagggagacgacgccgtgcagcctgatctacagctcggagacgatgagcacccccgggtcggcgaccggggcccgcaaccattcccgccgcagggcgcagacgccggtctgccgctacgtcccgagctcgctcgagatggacgagttcttcgccgccgcggagcagcagcaacaccagaccttcagggagaagtacaacttctgtcccgcgagcgagcgcccgctccccggacggtacgagtggacggtgctggactgctagggcttcatacctcacaccaccactgaccacaacctgngcacgctcctccattgatctctgtaacaccagaatgaccaccaccatcagcagcagcagcagcatgtcatatgccgtgggcgcgatgcaaatgcagtagcgttaggtttctgattcacctgttgtaaaaacttagagttagcccgcagtcagcagtagctcagccagccagccatctctcagcctgatccccaacctcactgtaaccgtcgttagttaacaacatctcatttccgtaggctctagcttgattagcagctcggttatcttctgtatcccggtctcatcaatgaatgat

SEQ ID NO: 74682 - DNA, 725 bp, Triticum aestivum
  Clone ID: PAT_TA_74682
cggcacgaggttcacctcgcccaagctttctctcttccctgtactactactactagttcccacccaaactttcagggttggtggtgccgaaatcaccgtgctccatcaggctacacaatggcgctggtcgattggatagaactgagtgatgatgcagagattattgaattgagcagtggcgaggagaatgtcgaagaatatcaggaagcttccacacagagcaactcagctcagcaccaagctacattgcatgatgatcagaccgtgtttgtcgcagatggtgaaggaagggaagaggctaccgaatctggaaatgcagaggaagctaccgcatcctcctccgttactgaaaaggagtctggcaatccagaggaagctgctgtatcacagacttgtcctcacactccaacagccgttgttactgaaaaggagtctggtaatccacaggaagctactgtatcacagacttgtcctcacactgcaacagctgtgacattccccggtcctgatcccccctctccgaaggctctgacttttgaagcctgtgtcgccaagccgggagagcgaaggcgaaacgtggcaggaagctcttccatgccgatacaccttggacttgtaggagccctagcttgaagacaagcatgaaggtcgtagaagccgtggaagagctggcagtagagctcaagacgtctggcatgccggaagaagaagaacaagaagaacac

SEQ ID NO: 74683 - DNA, 229 bp, Triticum aestivum
  unsure (1)..(229): unsure at all n locations
  Clone ID: PAT_TA_74683
taatctaatcaccaccacctaaattaccctgccgacctgccaccaacccatccgaataggattgcaagtaaaaacgaagcacttgaaatcctaaatcttcaaatttctttgcgtttgtgccgtgcattgtgcgttgtgctctatcgcgtttgtgcgtgctctgtgtctgngattccttttcttctcatcgcgacgtntagcgcattttgatcaactagccgcgacantg

SEQ ID NO: 74684 - DNA, 503 bp, Triticum aestivum
  Clone ID: PAT_TA_74684
cggcacgaggtctcaatctaacccgccttctaccgccggagccagccgtcgcgggcgagcgagcgacggcggcagccagagcgagggagcccacggcgccgtgacgggtagctcctccgacacacgcgctgccgccggctggccgtccgcacgcctccccgccgacgggctcgccggccctttcccgcgcaccttccctccgacgggcgtcgcgccgacgcctccccgccgactggcgctggcccctccccgtccgccacccccagcttcgagagccggtgcccgtccacggattcgagcgccgccgcccacacccggattggagggacggcggcctacctctcgactgcctccaccgtgactccaggtacccacctccacttcgccgccgttcaccaacacgggcaccaccgcctcccccgtgcttcctcccgactgcttatccctgcgcggtcgggaaccagcccccatgcactgcttcagcgtagtccccgtccaggcct

SEQ ID NO: 74685 - DNA, 230 bp, Triticum aestivum
  unsure (1)..(230): unsure at all n locations
  Clone ID: PAT_TA_74685
ttnggggggaattctccccccgggggggccctcgcgccccgcggggtggttttttttacgaggcttccccacttctcccttccgggcatctgctngcgacccccgcggctgtgcgccttaccatccggtccttccgtgggctgaagcttccctcgtgtccccccgtgccaatgcaagaggaattgactaactttcaagagtgccgggttcttnggctggaccatggtgga

SEQ ID NO: 74686 - DNA, 380 bp, Triticum aestivum
  unsure (1)..(380): unsure at all n locations
  Clone ID: PAT_TA_74686
cggcgctcttttccgcaaancacagctgcggcggcgcgcgcataggaggcgaagcagcagcggagccaagccaccgacgccaccatgggtactctcgcgtgactccatgcacaagcgccgggccaccgggtgggngaaagccacgcaaactgcggcccgctttgcgccacggtggacacgcacacggccgacacacgttacttgagccctccgtngcaccgcccaaggacaccanggcccaaagcagccttaaaggctatatcggaacgccaaacaaagaacacgtgcaggcacgggctccgctgcttcgccgcgcagcgctaacgcttgcacacgcctgcgacgcggcctttcctttccccgggtttccccccttttgg

SEQ ID NO: 74687 - DNA, 188 bp, Triticum aestivum
  unsure (1)..(188): unsure at all n locations
  Clone ID: PAT_TA_74687
gtgcgaaacccgggaaggggggccacaaggtggggacaacccccgttggacgaaaaatgggaaaaacgccgaaatttttggtggggcttttaggggttttcacgcgcaaaaaaatgggccntgggcccgtggggccccccgnggtggtttcccgcaaatgtttcccccctgtttcccggaaaaaaagc

SEQ ID NO: 74688 - DNA, 235 bp, Triticum aestivum
  unsure (1)..(235): unsure at all n locations
  Clone ID: PAT_TA_74688
ggcctggggcccggttttcttaaagaaaacttaagttgggagattccccccccgggggggccttggggcagcgggaaatttccgggggcaacggaaagggggccaagggaaaggttccggaacggggaaccgngaaccggggttgggtttacaccttaattggggggggggcgttagggttgggaaccaatttccttaaaaaagggtttaccttaggaaaggccccgggcncttt

SEQ ID NO: 74689 - DNA, 127 bp, Triticum aestivum
  unsure (1)..(127): unsure at all n locations
  Clone ID: PAT_TA_74689
acctactaccctacaaaggcacagaggtatacgtagtaggagaactatgtacgagtggtaccccttnatagatatatatagctaatagctaatacagaaactagtgaccctagataggtacctacta

SEQ ID NO: 74690 - DNA, 357 bp, Triticum aestivum
  unsure (1)..(357): unsure at all n locations
  Clone ID: PAT_TA_74690
gcccncggtttactcgatcgaccgaggctcgtcgaacccttcttccccaccgctcaagatgcagatcttcgtgaagacactcacgggcaagaccatcacccttgaggtggagtcgtctgacaccatcgacaactgtgaatggccaatgatccaggacaaggatgggcattcccccggaccagcagacgccttatcttcgctggcaagcagctggatggactgtgtacgcacccttgccgactacaacataccagaaggaataccaccactaccacctggtagctaccgcctgcgatggtggcatgcagatcttacgtgaagaccctacaccggcaagaccatcactctggcaggtat

SEQ ID NO: 74691 - DNA, 414 bp, Triticum aestivum
  unsure (1)..(414): unsure at all n locations
  Clone ID: PAT_TA_74691
gtatgatgacatctcccaggccagggggcatcgggttacccagctgaggaacattcattcaacagtttgcacgtgcacggccatttctcctacgcgggatagggcagaggagtgtagacctagcgccacatgcccactttcttccgatccgtgcgccccccattcgcaaccatgttcgctgcggccatcacgccttcggacttgcgagtttatctactttgcgtcgggcaagcgctggctagacgggcagggcctagttgaagttctccctgacaactagaaggagcagacgccctccgccagggacaggaagaggcacaggcgagcctacaggggcgattggccctacaaaggcgtcttatttgccgtaggagaggcaaggtcctcgccgtnggccgaactcgtttttaacct

SEQ ID NO: 74692 - DNA, 314 bp, Triticum aestivum
  Clone ID: PAT_TA_74692
ggccgctgttaaactagtggcatccccgtggctgcaggctttcggcggcttagtggttttaactcgcatcattctcaaggttagcaggaggctgggccatggctgcctgtcgcagcccaagtcagggctcttctgtggtgcatcaacaaggtgcccactgtctgtcccaccccaagctgctgcagcttgcctgcctcatgccctgtcctgcacctgcacaggtgtgcacacagtgtcaccccaatgcaggtgttgctagttatgtcccagtgcacactttggcattcagtgtgcatgtgtttgcttggcatttg

SEQ ID NO: 74693 - DNA, 796 bp, Triticum aestivum
  unsure (1)..(796): unsure at all n locations
  Clone ID: PAT_TA_74693
acgcctactagtaaaggattggttcagtagataaccgagccaccaacagcaagcatagctacacgggaaatgggcgtcgtggcggtgaggaagtcctcgacggtggtcgtgaggccgccaccggagccggcgacggccaccgtcaacatcaacctctcgcccttggacaagaacgtcatgtccgtgccagcggctgtgttcatggtgttcgacagtcggatccccaaatcctgccgcgaccatagagaaggctctgtcccaagctctagcccactaccccgcagtctccggccgcctcgccgccggagccgagcagggcgagttccacatcaggtgcaccggcgagggcgtcccgttcgtggccgcggccgcggactgcgctctcaaggacgccgagttcttcggccggtcggcggccggcgcgctgctggaggagctggccatctactacccggccgagcactgcggtttcggtgaccctctgctcatgatgcaggtcaccgagttctcctgcggcgggttcgtcgtcggggtaacgtggaaccacgtcctcgccgacgcggccgggatcggccagttcctgcaggccgtcggcgagctcgcgcgcgggctgccgtcgccgtccgtggccccggtgaggcgggacgacgcgctgacggcggtgcctccggcccaccgacggcttcgtggagcttatgatgacgctccagccggccgacatnggccgcgctcgacgtcaccgttgcccatgggggctgatcgaccgtcaggacgggtgcacgccggggggtcatca

SEQ ID NO: 74694 - DNA, 304 bp, Triticum aestivum
  Clone ID: PAT_TA_74694
ttgtgccactgcatgtgctagcatcacttactgacggtcggaattttttgttgttgccactctagctcttgtccattttccctataccactcttaaatttcaaaccttgcttcttattaccgtacgcatgtacatgtcgattactaattccgggttttagacacttgtgccactgcatgtgctcagcatcacttactgacggtcggaattttttgttgttgccactctagctcttgtccattttccctataccactcttaaatttgacatttcactgttgccactctagcttttaacaatgctt

SEQ ID NO: 74695 - DNA, 158 bp, Triticum aestivum
  unsure (1)..(158): unsure at all n locations
  Clone ID: PAT_TA_74695
gctacacaaattacacaacagacaccaccataccgcagccnggcaagccataacaaaagcttgctcacaaaggccctggccgctgcttgccatanaaattgcatgcttgcaagccttaaaactcaaccaatttacaattgactgttgcgcggcccatt

SEQ ID NO: 74696 - DNA, 265 bp, Triticum aestivum
  Clone ID: PAT_TA_74696
tcgcgcgtcactctttcacgcccgtcttgcgcctgctagctagctcacccagtcactcattactcatacctcaactactcgttgaccaaccactaccagcgcatcacgacacgccgttgaacgacgttacgacctgtccgcagtataaaataccaagcgcttacctcactcaatcacccttacgcaactttccgaatgcgttactcttccgccgcggtgctgagcaccatcgtcgttggccaggctgctgccgccaacctccaca

SEQ ID NO: 74697 - DNA, 528 bp, Triticum aestivum
  Clone ID: PAT_TA_74697
ccccactggccccgctggtgagtgaggatgttacttccaccatcaagtctacctccacctccaccaagtacatcaccgtcaagcccactcccactggtgagggcgatgtccccgctgactccgagtccaacccctccgggcccgcttgttgttaccggtgcctaccccactggccctgctggtggtgaggccaagccctccactcctgctggaagcgaggggttgtgaggactgcgctgctcccgtcactgtcaccgtaactgccaaggagaccatcaccgttaccaagggtggtgactaccctgctgctacccccaacgctcctgagccaacccccgaggttccctctgagcagactgcctcctccagcatgcccgccgtccccactgccatgtaccccgtccccggtaacggcaccaacccctaccctgccggccccactggcttcaagacctccaccaagcctgccatgcccactggcaccggtgccgttcccacctcggtcctccccagcttctctttcgtctc

SEQ ID NO: 74698 - DNA, 112 bp, Triticum aestivum
  Clone ID: PAT_TA_74698
actggaagcccatccttatctactcgaggatgggatcaatgtgctcatatatgctggggaatatagaccttatatagcaattggctcggaaactcaaggtgggtccactacc

SEQ ID NO: 74699 - DNA, 273 bp, Triticum aestivum
  Clone ID: PAT_TA_74699
tcacaactctattgtgtgatatattttctcaacctatgttgtatgttatcattttgtagaggattttttaaactgctatgtttgtagatacgtacaaatggatgtgataaactttataatgtttcacaccatgcaaatattttttgttgggccaaaattggcattaggatttgaggaccgcattatgttaaaaacatactgggtcaaactttggccaaaagaaatgggctaatgggctcaaggaaatttaaactgccctttaaattttgccta

SEQ ID NO: 74700 - DNA, 128 bp, Triticum aestivum
  Clone ID: PAT_TA_74700
tatgtctcagtctggcagatgctgcgcggcgcaatgcttctcagtctggtagatctccacgcgccgagtcgtggctttcacagttgcctttcaaatccttttggcataagaacactggcagttcttga

SEQ ID NO: 74701 - DNA, 253 bp, Triticum aestivum
  Clone ID: PAT_TA_74701
tcagcggtgcctgcacctccgagggccagtggaactgcattgatggcaagtccttccagcagtgtggatctggcacttggtcgacagccatggctgttgcgcagggcacaacctgccaggtcggccagtccaccactctgagcatttccgctgctaagatcaagcgtgtcgttcgtgctttccgcgcatagacaagcagtcggctcacgctgagcaatgtacaaaaggggaatgacacggtatgaaacacttc

SEQ ID NO: 74702 - DNA, 348 bp, Triticum aestivum
  unsure (1)..(348): unsure at all n locations
  Clone ID: PAT_TA_74702
ggctgactctctgaccgaggaacaagtctccgagttcaaggaggccttctccctctttgataaggatggcgatggacaaatcaccacgaaggagctcggaacggtcatgcgatcgctgggtcagaacccgtccgagtctgagctggcagaatttgatcaacgaggtcgatgccgacaacaatggcaccatcgatttccctgaattcctgaccatgatggcnaggaagatgaaggacaccgactctnaggaggaaatccgcgaggccttcaaggtcttcgaccgtgacaacaacggcttcatctccgcggccgagctgcgtcacgtcatgacctccattggcgagaagc

SEQ ID NO: 74703 - DNA, 466 bp, Triticum aestivum
  unsure (1)..(466): unsure at all n locations
  Clone ID: PAT_TA_74703
ttcttgcagaagatcaagacggggagagcgatgatgaacatgacgtgtgggatcaggtacgcgagccagaaaccaacgtatcgctcagcgtaaaccatgctgatttgaccgaccagagcaccgatgttgatgaagaagtagaaccagttgtagatacgggtgaccgtgacagcggggtcgacaatgacgcgctcagtaccgcgtgtctcaacgcgcatcttctcctgaggaacttgttcggcgatnagaggggcaatgttgggcttgaaagttccagttccaagacccatgatgatgagaccgaggatcaaaacgccgagggcagtgttggagttctccaagacagacggcgcagctaaggcgacaaggatcaagtgaccgatttcagcgaccaagacggagtacagaatagtcttgaaacgaccaaggtaggtctcggcgatccaggctccgagaagcgggcaga

SEQ ID NO: 74704 - DNA, 163 bp, Triticum aestivum
  Clone ID: PAT_TA_74704
aaggaggagcttgatgggagaatcaagcgagtttgttggagagaaggttgcatatgcactcgctcagggcttgaaggtcattgcatgtgttggtgagactcttgagcagcgagaagctggatcaaccatggcggttgtcgcttaacagaccaaagcaattgct

SEQ ID NO: 74705 - DNA, 557 bp, Triticum aestivum
  unsure (1)..(557): unsure at all n locations
  Clone ID: PAT_TA_74705
accacacactaccatcacaatggcctccctacactaccttcctcccgtcaagccctctgccattgccctcggcacggccttcaaccacgccgtctccctcgctgtcctcggccccgtcttcggtgacgcataccgccgcgcacagcaggcaaactccaaggaggagtacttccacagcaaggaggccgctaccgccgccgcatcgtggggtagctccgtcctcggctctggtatccaggcctacggtgtcggtgctctgatcaacgctaccggaactctcacctacaagggtgctgcttacctcggctccctgatcttcttcgcctccgccgctccctccattgtctcccaggtcgtcaccgagaagcgccccatggacaccatcgccattggtgcccttgcccgcgtcctcaagaccgtcggtctcagcatgttcctcacctattggggaacccgcaccaaccccttcgactaagcgtctcgccccataacggcngaggagtttagggattctcatctttggcggtttagattgatgcttcagtcagcgaatgatg

SEQ ID NO: 74706 - DNA, 386 bp, Triticum aestivum
  Clone ID: PAT_TA_74706
tgcccccggaccaggaggatcgtcgtagattcggacaccgatgagcaccacttcgagtcaaggccgactccggcgcctccaagacctaccctcagcaggccggcgccatccgcaagggtggacacatcgtcatcaaggcccgtccctgcaagggtggtgaaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgataattgatatgtcagccttctaacttagagtggcaacacttaggatgacctgaagcttcccac

SEQ ID NO: 74707 - DNA, 306 bp, Triticum aestivum
  Clone ID: PAT_TA_74707
tggccttactcagactaacgtctgcgctgagcccggtgactctggcggttcctggtacagcggtgctcaggcccaggttgtcacttccggtggctctggtgactgctccagcggaggtgtcacttacttccagcctgtcaacgagattctgtctgcttacggtcttactcttacccgcggttaaacgcttggatgtgagtttgctttttgcctagcgatggacgatggttttggatgatgtggtatgaaatgtttcatcagaacgctttgagttgtatcatagtttgattgttgaattgcagttat

SEQ ID NO: 74708 - DNA, 112 bp, Triticum aestivum
  Clone ID: PAT_TA_74708
ttttccattctcctggctccacttgatgcactattattgtggatttaggtaggttgccactctgaactcggaagcagttcaaagtaaactggatagcgcgtgagagtggcag

SEQ ID NO: 74709 - DNA, 571 bp, Triticum aestivum
  Clone ID: PAT_TA_74709
gcgttattggcactgtgtgatccgcagaagcttgcagaaaattctataacgcctgattattcaaagtctctacctgaaatatatgctcaacttattcacatggttgtcgatgatgaccgatgggaaaataactggaaagcggctttcatagtacttgccatacctcacgcactgatgcttaaagagagcgaattagagggtttagatcaagaggcgatgagtatcctggaagaataccgaaagtattactatgatgatcctgggtgttcatcggggttggttgagcgaatagtgagatgttacacctcttcacttcctgacgcacttttcttggagcttactgagaatgaaatgaggcgattcatctgtacggcaacatgatgattatcaaggtcatgtgttgtgctagtgtacggggctactgaaatatgggggcgacgattttgggtacactcatgaaggacagaccgttatatgtatatctcgcatataccattctccaaaacgacgagccaagaaccgctcatgcgtactcactcctatccacccaccccggctgcaacgccttccc

SEQ ID NO: 74710 - DNA, 129 bp, Triticum aestivum
  Clone ID: PAT_TA_74710
tatgggctctctcatggctggatgagctcccatgctctcgacgacgacctcaaagctcgtttcatgagaaatcgttcgctgaccaaggacgaggtggaggccttctggaggcaggccggcttcttgtgc

SEQ ID NO: 74711 - DNA, 406 bp, Triticum aestivum
  Clone ID: PAT_TA_74711
tgggaagacttttgatctagacacactattttcctgaattcagaggagataaagtacatggtgatcctaggcttggctgagtacaatagtacggtgttcgtgcggacagttgtcggccacttcatggtccaacttgaattcattgaagttcaacagaacgttcgaaaccaacatttggaatttccatcaaccatttgaaagtgtctatactggaggtatctagaggtgtactgtggttgatgagatgcaggaatgggcttgtatgctgcaggttcttccattttgtgtgcttcacatgtcgatcgactctctgtagcacgcgccggtcaagtggggagtggaactgtaggagttgatcgtttaatttgacaactacccgctgttattgtctaaatttgtggacaca

SEQ ID NO: 74712 - DNA, 132 bp, Triticum aestivum
  Clone ID: PAT_TA_74712
cgctacgaaaagtatacaacttggaactctgccaacatgcgcgtcaccatccactcagcatcgctagctatcgcagccttggcagtagcagcatcagcaactccgatgggactaccaaatcgccaatcgacc

SEQ ID NO: 74713 - DNA, 339 bp, Triticum aestivum
  unsure (1)..(339): unsure at all n locations
  Clone ID: PAT_TA_74713
ctgggatcaaccgtttcttgggggctatatttctttttttacaacagagctaaacaaagatacttgcaggagaaggatgttcagctccgtcctttcgaccatcttgcctcagctgcagaagcaggtgctttggtttgcctgtttacaaatcccatatggctngtgaaaacacggatgcaactacgaactcccgggcatacttcatcttattctggattttctgatgctttgagaactattcggaaagaggagggatggcgagcactttatagagggatcgggcctggacttttgctggtcacccatggcgcgatacagttcactgcctatgaggaactt

SEQ ID NO: 74714 - DNA, 345 bp, Triticum aestivum
  unsure (1)..(345): unsure at all n locations
  Clone ID: PAT_TA_74714
tatcctcttactgacattctcactcgccgtcctccacactaccttcctcgctcttgctttcctcgcggacggaactcattcgacgcgttgtgtcggcgcttgatcggcggctgtgggtgctacgtgaatgggacatgggattagagaggatgttcgaaacgtgatggtccgggttggtagatnagtaggaagaagaggatattgagcggcggcggggtggtggaggacctgggggtgatgggatggtgttggtattggtggaaaggttggtataggggagagagataggtgaggtgaggacgttccgtgtaacgacacgcctattcaatgcaacctaaaacacgg

SEQ ID NO: 74715 - DNA, 468 bp, Triticum aestivum
  Clone ID: PAT_TA_74715
agatctccctcaacgcccgcgatcgctttgagggcacgacggccgtcgccatcgggattggcaacagctcgggcaatgcgtccggtggatccagctccggcggctcctcctccgcgccctccgacgaccgcgacaaggcacaggcggagcgtggcggctaccagcctcccgggccgcggccaggggcgtggcacctaccagaacggcaaccagggcggacgtggacaggctcatctcatgccggggggcagacccctagatcggatattttgcaccgtggggtgcgcactttcctccataggggcgtgctccctgggtgcctcccaacgccgctggcgtgctcgggcctcgccccggcaaccctgctcacgcctaccccatgacctaccatggcacggcttcttcttcgactcatcctccgccgccgcagccgtcgtgggatcaggccggcctgatcgccgccatgca

SEQ ID NO: 74716 - DNA, 663 bp, Triticum aestivum
  Clone ID: PAT_TA_74716
accgcgctactcctccaccgatggcgcagacgtcgcagttagaaggtttcctgggcgattccagtagatgaaacagccaaagaagaacttaagcaaagagaagttccgaacgcaaagatgaggacgaggacacagccatccaggagaggaaaaggagccgcaggggaggcaagcaatgcttcggtgatcccttccctgggaaattttgatcgagaaagtcaaccttgcatgcaacctacacattccgagcaacagccagttggtacaatgtttcagcggtacccgaacaaaggtgaggtgcaaaagcaagttcaaaggagaagcaagaggcaagaaccgagtggaagggaaaacctgagcagagcactcgttcctgcaccagtgagaaaaagcacgagaagaaagtcaaggcatttgcaggggtggcttggtgaaaggtttctgtatagcaataggctacccggcgcaataggcattaaatcatattctcgcggtgaagatggcaaggttgcactgagagtggaatccttcctgcccaaaaaatattcagatcttgtagcgcaagtcgggatgtactgaggttcttggatatgtttcagtcatgacgcttatatctatccttttgtggcatttgcgagctttatcttagccacgcaacaactt

SEQ ID NO: 74717 - DNA, 417 bp, Triticum aestivum
  Clone ID: PAT_TA_74717
ctctaccaaccaacacaaacaacgcaaccattggtctcatgtggcataagggctttggcggcaagcacgccggtggtggtgttgtcgctgaccgtcacggcgtccgccgcgctcccttccgcttctcttgcggacgcttcagctgcttccgctaagctagtcgccgacccttgacgacgattcacgacctctttcatatcccacatttcgatgatttcctcttgcgacggcgttggagcgattgaatacgcatggcggcgcgtaattcaaggagaagttaggcgataccacgagcatacatctgcgacgcagtttcatgcttcacaataccctcagtagcctaatacaacatgtctgttcttcaaaaaaaaaaaaaaaaaactgaaactagtcctctctctctctcgtcaagttttg

SEQ ID NO: 74718 - DNA, 601 bp, Triticum aestivum
  unsure (1)..(601): unsure at all n locations
  Clone ID: PAT_TA_74718
agcgccagtgccggctctgccgccactcccgcctcggtccccaacaccgtcaccatcccctgccaccacatccgcatgggtgacatcctgatgctccagggccgcccctgccaggtcatccgcatctccacctctgctgccactggccagcaccgctacctcggtgttgacctcttcactaagcagctgcacgaggagtcctccttcatctccaacccggcccccagcgtcttcgtccagaccatgctcggccccatcctcaagcagtaccgcgtcctcgaccttcaggatggtaacgtcgtcgccatgaccgagtctggcgaggtcaagaccagccttcccgtcgtcgaccagggcggcctctgggagcgcctctcccgcgccttctccactggccgtggctctntccgcatccttgtcatctccgacaacggccgcgagcttgctgtcgactgcaaggtcgttcacggcgcttctttgtaaacacctcaatacctatatcgacttttaaacccgttgtattgctcttttagtgtatggatttggagtcgagccgtgtttgcacgggagatcaattgcgggtactgaatcagcgattagt

SEQ ID NO: 74719 - DNA, 603 bp, Triticum aestivum
  Clone ID: PAT_TA_74719
ggccggaggctggccggacaggcacattcaggctcaccgtcatcagatggctcgactccgctagcccccctcctcctcgcgccttccttgccggtcattgaggccgtagccatcacgacggccacctcctggatcttgctcgacgcccttagctggtcgcgacgggccggtgcgggacgacacgacgagtcggtgcctcggcgcctcagcggccagtacctcactatgacgccggtgctcaagctcaacgccctcatctcctccgccctccctggtccctgctcgacgcccccatcgtcccatcccctactggtcaatgttccaatccattcgatgcgctccccacctcacaatcttcagtccgacagctcactacctcaagtagtagtctactagcacaatgtcttcaggaggatcaggggcttcttgtacaactacaaccggtgatgttgaagaagaggaggaagagaagaaagtagcagaataagaggaaatggaagaagaggtggagaatcaagaagttgacgaagatcttgatgaagaagaccaagaaaagtggacatggatctgactgagagaagtggttatgtgttgtgtcatgcc

SEQ ID NO: 74720 - DNA, 424 bp, Triticum aestivum
  Clone ID: PAT_TA_74720
gcgccgtcggcggatctgacccgatattgcgtttgcggcgcagaaaccagccatgaagggggccaaatccaatggcgccgtctattgccgacaccaagttggcggtgaagagcaagggggcggagaagccggccgccaaggggaagaatgttcaggccggcaaggaccccaacaagcccaagagggcgccctccgccttcttcgtcttcatgggcgagttccgcgaggagttcaagcagaagaaccccaagaacaagtccgtcgccgccgtcggctaagcggccggtgagaggtggaagagcttgagcgaatcggagaaggccccctacgtggccgaggccaactaagctcaagggcgagtacaacaaggccattgccgcctacaacaagggcgagagtgctgctgctgctgccccaaagaagg

SEQ ID NO: 74721 - DNA, 512 bp, Triticum aestivum
  unsure (1)..(512): unsure at all n locations
  Clone ID: PAT_TA_74721
tggattgccgttgatcatctcacgccttcttcttcttcctggcgggcaagatgttgggcgagacccagctgcccgtgacggcgctgatcggtcggaagcggcgctgggacaaggacgccgccgccgccagctacgaagaagccagcgatggcgatggtgccccgaaggagcaagcccctatggctatggagatcgcggctagcccaacaacccgtgacgaggagaagcaggaggacgatggatatggctgttccggcctgcaagatgggtgagcaaccccttacggaaattgaaagttcgactgtctcgactgtggaggagaaggaagtgaccaaggagcctgagattccaatgtgggacagcgatgatnatggtgagtttatgctcaaggcaaaggcagagctcgaggagcttcacattgcctgtgtcaaaagcatcaccgaattggatcctaagtcgaaactcttggtccctactcgcttctgcagcttcaatatagccggcttcgacct

SEQ ID NO: 74722 - DNA, 539 bp, Triticum aestivum
  Clone ID: PAT_TA_74722
taataggaatcatatatgttttgagtacttattttgcacaactgaaatagcaatgcttaccatacagtaaacaaaggtctaaataaagcattaacctgaagaccaccacttccaagttttgtggtaattttccgtaccttgtcgataatatagggtttaattctttgggttttctcaaatgatcaggcacagtgagatacattttcaagttatgtggactattgttagaatagctctgcattagatttacacttcattatctcgttttaatccttttgtcaacgtgtttcttactaatgctaattttgatgtactcatctacatcccaatttcgtgcttattcaatgtatcttagtgtaagatattcgtatctcatgccctcttgttgatcctataacttgatattcatgcatgtttaccaagaaagtatgttttgtactttgtttccttgtgtaacctaagtttctgtatttttgctcttccaggtttcaagagttggaaccccttcaagaagtatatttgctcttccaggtttcaag

SEQ ID NO: 74723 - DNA, 506 bp, Triticum aestivum
  unsure (1)..(506): unsure at all n locations
  Clone ID: PAT_TA_74723
cggccgcgtctcctcgattggatctccctcgactctgaagccgactccgaagaaagcatcctcttggaagacgacgactccgaagaaagcgtcctcatggaagacgactccggagaagactctgaggagctcggtgacggcgaggatggtccctgcctcgcgtggaccaaacgggagcgacgcaacaccgccaggttccacctcgccgtctgccatcccttatcccgcagatacgtgctgcttccaaccataccggaggacctcgccgcccagccgcaagatcgcctttgggcattcgagcccgtgctcgctcccaacaccggggacgatngagaggaggagcccttcaaggtgatatgctttgcaagataccagacgaagctcgtcctctttgtcttctcatccacaactaagcaatggtctatggtcaattctcccttcgcaccttttgtggaacacacgtcccgttttgattgtgtacgtggctgcttctactggtcgcaacc

SEQ ID NO: 74724 - DNA, 222 bp, Triticum aestivum
  Clone ID: PAT_TA_74724
tatgcacgaggtcatcatcaccctgaacagccaaccacccagtttctaacaatatcctatagtagccaaaggctatcacctggaaccatagaagctcaatatcggacttgttctcgctattgccgctggtggactggctcaaagcctctccagctttgattgatgagacccgtcctggaggtggaattgatgagaagccatgggaggggggttcagtcgcac

SEQ ID NO: 74725 - DNA, 159 bp, Triticum aestivum
  Clone ID: PAT_TA_74725
acgagggccacctgctccccatctcgatctaaaacctgagggtttctgtccagctcctgtcgcctgctgacccaaaccagagccctgcccaccacccacagcacatgcctgcacagcacaccacatggtgtcacagtgtgcatgtgccacagcacaccc

SEQ ID NO: 74726 - DNA, 906 bp, Triticum aestivum
  unsure (1)..(906): unsure at all n locations
  Clone ID: PAT_TA_74726
gcctctatagtggatccccgggctgcacgctctggnntacattagcatgggatacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaaagaaaccggaaagttggggggcctcgaaagaaccgaattcaggattacccttcccctaaggttccttccaaacccnattaaaccgaattggcccaacccaggggaattccggggcgggaattggtttggcttttaattaaggggaacctcccggccgggaacccttttaattgaaggaaaaattccaaaagttcctttttgggggttcccggggggggaaggttaattgggttccggcaaagggcttaaaaaccttttaacagggaaattttggaccgggaaggggcaacccaacccaagggcggttgaacccttgcgggctttaattttggaccttcaacaacggggaaaactttaccagggttcccagaacattaggcaggattgaccaagaactgagaagctcttttcttgatttctcattgggttggtgggtgcatggccgttcttagttagtggagcgattttgtctggttaattccgttaacgaacgagacctcaagacctgctactagcttcggagccatccctccgacagctagcttcttagaagggactatcgccctttaagcgacggaagtttgaggccaatacncgggtctgtgatgcccttagatttctgggccggaaagcgcgctaacttaatttttcacgagtattggcttgcccacaggcccggtaacttggga

SEQ ID NO: 74727 - DNA, 754 bp, Triticum aestivum
  unsure (1)..(754): unsure at all n locations
  Clone ID: PAT_TA_74727
ttatagtgatccccgggctgccgaattcgttacgaggcattgaagaactggagcgggaagaggccgaggtcatgttccaagcgcgatgaaggcgagtacgcatccctccaagccatccacgacgccgtgccatcgctatgtcctcaacccctcggccacgggcgattcgaatcgcagccatccacatccttcctcgtgactgagttccttcacctcacgggacgatcgagttcaaagtcgaacccgccatcgctggcanttaagctcgcaaagctacataccctgcccgcgccataccagaaggctgtgacaagcctatgtttggctttccagtgacaacgtgttgcggcgatcaccacaaagattaacagctatagggaagctgggcagactattacgcggaaaaccgtctcagatccatcctacgatccgcggagcagaatgggcgaagggacggcaggtcaagaagctagtcagcagaccgcggccatggtagtaccccgcttgattggcgatatcatctcaatacggcagggagtttgcacccgtcgtttacatggcgacttatggagcggcaatgcaagcgctggcgtcttggtataagaaagggcgaggttgtagactggtttacgactcgtcggacatgctacgccgcacaacgagtttgaattaggcgccatgaaatttggtggcttcngtagggagttcctgaaggagtccctgagctgtgtccaagacggagccgtgagaatac

SEQ ID NO: 74728 - DNA, 613 bp, Triticum aestivum
  Clone ID: PAT_TA_74728
ctgggatgctgaggacaataatggggtgtgcctgtggacaccatctgtcttctttatggtccatctcgagtcattgcagtccaagaaacttttagaagccaacttcttttttgtttgtcgcccattcgaaagtgtctacactgcagaaacagacattggtggtggacacgatggggctggtcttttgcagaatacataagatgattatctggctatgtatgctgccgtggtgtactgattgagcaggtatctaggactacgttccggcggctgagatgcagaaatgggttgtgtggtgtaggttcttccattgtgaaggggtctgtgtgtactggatttgccggtgacttgcttgaattaagtattagtgttgcgtctggttgagttttcagcttctttacatctcggctgatgttatatgccccatggtgctgtcacaatagattaaaattgtgtttctcaaaagacatgacgatgacacggtgatcatgaaggtgaccgaatccaggagaagatacatcccttgtttgtcattagaatgagcaggatgcgagttccgttgggtagagttcaccttgtgatttgtagtatgcccaagtttgtactctgtcct

SEQ ID NO: 74729 - DNA, 279 bp, Triticum aestivum
  Clone ID: PAT_TA_74729
acaatttcttgaatatagtatacaagtgcaatttcctgtcaaggcatatgttcttctgtacttatatagtgactttacaataggttgaatagttttgttttcaatatttccttccgatttgtgcatctgcaattagaagaaaaaggtatgtcgtttgcgtatgtattctcgagtttctacacctgtttattcgcacctaggtgttctacacaaagaagagagcatgataaacaccagctgtgggcaatcctgcaatttgtcctgactatttggattcta

SEQ ID NO: 74730 - DNA, 472 bp, Triticum aestivum
  Clone ID: PAT_TA_74730
ccaacttacgcacgagcttgttatcatcatgttgtctcaagtcgcactcctttccctcgtcgccagcatggcagctgcgcagactctcaacatccccactcgctcaggcagcatcgtgtcgctcccccagcccagcaccatcttcggcagcgtcaactttggtaacaaggagttcgaccgcggtcggccttgcaactcatattaggacactggcagcgacagcgccgtcttcatcctccagaacggcgcgtccatctccaacgtcattattggcgcaaatgcgctcgagggcgtgcactgcttgggctcctgcaccctaaccaatgtctggttccgcgacgtctgcgaagacgccatctccatcctcggtagcggccacgccctcatccaaggcggaggtgccgctcaagccagcgactaagtcattcagcacaacggcgccggcacagtaaccatcaaaaactacaccatc

SEQ ID NO: 74731 - DNA, 504 bp, Triticum aestivum
  Clone ID: PAT_TA_74731
cggcacgaggcaccggtgtcttcaccaccaccgagaaggccaaggctcacttgaagggtggagccaagaaggttgtcatctctgctccctccgccgatcccccatgttcgtcatgggcgtcaaccacgagactttacagttccgacatcgaggtgctctccaacgcctcttgcacaaccaactgccttgctcccctgggccaaggttgtccacgacaagttcaccatcattgagggtctcatgaccaccatccactcctacactgccacccagaaggtcgttgacggcccctccgctaaggactggcgtggtggccgtaccgctgcccagaacatcattcccagcagcactcgtgccgccgaggctgtcggcgaggtcattcctgagctcaacggcgagctcactggtatggccatgcgtgttcccactgccaacgtctcggttgtcgacttgactgtccgcatcgagaaggctgcgtcctacgacgagatcaagcaggccatc

SEQ ID NO: 74732 - DNA, 469 bp, Triticum aestivum
  unsure (1)..(469): unsure at all n locations
  Clone ID: PAT_TA_74732
gtaatagtggatccccgggctgccgaattcttacgagggcaggcagcgaagcggggatgggaggagatggcgtcggcggcgtacctcctcgcccatcggcgagtgactcctgtcagagccccatacggctccgtcgatctgccagacctaggtcaccggcgtggatgccgtctcaggcgagaaaaggagtggtcgtcttttaggacgcgaggagggggagcagccaaccgtgctcaaggccgtccacggtggccgcaaatttttgcggggctaacaactcgaagctgcaagaagacgggaaggcggaagatgtcgagcattgtggccctgcgcacaaaggaagaaattacaaggttggcaaattcccaattttcctttacttcttgttagaacttccaagggtgccttcttggattcacccttatttattntaacatcccaattaagaaaggattacaggggaaataac

SEQ ID NO: 74733 - DNA, 484 bp, Triticum aestivum
  Clone ID: PAT_TA_74733
cttttcgaggctctcacgactctcccaacctctctagcgaagtcgacgcggcgaagaaatcaggcgacaagattgcgaactgctagatatctcgacccgatccgggtcgggtcggccatgacggtagatcgtggaatgtgactgctgtagtgctgtgctgtgctgtgctgtgctgtgcctgcacccttcgagatccctggctgctccagcctgtgtaagaacttgtggagcagaggaaagtaccctggagtcatgttctcgtcaaaccaataggaaacacagcgacctcggagatccacgtgatgggcctaaatttcagttcttcttgacacaccgaattcaggcgattgggacacacgaaaggttgaaacccaaacaaacttgggaaggcattggattcccaccagtgggttggccaaaaggaagtgtggcccggaagtggaaaaaggccccaacccttgccaacacagggggtttcccacag

SEQ ID NO: 74734 - DNA, 233 bp, Triticum aestivum
  Clone ID: PAT_TA_74734
ttgcacgaggataacccgacagccacgccccttcccacgacaacctcttctcccagctcacacaacaagtcgtcaaaatgggtcgcgtccgaactaagaccgtcaagaagtccgccaaggtcatcattgagcgttactaccccgagttgtcgctcgacttcgagaccatcaagaggatctgtgatgagattgccatcattgcctccaagaggctccgaaacaagattgccgga

SEQ ID NO: 74735 - DNA, 452 bp, Triticum aestivum
  unsure (1)..(452): unsure at all n locations
  Clone ID: PAT_TA_74735
tgcttatagtggatccccgggctgccggctcgttttacacccttggtgncagcagctcatcgtcgccatcaacaagatggacaccaccaagtggtccgaggctcgtttccagtgagatcatcaaggagacctacgtcctatcatcaagaaggtcggctacaaccccaagcaggtcgctttcgttcccatctccggcttcaactgtgttgacaacatgctcgaggtttccaccaacgccccctggtacaagggttgggagaaggagatttgtttggaacaagttctccgtgcaagacccttcttgaggccatcgacctccatcggagaaccccaaaggcgttccttaccgacaaggcccccttccgtctttccctcccaagggaattgttcttaaccaagaatttgggtgggtatttgggaaaccgggttggccccggttcgggaccggttat

SEQ ID NO: 74736 - DNA, 420 bp, Triticum aestivum
  unsure (1)..(420): unsure at all n locations
  Clone ID: PAT_TA_74736
tttatggcacgaggcccacagccaaggagaatagtactatgctagcggcggcaactagcntngtagcggcgccggctagcaagtagcggcaacggctagcggcgggtagcaagatagtaccccgacgtaggaggccaccgccggcgcggcgccataggtacatagcccaccgcctacctcacaaggggagctaccggcaggtatacgagataggccggcggggagaccggggctagcgactagcaccatttnagtagcgtgcaccgcgtagcggctagctacctagctagcagctaagcaactagagccggcgcccaggaggccggccggcgaggcgagcacgaggatngaggaggacaagcaagcaagcaacatncaccagtnacacacacccagcgtatagtatacaccacccgctag

SEQ ID NO: 74737 - DNA, 539 bp, Triticum aestivum
  Clone ID: PAT_TA_74737
gctcttactgcggtgggcacgtccagtacgccatgcccaacgcgaccaattcgactacattcatgatcccgatcgtgggcgctggagcagacccctggatgttccgccacgaggactactactacatgacctacaccaacaacgtcaacatcaccctctggcgcagcatgtccctgacctcctgggacgccgcagagtccaagaccatcttcgtccccgagcccgaccattgcctactccaccgacctctgggcgcccgaaatccaccaaatcgacggaagctggtgggtaatcttcaccgcagacccccaacttcgactccccaccacccgaggtggagatgtggtgcgagtacaactgccccgccgtcaaccaccgcatgtttaccgtcgtcggcgaaggcgaagacccctggaccgccgagtaccgctaccatagcgaactcgagacgtacgatcaattcgccatcgatggaacctatttccagcacgccgaccaactgtaccacatctactcatgctggtaccacaagtacgacg

SEQ ID NO: 74738 - DNA, 487 bp, Triticum aestivum
  Clone ID: PAT_TA_74738
ctgcaggatttggcacgagggttccgcattcgcgacttcgactccacaaacctcttccgcctagctactatcgccatcagtctctacctctctcgaagcgcatcaccattctagcaacacatcgcccacatgtctctcaagaacgacgaattccccgcctccgccgccttcgactagatcgcgcaagccctttccgcttccgacgccgaccgcacagacgccattaagaacggcaaggtccatattcgctttcacactcaagaacaaggccggcacacaagaaacatggtaccttgatctcaaggagaccggcacggtcggcaagggtcctgctccagcgggcaagaaggctaccgccacactggtgctgagcgacgaggactttggcgagcttgcggccggcaatgcgaatgctcagaagctgtttatgagcgggaagttcaaggtcacgggaaacgttgtgagcgcgacgaagctagagcctatc

SEQ ID NO: 74739 - DNA, 341 bp, Triticum aestivum
  Clone ID: PAT_TA_74739
tagtggatccccgggctgcacgcgtagattaggagaaggaagcagcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatcttgtcctcacaaggccaggagtgcctgcctctgatcctcatccctgaggaacagactgaaatattcttcttcaaccttacccggtgaaagttgcaaatcctaattccctttattgcaaggggttcattattcaattggtttatt

SEQ ID NO: 74740 - DNA, 367 bp, Triticum aestivum
  unsure (1)..(367): unsure at all n locations
  Clone ID: PAT_TA_74740
ggngcgcacccctctccctccttcctgnagacagcgccgctgtcgngccagagcacatggttggctgncctgtccccgctcccgcagcctgagacctgctgtgctccacctgcgcgcacggtgnngtgcatgtccaacccccacgcagttctgtccanaggcctactcctgttttacctcaagcgctccggccaagcatggcagcttcccagcagtgggttgacattgtcaagcatgcttttttttcaaaggagctgcacttccttggaattgcctaganccttggtgttaccttaaccaattcacggggccttggcccttcggaattgggccaaagtggcaccaggaattcttaaccctttggaca

SEQ ID NO: 74741 - DNA, 682 bp, Triticum aestivum
  unsure (1)..(682): unsure at all n locations
  Clone ID: PAT_TA_74741
ctttacgaggagaccccacacatgtcttacaccacccgcaaggttggcgctgccaacaccctcgagcaccgctgtctacatcgagaaggacggccagctcgtctcgccatggcacgacatcccgctctacgccaacgagcagcagaccatcctcaacatggttgttgagtgtgccccgctgtgaccaacgcgaagattgagatctccaaggaggagcagctcaaccccatcaagctttgacaccaagaagggcaaagctccgcttcgtgcgcaaactgctttcccccaacaagggcttaccttttggaaactacggtgcctttccctcaaactttggggaaggaccccaaaccggttttttccaaccccagggaagaacccaaagggccaaaggggttgaacaaacgacccattggacgtctgcgagattggcgagcttgttgccaagcccggtgaggtcatccaggtcaaggtcctcgtgtgtccatggctctcttgacgagggcgagaccgactggaagatcatggtcatcaacgtcacgacccgttngcccccaagctcaacgattcgaggacgtctagcgccactctcccgggcttctccggccacaacgagtggntccgtatcttcagatcccgacgggagccgagaaacagttgctttccgggagtggagacaaga

SEQ ID NO: 74742 - DNA, 103 bp, Triticum aestivum
  Clone ID: PAT_TA_74742
ggcgggtaccaccccctcttccaagatgtcgaagcgagggcgcggaggttctagctggtaacaagttccggatgtcgctgggtctgccggtggcagccactgt

SEQ ID NO: 74743 - DNA, 582 bp, Triticum aestivum
  unsure (1)..(582): unsure at all n locations
  Clone ID: PAT_TA_74743
ctgcacgagggcagtcgtctgccgtgacatcgtcgaggcccactacaaggcatgcttgtactctggaatcaagatctccggcaccaacgccgaggtcatgcctgcccagtgngagttccaggtcggcccttgcaccggtatcgagatgggagaccacctctggatggctcgcttccttctctaccgcgtggccgaggagtttggcgccaaggtgtctgtccaccccatgtcccattcccggtnactggaacggcgccggcctgcacagcaacttctccaccaaggagatgcgtgttgagggtggcatgaagcacattgaggctgccatcaagaagcttgagggccgccacaaggagcacatcctcgtttacggcgagggtaacgaggctcgcctcactggcaggcacgagactggttccatcgatcagttctcttacggtgtcgccaaccgtggcgcctctatccgcattcccagggaaaccgccgcccagggcttcggttactttgaggatcgccgccccgcctccaacgcctacccgtaccagatcaccggcatcatcatggagacctgcttcggcgccg

SEQ ID NO: 74744 - DNA, 355 bp, Triticum aestivum
  unsure (1)..(355): unsure at all n locations
  Clone ID: PAT_TA_74744
ttacacgggggataggaccggaagcatgccgcccaggtaaggacgcgaaccggagcccatggcgcaaaaaggccgggcgacaacgggcggcctaccaatcaaagggaacttcggttaaccgggggcgggtgggaggcgcccgctgtaaccaaagaacccgggaattgccaccgttcgcaaggttcgcggccagaaaaacanggggaaggcgaacgaaacaggggcnggttggagaaccggcaaaaagcgcccaccggcgccggcacgaaccaaggcgaaggggtgaaggcaccgaaaaccaccaagaattcgtggaaagaaccgttgctggagtgttgggccgcgaaccgtgtag

SEQ ID NO: 74745 - DNA, 476 bp, Triticum aestivum
  Clone ID: PAT_TA_74745
ggtacgaggggcaactgtctctcactctcattgtcctcgccatcaactactccgtcgctatggtcgttgcgccacagtacgccacctggggtccgcaaacctactgcgacatgaagaccaacagccttgaccagcagcccgattgcagccaccacaaggatctcattatgccttgcagcgaactcgctaccaacccctctgcgcagcaagtctgtacaccctctgttctcatcaccttcattaatcgcgtcaccatcaacttcccattcttcggtgtcgtgctcttctgggctcaattcgctttcttgggcgtctatctagttgtcttcctcaccacgctcttcaaggctccatcccttgaccaggaacaagtcgatcgcgatctcgaggaggaagaggaggagggtctgcttgccagcactggacgcaggtttggtgctacctggagtgatgtcactggacgcgcaaggaagcct

SEQ ID NO: 74746 - DNA, 603 bp, Triticum aestivum
  unsure (1)..(603): unsure at all n locations
  Clone ID: PAT_TA_74746
gggatgatggctttggcgatgggatctgtcaagagatccttactggaaattctggagagcgtggaatcggtgcagaagaaaaaaccaagtgtcaaaaactctcctgtttggggggcagttctcacaaacaaaccaaataccaggaatcatggggacgttaggatcatggacaaagcagctgcgtacgtgaagaagaagaatctggaaattcctactaccttcaaaggggcaattatggagaaacgtgaactgcattcttgcaagactaagctcttatttgcatcagtggaatgtttctgcgacgatgctcaagcaagcctgttgcaaaggtgtatcctcctgttggacaagcgacgtgnagagctgatgcggatagcctggaagtgaggtgtgggaggggagcatgaaagacgcgcgtggaagaaatcttctttgttccctttccttctgacctggttctgtaataagtagtactcagtttcattctcatattctgttggagagaacttctgctctcgagattctaggcagcgtagtcgcctagaagtagttgttttatttctttgtttaggtgctgttggaactacttgtgctgcttcgatc

SEQ ID NO: 74747 - DNA, 334 bp, Triticum aestivum
  Clone ID: PAT_TA_74747
ggatccccgggccccgcttttaacctgggggtgatcagtgcgccagtgcccactgcacgtggagattgatggatcatgggatggatcgacatgagaggatgtcgagcgtggtcgcctactagctagtagcgagcaagaagagatcgatcgatcagcttgtttttcttgtggtttttattttgtgtttggctaggtctgtgtgttgtggtttgatgccagaggtgataatctatgtgtgctgatcatttattggtcacatgatacaatggtttaagcttgccacataagaaagggaaaccaaggtaaaccaaaaaaaaaaaaaaaaaccctcggg

SEQ ID NO: 74748 - DNA, 304 bp, Triticum aestivum
  Clone ID: PAT_TA_74748
cacacagttcgttttggcaactgccgccctcgtctggtgctgcgtacgcagctcctaagccacccccaggccccaacgtcaacccttggactggcaaagaccgctatgttgttcagagctacggcaaaaagctcgatcagaccattggatccttcacagcccagaacgacactctcaatgcggcgcgcactcgcacagtcgcccataagatctcgactttcacttgggtcaccacacgcgatggtctcagcctcattccccaagccatcaaggaagctcgtcagcaaaagaagggcccaaagaa

SEQ ID NO: 74749 - DNA, 739 bp, Triticum aestivum
  unsure (1)..(739): unsure at all n locations
  Clone ID: PAT_TA_74749
ggatccccgggctgccgaattcttacgaggctacagacagaagtgatcatggcccgcgctcaggtatgctcatggccgtcgccttggtgctnatgctcgcggcggtcccgcgcgctgccgtggccatcgactgcggccacgttgacagcttggtgagaccctgcctgagctacgttcagggcggcccagcccgtctgggcagtgctgcggcgggtccagagcctccataacaggcgcatccaaganttntcgcaagccgttgacttgcctcaagggggattcggctcgtggcattccacaaattcttcaaaccggaagngaacaaacggcccgcagccttcgccccccaagttgcgggttgttcaaccttcccaataccaacaattcaagttcttcggaacattcgaactggcaaacaagttgttgttaattgagcggaacgaattccggtcaagcttggttgcttcagcttcattccattccaccgttggaagtttaaagcggcgcagccttcttattcccttattgttagtangggcacttagttattgcgaagttttattaccttgaattattgaattaagaaactcttcttccttgcttggcttgctggtactcctctggaggagatcagtatctgttgttatctaagaagttgagaagtttgtacccatgggcactcccagtngtttatggacctttatacatacagctcgttcttgttcagttgtgtgactaa

SEQ ID NO: 74750 - DNA, 357 bp, Triticum aestivum
  Clone ID: PAT_TA_74750
ttgcacgaggtgcaaggacgcaaggaacaggaacgccgccgtcttgccggcgttccgtactaccagtcccaagtcaccaacttgagacgaccccaaacggcactgactgatagaagctggtggccacacaagcgcaaggcttatggattgcgcatcatacatatgtcattgtcagttgcacatgcaagtgcagttgctgctacagctcaccaaaacgggccgtacacacgtctttcaaaagagagaaaagttagagcatcccctataatggaagtttgaaatgtactattatctattatcccattttctggtaatttttaagagacgcttctactttggtacaagcccctaaaaaaa

SEQ ID NO: 74751 - DNA, 496 bp, Triticum aestivum
  Clone ID: PAT_TA_74751
tggcacgaggcgcgacagtgggtggagccgttgacggagttcgccgccaagatcggcggcgcgccgcagtacagggggttcaagtacaacgagtatatgcagcggttcatgaagagcaggacggatccgcaggccaggcccgaggacgccttcagcgtcagccactatgccatctgatctgacgtacgtgcacctgtacgtccgccactcggaagttaaatgtacgtgtacgtgtacgtgtacacatttcatttcatggtatgtaccgtgtacgtgtacgtgttaccctacatatatagcttactatatgctagcatatgtgtgttgggttcgtggtacgtgcatcgcaggtacggtttccttcttcgacgtcttagtcatgtggggctgtccgatctgaagtatgatggcgtgtccggggtgttgccccggtatgtttcattcaacggtgaggttttgcttttggcgagccacctcagaggtccgcaaagctgca

SEQ ID NO: 74752 - DNA, 381 bp, Triticum aestivum
  unsure (1)..(381): unsure at all n locations
  Clone ID: PAT_TA_74752
cggcacgagggtcgaagtaacaaagaacaacttccagcaccccaagacgggcaagtccaactcgacatcatcatcaacaacgcgggcgtcgccggaaacaactacttgagaatgttgactgcgaggactttgctaggcagttcaatatcaatgtacgggggccgttgttgctggtcaaggctgcgacgcagtatctgccgaatgatcgatctggtcgtatcgtcaacctcagctctgtgagttcgagcctgggatacaaaggccagtctatctactgtggcacaaaggccgcgctggagagcatgacgagaacgtgntcgcgcgagttggcggagcgctgcacggttaatgcgattaaccctggtcctgttgctacggata

SEQ ID NO: 74753 - DNA, 225 bp, Triticum aestivum
  Clone ID: PAT_TA_74753
ttagtaggaagtacccaaaaaaaatattaccaaaaaaaggagggacgagatggattggaacttggaaggtggtggtggtccgtcctctctgtggataggtgctgaagcatggatcgatggtgaagatggggttggaaggtggacttgattcctgtgattaccagtgttgatctctgtttatcgtcgtcctcggcagtgcagtgcagtgcatcatctggactagcc

SEQ ID NO: 74754 - DNA, 538 bp, Triticum aestivum
  Clone ID: PAT_TA_74754
aggctcacttgtaactctcctcaagagtactattctattcgaagcatccaacatgtctcaaggaaaatggacacccgagaactttggctggattgccgtcccaaggaatcgctccaacgtcccgtctgctgaggatgttaaagagatgaacaatgatttctactcagaccccatggacgcctggcccgtgaccgatgtgacggacaaggcgcgtgagtatgcacagcatttcctttcgaaggagactttcaatcacagcatgagggtattctgctacggtatctacatcatccaacactacttcccagaataccattccagtgcccttgttcgaaacctgggcactgacctgcctattccacgacatcggcacgaccgatgaaaacatgtcgaacacgcacatgtcattcgagttccaatgcggcctcctcgctttgaccaagttgcaggagttcggcgcgcacaaaatccaagcagagagcgttgccgaggccatcatccgccaccaggatcctggtgagacaggcacggtcagtgc

SEQ ID NO: 74755 - DNA, 692 bp, Triticum aestivum
  unsure (1)..(692): unsure at all n locations
  Clone ID: PAT_TA_74755
cacggggccccgttataactagtggatcccccggcctgcaggatttcggcacgagggtcagatggcaacggctacgccccagtgctggactgccacacctcgcacatgctgtcaagtttgctgagctggtgaccaagattgacaggcgatctggtaaggagatagaggccgcgcccaagttcctcaagaatggtgatgctggcactagtgaagatgattcccaccaagcccatgggttgtggagaccttgccacttatcctcctctttttcgttttgctgtccgtgacatgaggcagactgtggctgttggtgtcatcaagggcgtcgagaagaaggacccaaccggggccaaggtgaccaaggctgccatcaagaagaagtaattcgacattgatatccaaatcactgttcagacaccaagcagtttttagtattggctgagtttgttaagggcattgttcgtactggtatattttagctgttcagctgttagcgctgcatatcgtgcccttggtggtcgtctgtcttgtgccttttacatactgtgtcctaatgtaagcttcggtgaaacctggatgttatgagacctggtngtgtcttttaatactagcttgttgcatttatctgtgtaggtgctttatctagtgcatttgaaagacacaaatgcatcttaacacatttgttcttttaa

SEQ ID NO: 74756 - DNA, 330 bp, Triticum aestivum
  Clone ID: PAT_TA_74756
gtgaactcgaacggcgacacgagtgggggagcccggacgaccagtccctgaagccgcagggctatccagacggtcctggacgccaaggccgccgtcgacaaggacccgcagtgccgttacaaggtgtcctgcgccgacatactcgccctcgccgcacgagaattcgtcgtccagagcggagggccgtactaccaggtggagctgggcaggtacgacgggaaggtctcgacgaagattagcgtgatgctgccgcacgtcgacttcaacctcgacaaactcaacggcttcttctcaggcttgggcctctcccagaccgacatgatcgcactc

SEQ ID NO: 74757 - DNA, 474 bp, Triticum aestivum
  Clone ID: PAT_TA_74757
atagtggatccccgggctgccgaattctttcacgagggctcgctcatgattgtaacgcttggcatgttgtcggacccggtgacacatgttggactatctctcagctctatgacttggcacttgatcagttctaccagtggaatccggctattcaagatgaatgcgcgactggtttttggttggactatgcctattgcgtaggaatttcagcttgagcttatcagctcccagtgggtgccttttgcggaatgtcaagaattccaagtatgcacgcaactcgacttcagtgacttgtgggcccttttggggatatagccaattagtgaccggggggcgttattattccggaaaccaaattctgaatagaaattattaccattattggcccattgttgaaaggccttgttccaagttagggcccggcaattggagaattctgcggaccaaaaccaaaaaaaaaaaaaaaaaaaaaaa

SEQ ID NO: 74758 - DNA, 651 bp, Triticum aestivum
  Clone ID: PAT_TA_74758
atagtggatccccgggctgcccgcgcgctttgtaaatctgagataacaacttcccctcaccaccaccaaagcaaactacacaacaccgccaacatgggtaaggagaagatgcacattaacgtggtcgttatcggccacgtcgactccggaaagtccaccaccaccggccacttgatctacaagtgcggtggtatctgacaagcgtactatcgagaagttcgagaaggaagccgccgaactcggtaagggttccttcatttacgcatgggtcctcgacaaattgaaggccgagcgtgagcgtggtatcaccatcgatatcgctctctggaagttcgagactcccaaaatactacgttaaactggttaattcgacgccccccggtcacccggtgattttcattcaagaacattgattcaccttgggttaccctccccaggccggattgcgctatttctcatcattgccgcggtactgggtgagttcgaggctggtatctccaaggatggccagaactcgtgagcacgccctcctcggcctacaccctcggtgtcaagcagctcatcgttgccatcaacaagatggacaccaccaagtggtccgaggagcgctaccaggagatcatccagagacctccaattcatcaagaagtc

SEQ ID NO: 74759 - DNA, 205 bp, Triticum aestivum
  Clone ID: PAT_TA_74759
gcacgaggatcagaagtacagatagagagaagaagcgtattagcaaaggcttctcttgcttacaactgtaagagcaaaaatatgcccgcacttcaggaaactgtttcctgagtatgttgagaagtataaccaacaacaagaaaaggagcaaactggcgcggaaccagaaccccaggagaaccataccccagctccttctcatgcc

SEQ ID NO: 74760 - DNA, 718 bp, Triticum aestivum
  unsure (1)..(718): unsure at all n locations
  Clone ID: PAT_TA_74760
ctttcacgaggcaaggacagtctggtcccgagaccctcctcaagaagcgcaagtcgcaggagaaggcccgcgccgagaaggccaccgagattgagaacaagaagaaggccaacaaggagaagcgctccgtcattttcaagcgtgctgagaagtacgttaaggagtatcgctgatgcggagcgtgagcaaatccgcctgcaccgcgtcgccaagcaggagggccacttccactttcctgccgaggagaagctcatcttcgttgtgcgcatcaagggtatcaacaagattgcccccaagccccgcaagatcctccagcttctccgtctgatccagatcaacaacggtgtcttcgtccgtgtcaccaaggccaccatggagatatcaagatcgtcgagccgtgggttgcctatgttaccccaacctgaagaccatcaaggagctcgtctacagcgcggatacggcaagatcaacaagcagcgcgttgccatcacagacatgccatcgttaggacaaccttggcaagtacggcattgtctgcgttgaagatctcatccattagatctacaccgtcggcccaacttcagcagggctccaaacttcctgtggccttcaagctcaggaacccccacttgtggtttcgcccccgaaggtttaagcncttcattagggttgtgacctgggcaccgggagacagataaaactcatcggcgataaacag

SEQ ID NO: 74761 - DNA, 483 bp, Triticum aestivum
  unsure (1)..(483): unsure at all n locations
  Clone ID: PAT_TA_74761
cggcacgaggcttcagtccaatttcaccaatttcaaccgcgactcccaacgtcctcaacaccaatcttcaaaatgaagttctccaacattgctggtatcatcgccgtcttcgctgcggcccttgttgctgctgctcccgtccccgacgataacgccgctgtcaatgcagttctgggctacaagcgctccgctnatggagaagacctcgggtacaagcgagacatcgccgtcgaggttgctccagttcagaaggacaagcgccactgtgctgcacctctcaagaagaactaagcggccagcaagacacctcctcagagtttggaacgatngatcatctcaggaggagcccagttcagatcaaggtggcaggagcctagagggcctagtctgggacagtcaggtngatttgcgggactttttcgagaaacggttgcatggcaaaaggtttctgataatggattttgattcctctcataatctagt

SEQ ID NO: 74762 - DNA, 452 bp, Triticum aestivum
  unsure (1)..(452): unsure at all n locations
  Clone ID: PAT_TA_74762
gatccccgggctcccgccctttatcaggtaatgctcagccgtcgcttggtgctgatgctcgcggcggtcccgcgcgctgccgtggccattnactgcggccacgttgacagcttggtgagaccctgcctgagctacgttcagggcggccccagcccgtctgggcagtgctgcggcggcgtccatatcctccataaccaggcgcaatccaagagcgatcgccaagccgttgcaactgcctcaaggtttntcgctcgtggatccacaatctcaagaggacaaacggccccgcagcttcgccccccaagttgcgggtgttaaccttccccattaccaacaattcaagttcttcgaaaattcgaaactnggcaacagttgttgttaattgaagccggaaggaattccggtcaagcttggttgcttcaagttcattccattccaacggttgaagttaa

SEQ ID NO: 74763 - DNA, 306 bp, Triticum aestivum
  Clone ID: PAT_TA_74763
ctgaattttgccaaaatggggcttaacgggagcatctcaccatctatcgggaagattgccacacttcagatgctatttctttcagacaacaaacatttactggcacggtgccgaaggagctcgctgagttgccagcactgagaaaggtcgatctgtcaaataacaatctatatgggaagcttcctgaatttcgcaagacatgtggaggtgatacttgatggcaacccaaactttggcaagcctgctcctccgccctggaacccaggtggtagcagcaatgacactataagccctggggggaattgg

SEQ ID NO: 74764 - DNA, 158 bp, Triticum aestivum
  Clone ID: PAT_TA_74764
ggctatatcgaaaaacgaatcttaaaaaagctcgaagtttaacagcacatacgcacacgcaggcctgatcacgatgcagttctccgacatcctcgccgctgccttatgccagcactgcccttgctcagagcggccccatgatggtccacgtcgtctct

SEQ ID NO: 74765 - DNA, 461 bp, Triticum aestivum
  Clone ID: PAT_TA_74765
cgccgccagagccgtcgccgatccatccgaacgttgcttggccctaggggcatggacaagatatcaggagcggaaggggagagaccatcatcaccaacgacggagacaccatgctcaagggcatgtcggtcatgcatcccatagccaagatgcttgtcaacctttccgcagctcaggatgtcaaagctggcgacggctttttcatcggtcgtcgtcatctgcggtgctctccttggcgccgccgaacgtctgttgggcaagggtatccatccctccgttctttccgaatctttccagcgcgctgccgccgcagccgttcaagtactacacgacatgtcccagcctgtatctctcaccgatactgccgtcctcctccaggccgacaacacttcgctatcgtccaagattgtgtctcagtactctggtctcctcggacaaatggccgtcaactcggtcaccaa

SEQ ID NO: 74766 - DNA, 519 bp, Triticum aestivum
  unsure (1)..(519): unsure at all n locations
  Clone ID: PAT_TA_74766
tggcacgagggcgaccccgccgacgcggcgagcgggagcagcggccaccaccatgaccatgagagcagcagcacgacggggcggcaagaaagcttgcaatgaagcctgaggacaatgagatgacaactaactcagctatttcatctgattgtgcgcggcctcgcttcgaactccatcaaattccacggctgcaacatgaagtcctacccggaggcctagcgtggtgggcggaggcctagcgtgggtcactggctcccaggcccaggccggcaagtttcaggaccgcgccgaccggctcgaccgcaaggatgaggactgcagccggctgctctccgcgctcctcaccggcacgagcgccgacggtggcgccgacnacaaggaggaaaaagacgaaactggcccgccggaggtggcgacggtggccccttgatgaggcggcactcacggcaatggtcggatcgtgtaagggctagtcatgccgtccgcagtggcattcactggccattattggcggggaag

SEQ ID NO: 74767 - DNA, 575 bp, Triticum aestivum
  Clone ID: PAT_TA_74767
cttgcacgaggcttcaagaaggtcatcgaggggttgagggaggttgagtataagtggttgtcagcattcttgcttatgagggcatacaacagtatcgtgttctggtcatcacctgttttagtttcagcggcaacctttctaacatgctatcttttgaaaatccctcttgacgctagcaacgtcttcaccactgtagcaactctgcgtcttgtgcaggagccagttagatcttttaccaattgttatcgcagttgcaatacaagctaaggttgctttcactcggatatcaaagttccttgatgcacgtgagctgaatgggcaagttaggaagaaataccgtgtgggcaccgattatccaatagcgatgaactcatgcagtttctcctgggatgagaatccatcaaaaccaactctaaacaatataaatctggtggtcaaagctggagaaaagattgcaatttgtggagaggtaggatcaggaaaatcaacacttttggctgctgtactcggagaggtccccaaaactgaaggcacgattcaagtctgtggaagaatagcatatgtttctcagactg

SEQ ID NO: 74768 - DNA, 685 bp, Triticum aestivum
  unsure (1)..(685): unsure at all n locations
  Clone ID: PAT_TA_74768
ctgcacgaggctttcgactgccattttattttgaattgaagtacgggtgctcttgattcagatgtttgggaagaaaggcagaacctttctctcgtaggccgtcatagatggatcggcgagatttgtccggctcagtgttagtgataataaacaagtcattaggcgatcacattcgttggataatgaattagatgtggggttataggacctgtacaggttgttactaattactagtactgatgagtgacaacatatggtcgctagatcagatgaacccagcaccatgaagagatcagattgccacttacaccgattgccatcagttctgtcagcgaagcagcagtttgattgctaggactatgctctctctctctctctctctccggaacaagcgggcgcgctcgggatcggggttaccatacaatttttcccaggaacctttagtgaatgtgctaatggagtcaaagggtggcaaaaagtctagcagtagtagttaccctgtatgtacgaagctcccctcggctacagcattgaagacgttcgacctgcttgaggcgccagaagttctctgatgcatactcgaactgcgcgaagaagccatctggatatcgtttttggcatcccttccgtattaggattttatngcaatttattcttgaattctttcccacaaatctctcttggt

SEQ ID NO: 74769 - DNA, 521 bp, Triticum aestivum
  unsure (1)..(521): unsure at all n locations
  Clone ID: PAT_TA_74769
ggtacgaggctacctacaatttcaagctctctacacatccttcaatcacctcaaactacccaagccaactcaactgtcagcatggcccttcatcgtggcgtacaaggcggctgcaccgtccaacgcattgccaaaggcggcaccaaaggcggctgcaccatccaacgcaatgccaaaggcggcgtcaacggctgcaccgtccaacttggcggcgtcagtggcggctgtaccgtccaatatatcactctcctctcttcctccctctctcgacagagactcgacagagagacactgcctgtagttgcatcacacccaacgactacagatngatgccgtctcagctcatcaccgctttcacttcgatcatccctttttacacgataacaaggggatttgtccaagtacttacgccaattgacaagtacgcggatacaagtcgcctcaaagccttgctataatgccgataaaaaaacatgcgagaatcttccgacatggccgatcgaccacaacaacatatgcgg

SEQ ID NO: 74770 - DNA, 567 bp, Triticum aestivum
  unsure (1)..(567): unsure at all n locations
  Clone ID: PAT_TA_74770
tggcacgaggactacgcatatatcaactacatcagctcttcgttgatatatacgtcttgtagtcgcatcgtacatcaagagctcaacttcaattcccctctcttaccttaccacatcaatcaacaacatgttgaccaaccgtcgctcgaccatgatggtccctcccaaccgcatgcccagctggcatccccactcaaaaggcaccatgcctcagcagccatcatcaactcctcttgcgatcgataccgaagcacctcaaagtcgcacacccgcagtcttgacatcaacgacacccgacctgcccggccaccgcgtcattcgcgtcctcggtgccgtccacggaactacaagcgcgacgcgcaaagacccgaaatcctttattaagaacatcgcaggcagtttcaacagcagttggggagaggccaagagcgtgacgagtatcgtataccaggcgcgtgatcaagccatcgacaggcttgtgaaagaggccataagcnagggtgcgaatgccattgttggattagacattcgggaaagcgaaatcatgggctgtgtggtggtgagcgt

SEQ ID NO: 74771 - DNA, 537 bp, Triticum aestivum
  Clone ID: PAT_TA_74771
gcgtctttgcccgaatactcgatctctatctcccaagcgatgcaaccgaggtaaaggaatatgctcacaaaatggcccgactggccctgaatccttcagtcctcgcccacgccacggacgctgagacgaaccatccagtgctccggcccttgactaccttcggcgaagaaaacaggaacgacccactctggacaaccaacggatggcagagactgaaatttatcgggtaccaacagggcgttgtggccgtcgcgtacgactattcgcacactagcatcaaccgtcgaatatacgctttcgcgttgaaccatctctggagctgcacgggaaccatgaccggctgcccgatgagcatgaccgacggagctgctgctttgatgcacaaacactccaacgacccagacggcaaccagcctggccgcaagcgagtgtttgacgaatcgtttcgcagactcacgagccgagatccggcgttcgcctggacaagcgggcagtggatgaccgagaggacaggcgggagcgatgtctccgggaccg

SEQ ID NO: 74772 - DNA, 438 bp, Triticum aestivum
  Clone ID: PAT_TA_74772
tggcacgaggaattcgtcgcccgccaacgagatacctcatatcctatcccctcgatttgagaatctctgcacaataccgccaggatggtccgcacttccgttctccacgatgccctgaactccatcaacaacgccgagaaggccggcaagcgtcaggtcctcatccggccttcgtccaaggtcatcatcaagttcttgaccgtcatgcagcgccacggctacattggcgagttcgaggaggtcgatgaccaccgctccggcaagatcgtcgtccagcttaacggccgcctcaacaagactggtgtcatttccccccgctacaacgtccgcctcgccgacctcgagaagtgggttgtcaagttgctccctgccccgtcagttcggctacgtcatcctgaccaacctctgctggtatcatggaccacgaggaggctcgcc

SEQ ID NO: 74773 - DNA, 501 bp, Triticum aestivum
  unsure (1)..(501): unsure at all n locations
  Clone ID: PAT_TA_74773
gaggccgtttctgggatgtgttgattgatctgctaagcacggtagctgcggtagctgggatgtgcgtcagtttgatctgctgatctgtaattgattggttgttggcattcgagttgttcatgtgaggctggcttgcttagttgtacgtagtagtctgatgtattcagtcaattctaacggatgtattctgttcccgggcctttaatcccaagactatttctcttcactggtatcgttaagtgagtatgtggtttactctgtagttcctattttggatttacagtgatttacggtgcaatccccattgttttttagagtgattttcagtgtaatttatacttnattttcattgtaatccgtagtggatttccagtgtaattttctagtgcatagatngaatatttgtagtgtaaatctnaagcaatttgtagtgtaatccccggttattttacaatgtaatttcagtgtattttgtcagtggatctgcactgtatttgctag

SEQ ID NO: 74774 - DNA, 348 bp, Triticum aestivum
  Clone ID: PAT_TA_74774
gccgccggtcccaacgcttaccaaagtagcagcggcgtggtgggggcagtggggctgcaggtcgcgcttagcggcagagagaaggcggcgacggcggccgaggcgaggaagaggaggaaggagctcaccaagctgaagcaaatgcacggcggaagccgccatggcgcttgcgagcactggtgagtgagctgctaatcatggcaggttactaggtgatcgaggacgcatgcatgcatggcactactgccgctgagtcactgacaaggcatcggtgatcaactgatgatgacgataggttccttggacgcaagcaatagcactgatattagtacagctcctaccaacttt

SEQ ID NO: 74775 - DNA, 338 bp, Triticum aestivum
  Clone ID: PAT_TA_74775
gagggttttttttgcagctccagccctacctgcggtctccacctccacactctctaatcgctatacattactatacaaacataatccttaatcatgtcgttcagtatccgcaacaccatcgccctgggcgccttctccgccctcgctgctgcgcaaatcgtgcccccgaagctcgacgcaacttgtgccgatatggtcatattcatggctcgtggcaattacgccccataccatgacggtcgcactttccccttcgtcgaggccacctgcggcaagttgactgctcagggcaagagctgcgactacattgacatccagtttgatgtaacccttggtgg

SEQ ID NO: 74776 - DNA, 349 bp, Triticum aestivum
  Clone ID: PAT_TA_74776
ttaattgatctttatttgctgacatcattcatttattcaattctaattattaacaaagttcaatgtatattgtacaccattcatattattgtggttgcaaacattgtctaattaccatgtgtactggttggattttgggcttttattaatgttggaccaggctgggtgctttagatgttgtctttttaaactggtaggatgctctgtgcatgtcatatgcgggttatagcggtacaatcatgaatacctattacaatctggcaaatggacagaaaacaaaagaacagctgaacatatgagaggttaaatggaggttgttatgaaggtgaatgctagtcagccattgctt

SEQ ID NO: 74777 - DNA, 100 bp, Triticum aestivum
  Clone ID: PAT_TA_74777
aagggacgcacgagggcagggcctgagcgacctcttcaagtggaagaaccgcgtcattgtcgaaaacgaatacggcgaggagcgccaggagctccgcaac

SEQ ID NO: 74778 - DNA, 437 bp, Triticum aestivum
  unsure (1)..(437): unsure at all n locations
  Clone ID: PAT_TA_74778
tttatccaccacatgctgtcacttatgtctactatgtacgctatgctttctggggaagcgcatgtatacatatacatgggtctcatcactgagactacaacgccaggaatcaatctaagatggtaacttgtatatatgaacaagttcacaattgttgtttatatattgccatacttcaatctgcctaaactgatattatgtcccttggtctcatcaaggttccttgatgttgctggaatgaagaactccaaagcttaccttgttnacggagttgcaatggttattacttggctggttgcaaggataattctgttcatgtacttgttctatcacatgtttgtacattatgatcagattaagaagataaacaccttcggctattttctggtacttactgcgccttgcataatcttcgtgatgaatgtgctttggttctc

SEQ ID NO: 74779 - DNA, 253 bp, Triticum aestivum
  Clone ID: PAT_TA_74779
cctccattcccggtgttggccattgtcgcaactctcctttttcagaccaccacagacttcaccccagtcaaatccttcaagatagccgacgacgcccaacaagaaccacaccttcgactctgtcgatgctagtgcctcgctcatctaccccatgcaatgctcggctctgcgcaagaacggtttcgtcctcatcaagggccgcccctgcaagatcgttgacatgtcgacttccaagaccggcaagcacggtcac

SEQ ID NO: 74780 - DNA, 470 bp, Triticum aestivum
  Clone ID: PAT_TA_74780
cctgtggtcgattaaagagttgtacacttcttctaagaactactatatttttttctgtatattagggtctgtttggattggttcctatacttgcccaaccaaataattggtgttgaccgagcgatgggcgtttgtttcgattggcgcagataaattggctcgcccaccgctcgtcagccctctgcgttcagttttccgccaaatcattggcaaggcgggggcggccgaaacgtccaccaattttttggcatcggcagaatccaaacaacctcttattcttttcattcaattaagagtatgaactcatgttccaagaattgaatgtgatagttcatgttcagcggatttcgctaggagatacacacggtgctcacgagcgccttgagcaacatggatccgatgtttctgatgaatcatttcacgattagttagaggctgcagtgaaacattactatatgtgactagtattt

SEQ ID NO: 74781 - DNA, 392 bp, Triticum aestivum
  Clone ID: PAT_TA_74781
tccccgtccagaagcgcctcttccatgtcatcaccgccttcatcacctccattgccttcatttcgtactttgccatggccaccggcgacggcctgagctggcactccagcgtcgtcaacaccacaaagtccggtgttgtcgaggacattgtgaagcgccaggtcttctacgcccgctacgtcgactgggctctcaccacacctcctcctggcttttggaccttgctctgattgctggtctcaacggctctgatatcatcattaccgtcttcgctgacctcgtcatggtcctgactggtctctttgccgccttcggctccacccctacccaggtttggggttggtacaccattgcctgcgttgccttcctcgtcattgtctggcaaattggct

SEQ ID NO: 74782 - DNA, 412 bp, Triticum aestivum
  unsure (1)..(412): unsure at all n locations
  Clone ID: PAT_TA_74782
tgccctccagagaatctctcatgtagacatctctacagaaaaaagctcgaatgcaatgggtgagctgggaaaattgcgtcagttaaccagactttgtgtagtccacaggaaggaagccaagctttggaaacccttttgctaagtctttggatgagcttagcaactctcttcgctatctaatggttgtggacgcttcagagaaagtcgaggagctgaaatttttagcatacctaaagaatccccctctgtctctgcagagcctgcatttggtgggacggctaactaggctgcctggctnggtttcatcgctcagtaacttggccagtctgtcgcttcgacagacttaccaattggccaaggattcttttgaggttctagcgaagctccccagtcttgtttctctcaagttgta

SEQ ID NO: 74783 - DNA, 478 bp, Triticum aestivum
  Clone ID: PAT_TA_74783
acgatctgcaagaaattgtcaatcgtaggaagcatgaagccctcacagtgcaaacatttggcactcgcatagaaaagctccaccgggagaaatacctgcagctttgtgactcagttgatatggacgaggttgactcgtcgagtaccataatggacgaagaagatgatgttgttcgtagcttacgagcaagtcctgttcatccagtcgaggatcgtacttcaatcgatgactttgaaatcataaaacctatcagccgcggagcatttggacgtgttttcttggccgagaagagaactacaggagacctctttgctataaaggtacttaggaaggcagatattattcggaaaaatgccgtcgaatgtatattggctgaacgcgatatattgatcacggtcaggaatccttttgtggttcgtttcttctattcgtttacctctcgggaaaatgtgtatcttgtcgtggagtacttaaatgg

SEQ ID NO: 74784 - DNA, 104 bp, Triticum aestivum
  Clone ID: PAT_TA_74784
ctaagggaccgagggtggattcaccaaaggtttggaagtggaagcggctaatttctcgaaattggctcaaacaccggttgccaagtcgttgatgagtattttct

SEQ ID NO: 74785 - DNA, 467 bp, Triticum aestivum
  Clone ID: PAT_TA_74785
tggaaaaaaaatgagaaataggagaggaacagagagtgcagagagatagagagactacacatcactgaaccctttggattctaatactaggttgagtaattttgtgtgttcttactgtttgggataatatgcagttttttggcttatcattgtgcctcaagtttcagtcatcgcttggctgtacagcgacgattttcgccgataatccgtctactcatactcgaccgttcgccggaactttgtctgacctgaggtatatactactttttatcacttttgcttcttctcaccggatgcatgcatgcttctccacacaggtttcccttagttcagtacttattttttttggtgtatactttctcctcatcaatcatgtatacgtacaacaaaacagaaagaaacatatgttgttgatcgattctgaactatcatatggaagataaccctctcttctatacccctttgtg

SEQ ID NO: 74786 - DNA, 345 bp, Triticum aestivum
  Clone ID: PAT_TA_74786
gcacgagggagcattgctatgtgctagagagttgtgctgcgacgggcagctagcggtgctggaaccggtgtctatcggtgctggaaacggtgcatatgaaagctggaactagcatctttttttgctactactatcttggttttgctggcctactgaattttgctaccaccgtcttcaatttttgctggaaccagcaatctttttgttaccactatctttgtgtttttgctggaactagacccaatcttgcttccatcgccttcgatttttgctggaaccagtaatacttttttgctaccactatcttttgtttctactgcaaccagccccgattttgcttccacc

SEQ ID NO: 74787 - DNA, 464 bp, Triticum aestivum
  unsure (1)..(464): unsure at all n locations
  Clone ID: PAT_TA_74787
gcacgaggcccgagctacctcaccggtgagttccccggcgactancgatgggacaccgcggggctctcggccgaccccgagaacttcggccagaaccggggagctggaggtgatccactgccggtgggccatgctgggcgcgctcggctgcgtcttcccggagctgctcgcccgcaacggcgtcnagttcggcgaggccgtgtggttcaaggccggctcccagatcttcagcgagggctgcctcgactacctcggcaaccccagcctcgtccatgcgcagagcatcctcgccatctnggcctgccaggtcgtgctcatgggcgccgtcgagggctaccgcgtcgcctgcggcccgctcggcgagatcgtcgacccgctctaccccggcggcagcttcgacccccttggcctcgcttacgaccccgaggcgttcgcggagctcaaggtgaaggagatcaagaacg

SEQ ID NO: 74788 - DNA, 402 bp, Triticum aestivum
  Clone ID: PAT_TA_74788
aggccgagctacctcaccggtagtccccggcactacgatgggacaccgcgggctctcggccgaccccgagaccttcgcctagaaccgggagctggaggtgatccactgccggttggccatgctgggcgcgctcggctgcgtcttcccggagctgctcgcccgcaacggcgtccagttcggcgaggccgtgtggttcaaggccggctcccagatcttcagcgagggcggcctcgactacctcggcaacccctgcctcgtccatgcgcagagcatcctcgccatctgggcctgccaggtcgtgctcattggcgccgtcaagggctaccgcgtcgcctgcggcccgctcggcgagatcgtcgacccgctctaccccggcggcagcttcgacccccttggcctcgc

SEQ ID NO: 74789 - DNA, 453 bp, Triticum aestivum
  unsure (1)..(453): unsure at all n locations
  Clone ID: PAT_TA_74789
cgcgtacctaggcctgcagatccctgcgaccgcgagaacttctacccgttcccgcccttcatgtccggccttgtggtacgcgctgtcgtgggacctgggtgcgctnggtggcgcggtcggaggtcagccgccgcgaccgcgtcgggccggaggacatgtggacggggcggtggctcaacgtcgcctgcgaggccaagaaccggtacgacggcgcccccaggatgtacaactaccttgggagctccccggccaactgcttccggcgcggcttccgcccggacaccatcgccgtgcacatgctcgaggacgcctgccggtnggcggagacgctcgcctacttcaacgccaccgccgcgctgccgccgtccggcctctaacacctgccttgaaacggtcctcgttttgcttcttggctcgacccggtcggcagtgtgcgttgaatttgtgcgggtt

SEQ ID NO: 74790 - DNA, 527 bp, Triticum aestivum
  Clone ID: PAT_TA_74790
gcacgaggagacgctggaggggatggacggcgtcaccggcgtcgacgtcgtccccagggagaacagggtgaccgtcaccggctacgtcgacgccgccaaggtgatgcgccgctgtctgcgcgcaagacctggcaagcgcgtcgagccgtggccctacgtgccctacgacgtcgtcgcgcacccctacgctgcccggcgcctacgacaagagggcgcccgccgggtacgtccgcgacgtcatggccaaccccggcggcgcgaacgcgtccttcgcgcgcgccacctccaccgagactaggtacaccggggccttctccgacgagaaccccaacgcggcgtgcgcgatcatgtagctcctcactaggtcgatcgatctcctcccgttccatttggtaactcctagtaatacctaggtagtaactgctacgtatgtatgtatatacgggttacactttttcctcggaggagctgcatggctgctccgggttggttcaggcggcaggctggccgtcctgccgtcgttcccc

SEQ ID NO: 74791 - DNA, 475 bp, Triticum aestivum
  Clone ID: PAT_TA_74791
ctcaggacaaatagagtatgcatgttaaccataccaagagcactaaataaactaccaagagttatccaggtgctagattttggtgatggcaaattggatgaggttaactgtgttgaccttatcaacctgcggcacataaattccggctcatcggagttccaatttcgtaacataagcaggctgacctcactccaaacgatagcatgtgccttcggaataagggatgcaccaagatatgaggtaaagcagctgagggacctaaacgagcttcgcggcagcctggagataaatggtcttgaaattgttaaaagcaaggaggaagctcttgaatccaaactagctgccaaggaacggctcagcgaactgaaactgcagtttgggcacagttcgccagaagtccaagcagaggtacttgagggcctgtgccctcccgtggggctccaaacactggaattgcgttcctacgatggctcga

SEQ ID NO: 74792 - DNA, 404 bp, Triticum aestivum
  Clone ID: PAT_TA_74792
ctgcacgagggttgaagcttgctgctgtggtcatgcaactatttccagtcccaatgctgtgccgtggatgttcatgcacacaataaccaggtagcagcattttccaaagaaggggttctccgggccttgttagtgaatcagaggacatagtcatccaagaaagtttcttgaactggtcagaaaacagtatagcatctaaaagaaccccaagaaaccacggcgagcagagccgagttgactcctgaaacaaccgcttcctgccatagagcgccagacacatctgtgaggtaaactgggcatttgaagcacaagaaaagatgtggacgggataggattgtagtgcatcaagaccctcgagccctcgctgacgggaagttctttcattggcacaaaggggtaccata

SEQ ID NO: 74793 - DNA, 488 bp, Triticum aestivum
  unsure (1)..(488): unsure at all n locations
  Clone ID: PAT_TA_74793
gcacgaggacgacgtgtccgcgcacatcaacgagctctacccgaaggccgaaaaggaacgtgcgaatgagcccatcttccaggcgcagctnacgaggtacgcgtgccgcgggtctggtgatcggcaccgcctgccatcaccaggtcgccgacggtcagtccatgagcgtcttctacaccgcttgggccagcgccgtccgcaccgactcggcagtcctcacgtcgccgttcgtcgatcgctcggccaccgttgtcccacgaagcccaccgacgccggcgtatgatcaccggaatatagagttcaagggcgagctcagctggagccactcctatngtgtcctcctcatggacaggatcaagaacctggctgtgcacttcccggatgagttcatcgccaacctcaaggcccgagtgggcacgcgctgtagcacgtttcagtgcctccttgcgcacgcgtggaagaagatcacggcggcgcgggatctggcg

SEQ ID NO: 74794 - DNA, 408 bp, Triticum aestivum
  Clone ID: PAT_TA_74794
ctgcaatcctcagtggtgaggggaacgagaaggtgcaggaccttctcctccttgatgtcaccccactgtctcttggtcttgagactgctggaggagtcatgactgtgctcatcacccggaacaccaccatccccaccaagaaggagcaggtcttctccacctactccgacgaccagcctggtgtgctcatccaggtttttgagggtgagaggacaaggaccaggtacaacaacctgcttggcaagtttgagctccggcatcccgcctgcacccaggtgtgttccccagatcactgtctgcttcgacattgatgccaacggtatcctgaatgtctctgccgaggacaagaccactggccagaagaacaagatcactatcaccaacgacgagggcaggctgagcaaggac

SEQ ID NO: 74795 - DNA, 429 bp, Triticum aestivum
  unsure (1)..(429): unsure at all n locations
  Clone ID: PAT_TA_74795
caccgccaggaagaagatccagaaggacaagggcgtcgagccctccgagttcgaggacaccgttgcgcaggctttctttgacctggagaatggcaaccaggaacctcagaagcgacctcaaggacctgtacatcaacactgcaatccagatggatgttgttggcaacagnggaaggccgtggtgatccatgtgccgtaccgtctgcgcaagcccttcaggaagatccatgtcaggctcgtcagggagctggagaagaagtttagcggcaaggatgttgtctttgttgcaacaagaaggattgtgaggccacccgagaagggttctgctgttcagcgccctcgcaccaggaccctaacagctgttcatgatggtatcttggaggatgtcgtgtacccagctaagattgtggggaagcgtgtcagataccg

SEQ ID NO: 74796 - DNA, 350 bp, Triticum aestivum
  unsure (1)..(350): unsure at all n locations
  Clone ID: PAT_TA_74796
gcacgagggtggcccccaaacaatggcaattatctgttagctgaatttgttgatccccaggaagtgaaacgcaagcttgaacccccttccccctcccccagcagcaacagcagtggcggttcctattagcccagccactacaccaagggaggctcctttgcagcaaggtcaggcaaatcaaagtgtgcctcgccgagctgctgctacaccaagggagcaattgccgcctccaccaccccttgtgaagcctcctacatctnatccaagggagaagctcacacccaccccaaagaacgcagaacctcctgtggtgacacttgatgatctcttcagaaagacacaatcctctc

SEQ ID NO: 74797 - DNA, 418 bp, Triticum aestivum
  Clone ID: PAT_TA_74797
cgactagagtttcctcgctagggtttcgtctcccgtgtccggatccagcagcagcagcgggcgattgcggccgggggaaaaccccggcaagaagaagatgatcacactcaagagctcggacggcgaggagttcgaggtggaggaggcgggtggccatggagtcgcagacgatccgccacatgatcgaggacgactgcgccgacgacggcatcccgctccccaacgtcgactccgagatcctctccgatgtcatcgagtactgcaacaagcacgtccaggccaagcccgcctatagggctgccgccagagccggagccggagcctcggacgccgcccccgtcgcccccgccgaggacctcaagaactgggacgccaagttcgtcgaggtcgaccaggccaccctcttcgacctcatcct

SEQ ID NO: 74798 - DNA, 408 bp, Triticum aestivum
  unsure (1)..(408): unsure at all n locations
  Clone ID: PAT_TA_74798
aacgcacgaggcaagaacatgatcaccggtacctcccaggctgactgtgctgttctcatcatcgactccaccactggtggttttgaggctggtatctcccaggattgcccaaacccttaagcacgccctccttgctttcactcttggagtgaagcagatgatctgctgctgcaacaagagatggacgccaccactcccaagtactcagaggcgcgttatgaagaaattgtcaaggaggtctcttcctacctnaagaaggtcggctacgaccctgacgaggttcccttcgtccccatctctaggtttgagggtgacaacatgattgagaggtccaccaaccttgactggtacaagggcccaacccttcttgaggcgcttgaccagatcgacgagcccaagaggccctca

SEQ ID NO: 74799 - DNA, 459 bp, Triticum aestivum
  unsure (1)..(459): unsure at all n locations
  Clone ID: PAT_TA_74799
caccagttcatctcactgagctcgcaggcagccccagccaccagcgaaatggccgcgtcggcgctcaccagacgaccagcttcctcggcaccgccccgcggcgccaataacctcgtccgcagcgtcggcgacttcggcggccgcatcaccatgcgccggaccgtcaagagcgcgccccnagagcatctggtacggccctgaccgtcccaagtacctgggcccgttctccgagcagaccccgtcgtacctgaccggcgagttccccggcgactacagctgggacaccgccgggctgtctgccgaccccgagacgttcgccaaaaaccgggagctggaggtgatccactcgcggtgggcgatgctcggcgccctggggtgcgtgttcccggagattctgtccaagaacggcatcaagttcggcgaggccgtgtggttcaaggccggcgcccagatcttctc

SEQ ID NO: 74800 - DNA, 503 bp, Triticum aestivum
  Clone ID: PAT_TA_74800
cttcacatcgcggcgctgcagccggtggaggtcgacccggaggcggtgcgcccgccgaagcgccgcaacgtgcggacctccaagggacccgcagagcgtggcggcgaggctgcggcgggagcgcatcagcgagcgcatccgcgtcctgcagcgcctcgtccccggcggcaccaagatggacaccgcctccatgctcgacgaggccatccactacgtcaagttcctcaagtcccaggtgcagtcgctcgagctcgccgccgccgccaccggcgcggccgcccaccgcgccgctgccttcgcctaccccgccatgcagcacgcgccgtggtagcccgtcctcatcagcacggctcgtcgacgcttcagctaccatgatagcagtgattcaataatccttccttccgtttctgtcgccggcccgcgccgcgcgcaccagctcgtcgtcctcgatccgcttttggagttcctcggatgatttctgtagctctgtgcggctgtgtgca

SEQ ID NO: 74801 - DNA, 263 bp, Triticum aestivum
  Clone ID: PAT_TA_74801
gtggatcccccgggctgcaggcggcgttggcctccacggccacgggagcagctccctggcctcgctgctgctcgggagcggcgcctcggtgcgtgcgaccacctcggcctcttccacgccatgcagtcggtcgtctcggacgccaccgcctacgagatgcaccagcagcaccagacccaggtggatcagctagctaggggctacggctacggcgccggcgacgccaacggctcgcagataccacatcaagccctggcagcagc

SEQ ID NO: 74802 - DNA, 109 bp, Triticum aestivum
  Clone ID: PAT_TA_74802
tgagctcaccagctcgaagctcgccacctgcagcaaaacgcgcgaccagtggaagctgtgcacggtgacgcagtgttgagcaagtgaagagcatcctgcggatcctccc

SEQ ID NO: 74803 - DNA, 271 bp, Triticum aestivum
  Clone ID: PAT_TA_74803
gggccctcctccgagctaggaggaggaagggccccagagaccgaactcgcatcgtgaggtccgtgcttcctcgatggaccagatgcacggcggtggcgccggcaggcgggtgaaggtggtggggaaggtagagaggctcgacgggcagtcgctgacctactccagagttcgtcgaccgcttcatgaagccgaacctccccgtcgtcctcacgggcctcacctcctcctggccatcctgcgaggactggacgttcgccggccccgacgatcg

SEQ ID NO: 74804 - DNA, 292 bp, Triticum aestivum
  Clone ID: PAT_TA_74804
ggcgtggaggtggccgggttcgccggagaacagcacgggttctctgtcctccggccgttcggcgaggcggccaacgagctgatgcgtgtcctcaagcggtttgtgtacgcaggtaccacacgtaatacgtccactgatggttgaagtgtttggtgatctcctgattctcgtgtggcaaatcgtttggatttttacttacttcaataatgtaaatccggccacgcaacctaatgaaccatttgatggaagaactgcattctggaagaggtctgaaaagtgaaaaccgtatgtg

SEQ ID NO: 74805 - DNA, 125 bp, Triticum aestivum
  Clone ID: PAT_TA_74805
agccccgagcttcaccatgctcttcaggtgcagaaaatgtctgaacaagctgctacacacagctttaaggaatagacatatattcgtcaagaattaaagaacccactaaatggcatgcaatttac

SEQ ID NO: 74806 - DNA, 122 bp, Triticum aestivum
  Clone ID: PAT_TA_74806
ccgcggagtacgccggcgcccgcaagcggcctgaggataccgcgcacggtgtcctggcccgtgccccgacgctgcctcggcgtccgagaacgcggagcgttgcccgaggttcgggttctcct

SEQ ID NO: 74807 - DNA, 552 bp, Triticum aestivum
  Clone ID: PAT_TA_74807
atggacgtcgaccccacgcccccgccgcggcagtctgtcaaggtcgccaggccggccgctgcacgcaccagcgtccccagcaaagcaaatgagacggcaagggcgcccacgaaagcggcagcccagcaggacgagagcgatgacgaggagctcagtgacctggacagtgacgctgacgagatccaagacaccgttaacgtcggtggcggggaagaggacgatgacgaggaagaagacgaggaggaggacgaggagcttggaggagatgatgaggaagatgaggagcctcgggagctggacagtgatgacgaaggcagcgatggaggctccccggatctcgacaagatgaccaagcgtcagcgcgcccggttcgtcgatgacgacgattgcgcgctcctgaaattgtccgatgaggtacaagccaaaaaggtcttcacggcagaagagctgtccatgcggcgagccgagatggcccggcggaggcggaatctcagcgagaagcggaacgaagaagtccagatggaaacgatacacaagctgctgcacaagcag

SEQ ID NO: 74808 - DNA, 458 bp, Triticum aestivum
  unsure (1)..(458): unsure at all n locations
  Clone ID: PAT_TA_74808
aaatggtcaagtacagcaaagaggtcgacaacagtgtcaaagctgccaaggcaagaggaactcacttgagagtccacttcaaacacactcgtgaaatcggacatgctattnaagggtttgaagttgagtaaagccaaggcttacttggagaatgttttgctttacaaggaagccatctctttcaccaaatacactggtggaattggcagacacgccgtcggcaaacaatacaatgctcccggagacaaagtcagttggcctcagaaggcaaccaagacctttttggacttgttgcgcaacattgagtccaacgccgaagtcnataaattggaattggacaaggtttacatcacacacgtttactgcaaccaagcaccaaagatgcgcagaagaacttaccgtgctcacggcagaatcaatgcctacatgtcctcccctgctcacgtcgagatcattgt

SEQ ID NO: 74809 - DNA, 263 bp, Triticum aestivum
  Clone ID: PAT_TA_74809
cggctcgaaggataccgtcccccagaagctcgacgcctccgccgccagttcgctcgacatcgagaagaagacctacatcaacgacgaggccaacttccggcttcgacttcaacgaggaccagatggccgtcgagaagcttcgggaaggcatcagcaagttcgccgccgacgccgtcaccctcaaggacatcatcaagaagaaggtccaggcttaaatgctaaatgtctaccttctcttgccatggttttatgaggaatgacga

SEQ ID NO: 74810 - DNA, 414 bp, Triticum aestivum
  Clone ID: PAT_TA_74810
aaggcgctcgagttatttttatcgaaggcaaaaggctcctctgatagtggtcaagagagatgggggcttcaactatgcttctacagacttggctgtctctggtaccggcttaatgtggagatggcmgaatggataatatatgtaactgacgtatkkgtcagcagcaacatttccattcgtttttcagtgctgctaggctggctggctggctcccagatwwtwaagaagagaagtacccaaaggtgagtcatgttgggttcggctttgttcttggtgcagagggctcacgcttccggacacgttcctctgatggagttgttcgactggtagatctacttgatgaggctamatctcmgagcctagcacagcttatcaaacgtctgactgaaaatggtcaaattgctgactggacgg

SEQ ID NO: 74811 - DNA, 122 bp, Triticum aestivum
  Clone ID: PAT_TA_74811
tggtgccccgcgttttacaattcccgttccctcccgctatacagcagagagacgagcgacgacgctttacctacgacgtctacgacgggggacggactgggggtggcgaccggcggtatggc

SEQ ID NO: 74812 - DNA, 609 bp, Triticum aestivum
  Clone ID: PAT_TA_74812
ggcacgaggcgagaggctttcttcggctgaaacacttgttccacggaaccaagatgctgggttggctgaactcccagccactgttgctgcactgaagaaccccaactcaaaaatctttcatggttgtactggtcataaaggatttttgaccagtacaaccatgaaagatatcctcctggagatcccagcaagcgtgcctttgcctactttgttctgagtggtgggagattcgtatatgcatcactgctgcgtctccttgtcttgaagtttgtcttgagcatgtcagcaagtaaggatgttcttgcacttgcttcccttgaggttgatctatccagcattgaacccggcagcacagtgactgtcaagtggcgtggaaagccagtcttcatcaggcgacggacagacgatgacatcaagctggccaacagcgtggatgttgcatccctgcgccacccagagcaagacgctgagcgtgtgaagaacccagagtggctggtggttattggtgtctgcactcatcttggttgcattccccttcccaactctggagactttggtggctggttctgcccgtgccatggctcccactatgacatctctggcagaatc

SEQ ID NO: 74813 - DNA, 686 bp, Triticum aestivum
  unsure (1)..(686): unsure at all n locations
  Clone ID: PAT_TA_74813
cggcacgagggaggagagcagcataaactccccggcgaccgatgtgttcgaggtcgtcccgaccgagtcgggcgacaaggagaaccagagcgcgctcgtcgccgaggacagcgaggaggtgagctgtggagacaaggcggcactggccgatgccgaggaggatgtggaagtggaggagaccaagaccatgattgaggaggacaagaaggactccgcggccgccattgaaggcggcgaaaaggagaacccggaggtcgtggagctcaaggcccagctgattgccaaggagatggaagtcgccgtgctcacggcgacaatgcggagctcaagaagcaggccgacgaggccgggcggcggtcaagagggctgacgaggaggctgtggccaaggctttcctcatcgagcaggagctcaaggagaacgcggcgcgggagtgcccggatgggcgagcagctgagggctgtcctgagtgccgtgctgctgaggcgctggacgccgagatgcggngcctgcgcgtgcatgaccgagcagtgtgcgcaaggctggctgaggctggtcgctgcgtgtttttcggcggggacgcgcacctcgtcggtcaccatggcctcgccggcaatggaagcaacgggttggggggtccccgggaagattccggacgagggacgacgagggttcggcaggcaagc

SEQ ID NO: 74814 - DNA, 603 bp, Triticum aestivum
  Clone ID: PAT_TA_74814
cggcacgaggcgaaaagtgaagtggctcacgctgcccgcccgtggtctccggcgccgtggccggtgcggcctgcgtcaccatgtgctgatccaccttgacctgcacgaggaccactccaaggctcgcgacgacgacgatgacccgccgctagctgacatctttgagttcacctggttcccccgtatggtggacgacacggcacggcgaggcgatcgtcgtgctggacagccatgcaatgagcggcgtccggcatgacgcgacaacgacgacgaccgcggcggccgccgcgggcgggacggcccgcgtgcgcaggacggatggcgcgaccgcatccgccgctccctctccaggggcgctcgtgaccgtcagcgccaggatggtcaggaccgctcccgcgatcgctcgagcggcacgggcgggaggcgtcgaggtgttggacttgatgtcgttgcggcgcctccgcaccagatcatgctgggctcaggctccgctagtgttgaagggggcgtcgccatggagctccagccggtgcgcggccgcagcctggagcgccagggctcaccgcgggctgcacgcaggcgctcccaggcgagtctcacgcc

SEQ ID NO: 74815 - DNA, 165 bp, Triticum aestivum
  Clone ID: PAT_TA_74815
cggcacgaggcttcctttggtatatcaaatcaaaagttatctactggagcacatctgaagattgccttcttatttatggtgcaatcgctgtggtagtctgtttcatttgtgcattgatatctcttgcatttgccttccttgttattccacggcaagtgatgccat

SEQ ID NO: 74816 - DNA, 565 bp, Triticum aestivum
  Clone ID: PAT_TA_74816
cggcacgaggcttgtcggcagactcaacggactaaagcagatgtccttcgcctgcggcgtgtgggtcgaccggaggcgggcgctcaggccggagttcacggccaccagcgcgtcgcggtacgccgcgacggcggaatccgtggacttcgtgtcgggggccgagcaggcgaggcggcgcgtaaacggcttcgtggcggacgcgacgaagcagcgcatccgtcacatcctccctcccggctccgtcgactcgtccacggccgtcgtcctcgccaacgcgctctacttcaaaggcgcatggcctgagccgttcgacgtcttcaccgagccgttccacaccccaggcggcgccaccgtgcgcgtgccggccatgacgacaggccggtcacagtacatcgcgctctacccgggcttcagagccctcaagctgccctacaggaacgacggcgaccgctccgctgcattccacatgcttatccttctcccagacagcggcggtctcagcctctccaatctctacgacaaggtggtgtcatcgccggagttcatcaggaagcacacgccggaa

SEQ ID NO: 74817 - DNA, 344 bp, Triticum aestivum
  Clone ID: PAT_TA_74817
cggcacgaggcgactacaccgttgctcctcaggcagtcaagaaaatccaggctaacattaagctttcttcaacaaaccttggaattataattagtcgcatcgtttatgagacttcagatgcaatggagtcttcagaggtgatcctaaaagatatgttcattaacattgcagattatatgacacctgctacatgtactgatgtagctttccacaatatgtgggctgaatgttgttgcaaagttaagttgaaggtcaatactgtgcttcatgatgagaaggaatttgtatattttataatcaagtcaacaaacatgacgtgtctaacaccaatgtctgtgcttgat

SEQ ID NO: 74818 - DNA, 205 bp, Triticum aestivum
  unsure (1)..(205): unsure at all n locations
  Clone ID: PAT_TA_74818
tagctaggataccccgggctagcaggaatntnagacgaggnggaaccctaacacccaaatacaccactaccccgcctaccgcccctacccataggcaaccgccatacgccgacgctagccgangtacgaagcggctactacagaagctaccgtgcgacctgcatctatatacctaccaagccacaggacaaagtaccccaagaca

SEQ ID NO: 74819 - DNA, 770 bp, Triticum aestivum
  unsure (1)..(770): unsure at all n locations
  Clone ID: PAT_TA_74819
ctggcacgaggaagaagcccgaggatgagcctgcagccctgagngctgagaagtgtcaaggagggtgctggagaatgaagaggaacagaagngaagctgagtgaagataaggagatgaccttgtgagngagtatgagaaatgtgtttggatgngagaatgctggaaatgctgatactcgcactaaatggctgagtgagagaaaggttgaagttgacaatggagctgcagtccatgcagcaaacttggttcatttttgacacgaatgtgacttggcttgacgtgacacgtacttatactcaangcttgtgtgctcttggacacactgtgacngcaagacaccgacacacgacacaacacatgaaactgacgacgtgaccgctgttgccaatgaagttcccttcatgcatcaactgaaaattccttgaagccatgcttgaatggctgagatgtgtacatgttgtgctgtgtctgtgtggcctgctgtgcctgttgtgcttcatgtggtgactgctgtgctgatgtgcccatggctgggtacaaactgtgctgtgcngtgctgtgttgtgcctggctgaccaagcttgncttgcatcctgtgctgatctgaatgaccatggtcaccaagtttccatgactgctagtgtgggaacgtgaacgnggggtcttgtgtcccagtgcccttgatccgactagcagcctgngctcctcggatnggttcactaccagacctgtgtccttgttngagttgtcagtactcaggtagncgtgt

SEQ ID NO: 74820 - DNA, 233 bp, Triticum aestivum
  unsure (1)..(233): unsure at all n locations
  Clone ID: PAT_TA_74820
caaagaaccaattaaccacactcatctgaatcacccactaactaaccaactaacaacttaaagaaactaacttgacaactaacgaatccatgaactcatctcaacaacaagactgatgagacgagaccgaccgatgagatcctganacgagacgagatgagatgactgaatnacatgagaccgagacagaaanaagacctcgagacgagacgactgatcgatgacgatgagtc

SEQ ID NO: 74821 - DNA, 531 bp, Triticum aestivum
  unsure (1)..(531): unsure at all n locations
  Clone ID: PAT_TA_74821
aggacagcttaaccacactcatctagacaccactagctagccagctagcagcttaaggaactagcttgcagctagcgatccatggctcgtctcaacagcaaggctagtaggcggccgccgtggtcctaggcggcggtggtagctagatagataggccggcagggaggcctcggcggctgctagtcgtagcgggcaggtaggactccaagctcgcgccgtgcgtaggcgtacgtagacggnttatggcgtcctacgatacagcaaggagtagctgctaccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaagtagcggcgtcagcgtgcccttccccatacagcatagtccaccaatctgcaacaatgtacaactagtntcaatataataaataccttcctaacgtagcatagcataggacgcgcttgcgtagca

SEQ ID NO: 74822 - DNA, 312 bp, Triticum aestivum
  Clone ID: PAT_TA_74822
cggcacgaggccggtggggactgcaagctgtgcctagaggccgccattggtaagctgctggcgagagggtgcgccaaggagggagggatggtgttaggcggaagctgcagtttgagatacgatctgtatcccatttttgattcctagctaggtggcgctacctttaatttgttcttgtaattaaggtgtcagactcttatacccacatgcattgttcatacagattctcatgaatatgttcagatacaagaaacttcagtttatgtttgtaaataaaacaagggtgggaactaggaatactatctgccgaat

SEQ ID NO: 74823 - DNA, 121 bp, Triticum aestivum
  unsure (1)..(121): unsure at all n locations
  Clone ID: PAT_TA_74823
aagaaacatntcagcatcaatgcataccaagtaaactactagatacacatagacatacataggcagaggtactacaataataggccctgtanaagtangctattcacagtttatagaggac

SEQ ID NO: 74824 - DNA, 436 bp, Triticum aestivum
  Clone ID: PAT_TA_74824
cactgaggctctcacaaaccacatgttgggcaccatgccgccgcagcatgctcccgagctcaaggacgtacgaacatctcgtggaggcgatcctcatcctgcctcccgcccgacgatgcctgaaacctttcttcgcgcctccctcgtctgcaagccgtggtgcagcctcctgatccgaccatggcttccgcagccgctaccgggccttccacaagacagccccatgctcggcctcttccacagtgatgtaccgttacgcccccttcatctccaccaccaagtttctacccgcgcaatccccggcacaactattcccattgtatggccgactgccgccacggcgcatcctctttgagaacaagcactccctggtcgtactgggaccccatgacgggcaaacacgaagctgtcgctgcacagagggatgatgcagcaa

SEQ ID NO: 74825 - DNA, 411 bp, Triticum aestivum
  unsure (1)..(411): unsure at all n locations
  Clone ID: PAT_TA_74825
tggaagtgcagactgtggggttgatagcccccgtgcaattgttccccggtagttgcttactactgtgctgccggtgcgggcgccgttgtncggccaccctgtgatcgctggccgggttgccgctgcctcgcccgagtgttgctccctgcggtatgctcggctcggctgtgctggcccctatctacggccccctgntttgcccttgggccctcggcgtcctggccccccttatcccctttcccggggcctaggcccctcggaaaacccctgggcccccaataggtttccccccctgggctaagccccctttttccttttttcctttccccaatttcccccaaagggaaaaaacggggggggttttaccggccactcaccgggggggggtttaaaaccaaacgtcccnggaga

SEQ ID NO: 74826 - DNA, 494 bp, Triticum aestivum
  Clone ID: PAT_TA_74826
ggattttgacgaggcttccacctcctgtcttgtgcagtccccccttcgcccagyctcccggcgaatccaaatccctgagaaatctctcgcgccgcctagctgcctcggatrgctcccggcctcgcacccgctgctctacgcgtgcgccttccgcgacagcgccctcgtcgccgagctcgcccacgaccckggacgctgggggcgccggcaccggcgacctgcckktttcgccgccgcgctcgctgcttcggcgcctccgcaccactgctacgtacacccactccacggcggggcgggcgcacgcgcttctcctacggcccgccgctcgcgctcgccgcggtctcgctcgcgccgcagctcccggcgtcccacctcctgctcttcctccgccgcctgcgatgcctccccgagttcaggatgcgcgaagasatggttgcggctggcgctccgcctgccgttccccaacgaggaggcgctcgcgcgcgaggctgctg

SEQ ID NO: 74827 - DNA, 773 bp, Triticum aestivum
  unsure (1)..(773): unsure at all n locations
  Clone ID: PAT_TA_74827
gccgggtggcgcgctttttctcatcttcttctacttctggcggttcttctccgggaagcgagggccgtctagccccggaggtgctgacgaggagtcgtcatcgaccgactcgtctccagcgacctcgccgagagcgtccaggcgcctgcgcgaccccgaccagccggacatcccgtcttccctgcccatgtccgtgttcgactcgagcagcgaagccgccgggaaggcggcggcagactgcgcggtgtgcatcgtggagttccgcgacggcgacctggcgcgcctcctccctcgctgcgggcaccggttccacgccgcgtgcgtcgacgcgtggctgcatctacactcgacgtgcccgctctgccgcgccagcgtggtcgcccctgagcccgccgccaccgagcccaagaacgacccaaaagacgacggcgcggagtgcccggtgtgaggcggatctgtgcgcgccggcgaggccgcgagctaccaaagccaagccagagacgcatgtaaacggcggaaggcgacgacgcgtctttcggtgtcggtgtgtcactatcccttagctgactcctgcgggtcggcgaggtacggttggcttcgttccctcgatcttatgggttgtagtgtncttgttactatacatatctctctggctctcggtcaggtttggtgatcggtgagatgcatatttgaatcggagtcttcttctatatgatgatgatgatgtgcgtntgattggaattgtaagattaggcaacctttnttttagatta

SEQ ID NO: 74828 - DNA, 209 bp, Triticum aestivum
  unsure (1)..(209): unsure at all n locations
  Clone ID: PAT_TA_74828
aatggagccgcaggcctgtgtcaagcccattccgctagatagacgccgtacaagatgggctgctgtctgctagacctcgcccacagtggctgtgtgctggccccctctcactgctgngccagctgctcctacgtgcacacgtgcctgcagcctgcnactgcctgccgtctactaacgggcatgctgcgccactgccctggggcatagcg

SEQ ID NO: 74829 - DNA, 516 bp, Triticum aestivum
  unsure (1)..(516): unsure at all n locations
  Clone ID: PAT_TA_74829
ttttgacgaggcagagcagcaggcattgcaaccgggaagtgcagtgcagtcaatccaaactcgagcacagggaaacagaggagctggccgcaacgcgacagcagcaaggcggtttttggcccgggaaaccccaaaagaggatatgcaatgtcccgggtggagcgccgccgccgggagaagcgacgtgcccgtgcgctggccaggcggtctgaagcggagcgcagtacggtcgaggcggagcgaggcgaaacagaagaaccgtcagctcgcctgcatgtgcgatcaaggaaataagctgtcggctaccagtggtggtggtctgagcttcaaggacccaagcaatgcgtctacagccatcgatcgttgggaactttcatcgcgatccatgtgaagatggaacaactctgaacccaagtacctcttgattactctgagtgtagactggtttgggcaaaattntggccaaaacttccttggttaatttgatacggatttcagtacatgtacctgcagcta

SEQ ID NO: 74830 - DNA, 804 bp, Triticum aestivum
  unsure (1)..(804): unsure at all n locations
  Clone ID: PAT_TA_74830
tggacgaggcacgctccttctccccctctactcgatcccctcattctctccctctcactcgctcgactccactatcagatcaggccgctccgccgccttgcccagtccctgccggaccccgccgtcagggccccgtcccacctccggcacgccaagctcgtcgccttggagctgccgctgggccagctgccacctccggcctccccttcgtctgtgtcgtctcctgctcctcgccttgagcaactggcgcttcaaggttggcctcctgcagctcgtcgttgcctggagctccccaccaccagcaagcagtcgctgccatggccctcctcgcatgcctgtctccaccttccggtccatcctgcgtcgcttgactggaatttctcctgccttcgtctcctgctacctggctgcgccatctgtacctctgcctgccctgccgacctcctctactccgccccgagaaagctgccctgttgcctcttgttcatggccgcggacacccatctgtcgaccctgtgtaccttgtcctatcgccgatgggattccttactccttcggtcgccaagattgcaatggccgcaccaaccgaaggatctgacggcaccacatcaacctgctcctcttgtcgttgccaagacaacagaccaggatacgccaagacaaacgtttgtttcgccaagttccatcaaaccgacgtgtacgtcctaccgtcgctgtgtntactttccatcaagttcgactacagcacaattntntgtacaatacgccgatcggtaagtacgactacgcattggggcccattca

SEQ ID NO: 74831 - DNA, 101 bp, Triticum aestivum
  Clone ID: PAT_TA_74831
gcaatggggttgctccaagcccctttgctgtgctctcctcctctggcctgtgtgctgcttgtgcctgctgcacttgcccatgtcctgcctgtcctgtgtct

SEQ ID NO: 74832 - DNA, 320 bp, Triticum aestivum
  unsure (1)..(320): unsure at all n locations
  Clone ID: PAT_TA_74832
cagatctaacagcagctacaaaagcagccaagagggccagccacgcgctaagtaacagagctatacagagcagagctaagaaaagaaagcccagcagagcagctaagagctaagagccctaagagcagcacccaatgggcttttaagagctacagcagagtacaagacacaagtaagggcaggacagcacagagaggaaacattactaagtaagtataagatacctaaagagggtatactaagtaagctctctatactaaataagcttataaaggtaaggtaagtaatacctaaataagcctataaagtaaaggtantaa

SEQ ID NO: 74833 - DNA, 287 bp, Triticum aestivum
  unsure (1)..(287): unsure at all n locations
  Clone ID: PAT_TA_74833
tgtgacctcgcaaaccactgtctctcgcctggagtgtttgattttgtncaaacaacacctgccgcatcgagtgtctatgtggaccacaaggtttgtcgcgctcgaggtcaaggtcagagtgaggtgtgcctgggcaggcacaaggaggcccatgcttggcacaccaaacacactgccaaggagctctgcctgacctcagctccagcattctcgccctcaagacagcacagcgccatgtggcctgaggtgagggctgcacgaaaatcatgtcccagagggtctngcgt

SEQ ID NO: 74834 - DNA, 630 bp, Triticum aestivum
  Clone ID: PAT_TA_74834
gcacgaggcaatttcttctcttccaccattgccacccgctcactccatcctgccacaagccatggcacgaccaccatgatgcgagacggaggtgcaccacgtgccgcaaccgcacacaggagcgctaccacgaaggtgaccacgcgctgcaattcgtggaggccgggtgtgcgtgaagacgatgaccagcgacaacggagaccgccagcaccgcgggcgaykttgacaccgtggtgctccgtgtgctacaaccgcggtgacggggcgcaactcagggagacggcgatgctggaaccagctgccgtttttgctgcaaccaaccggtgaaggctctggaaccagcgcggcggtggctgtgcggcgatgctggaatcctgacaagtgctgcaccacgtcgacaagtgcggggagatccagcgagatttgttcctgctggaaccatgatttgtttttgctggaaccagctcaaatttttgctaccagcatcttccgtttttgtttgaaaccaaccaatttttttgctaccacgttttttatttgctggaaccggtgtatcaatttgctaccaccgtttctgaattttgctggaactaatcaaattttttgcttccatgtttttttgctggaaaa

SEQ ID NO: 74835 - DNA, 247 bp, Triticum aestivum
  unsure (1)..(247): unsure at all n locations
  Clone ID: PAT_TA_74835
gggccccggggggcccgggnatttcttaaagaaaaaaactttaagagatggaggagaatttcccccccccgcgggggggggtccctgggcgcgaggggggaaaatttttccggggggcgaaacgggaaagggggcgtttttcttcctttaaaacgttggggcnaaaccccggggccccgggccaaaagggcccacaatttgagggtttggaaaaaaaaggttaaacattccccgggaaccgggggca

SEQ ID NO: 74836 - DNA, 394 bp, Triticum aestivum
  Clone ID: PAT_TA_74836
gcacgaggaaaacacgttagacgaacactgagacctgccgccgccgccgaagccacgccggccgcctccatgaaaggccgcagcagccaccgykgggaccgctcccacctccgccgyggcctcgacttccagcaagctgckgaccccgaagacgatgccctgtctcagactcctgatgtgaatctgkgtctgactgatggagcatgtgattgtctcctcgtcgtttgggkgtctgkgagtctgktwtttytgkgagaactgaaccagttaagctggatgckgggagcggaagctggagctcgctgttgcctcttgccttgactgttgcccttctcgtgctgatagctttgcatgctgccwtgcygctggttgccttgactgtgtgtctgctctg

SEQ ID NO: 74837 - DNA, 322 bp, Triticum aestivum
  unsure (1)..(322): unsure at all n locations
  Clone ID: PAT_TA_74837
ggcctggcaggaaattctggcacggagggggaaccaagccttccaaaggggcccgagccgtgaggagcaaggtaatctcaccattcgaattatgggcgctccttcctgggaaagtttccggaggaaacccaacccaaagcttaactaactgggcgcacccggttccaattgtgagaatggtgccccccctgggctttcccaaccccggttggaacctttttcccatttccaaaggaaaccaattnngagattcaacccggggttaccctttccccccaagggcctggatgaacctgtggttggggcctgtggtttccttcca

SEQ ID NO: 74838 - DNA, 205 bp, Triticum aestivum
  unsure (1)..(205): unsure at all n locations
  Clone ID: PAT_TA_74838
cggcacgagggttttttttccttctttccaggagagcctttagctgctaacaaacnatgtgttgtttattgtgtgagagttttgagcagaggaaccaagtagaaactgcccaggccttacttgtgttgatgtgatgccttagcatatatgatttcaaatcaaacattgttatatcttctaaatcagtgtttcccatcacacaaca

SEQ ID NO: 74839 - DNA, 321 bp, Triticum aestivum
  unsure (1)..(321): unsure at all n locations
  Clone ID: PAT_TA_74839
aggagtgaagcagtcggacgtgatgaggttcgtgcagcgcgtgcgtatgctgggagtacatggcagcagcctggccatcgtagcgcatcaccaggctccacccgccccgacagggctcgccgtctcggcttcaatgccaagcaggggtatgtggtctaccgtatttttgtcagtgcgtggtggcattgaagaggccagtgcaccaagggtattgtctatggcaagcccacagcaccagngtcttacccagactcaagttccagagcgaacaacgaggtctgttngctgaagaaagagctggcgcgcaggctgggtggcacc

SEQ ID NO: 74840 - DNA, 468 bp, Triticum aestivum
  Clone ID: PAT_TA_74840
gcacgaggctctctcgactggaccccttctcctttctctatctctccacgcgtgcgccattgctgcgtcttcttgtgaragcgagtggttgccggarcctgcctggcctggaraggaagaggacgcgcgcgcacagcgagggaaggagaaaagaararcgttctttgsccctcgctcactccgatgtgttgctacgtgggcaaggscaccaaagatcttcctctttctcgtcacggcggtcctdgctcgccggcctcgtcctcggcttcggsctggcccaccggacgctctggggaggccmgaaggctgagccagcctgccggtggccgcgctgccacgcagcagcmgccgggcctctacggcggcggcggcctctcccggtcgcgggcaccgccaccaccgcgccgccgtccaacccgsktcacggagccggctgtcgccgtgttccccggggtcgctcctccggcg

SEQ ID NO: 74841 - DNA, 234 bp, Triticum aestivum
  Clone ID: PAT_TA_74841
ggcacgaggcgttcgccgcctcctcccagacggctcgagaatccgcctccccacacctccctcggcgccacttcgcagcccccagccgcagctccccgccggccgtcagattttgaaggttcacagcaggagagatggcaactctaaccagccttgcctcaaacccgaatccaaacaagtcattcgaggtcctgcctaatccgggtgactccctctcaagcctcagttttagcc

SEQ ID NO: 74842 - DNA, 585 bp, Triticum aestivum
  Clone ID: PAT_TA_74842
agggcgtctcgactggtgggcccgcacgccgcggctctacacggaccaatccggcgccaatgtcaccgccacattcgccatcgccggggagcactacgacgccgggtactcccacggcgcctccctgaagcggatcgacatgcagtccatcatccgcaccgccgtggtcgcgtacccggaccctctgccgctcgacccgtacaacggcgtgtacctggtgctctcctcaccggacgtgcaggtggaggagttctgccgcgccatgtgcggcttccactacttcaccttcgcgtccgtggtcggggtcaccgtcccgtacgcgtgggtcgggaacagcggctcgcagtgcccagggaggtgtgcgtatccgttcgccgcgccggagtacggcgccagcgggcagggggtactgcggccgccgaacggcgaccccggggtggacgggatggtgatcgtgctggggcacgagcttgcggagctggccaccaacccgctggtgaacgcgtggtacgccggtgacacgccaacggcgcccacggagatcgccgacctctgtctcggggtctacggcgacggcggtggagc

SEQ ID NO: 74843 - DNA, 651 bp, Triticum aestivum
  Clone ID: PAT_TA_74843
tgcagcagcaacacctgatgcagatgaaccagagcatgatggggggctacgcttcctctaccactgtcaccactgatctcattcagcagtacctggatgagaacaagcagctgatcctggccatcctcgacaaccagaacaacggcaaggtggaktgagtgcgcacggaaccaagccaagctccagcagaacctcatgtacctcgccgccatckgccgacttttttkccgccgcagacggcgtcgctgtctcagtacccgtccaacctgatgatgcagtccgggccgckggtacatgccgcagcagtcggcgcagatgatgtcgccgcagtcgctgatggcggygcggtcgtcgatgatgtactgckgcatgcakgtgccatgtctgcckgctccagcagcagcagcagcakgcagcaccagkgctggcctgctgcactggccagctggggatgtcctccggtgcgaccacctgggttcaacctcctccacggctgakggccagcatkgggctggctgkgctggccgkgctgkgckgccawgtggcaaacagcatgatgaactgcctggcgtcttctcggactackgtgcctgyggctgtgcatgctkgygccaakgaggggtcgacctcgctgtcggccgactgctcgcg

SEQ ID NO: 74844 - DNA, 202 bp, Triticum aestivum
  Clone ID: PAT_TA_74844
ccggggggccccccgggggctttctctcttaaggaaaaccttatagagtattgggggaatctaccccccccccgggggggccttgcaagtgccgaaacaagtgttccttaaggggggttttgggtcttaggaaggttaagcaaggaaaggcaaggaaggaaacttatttcccgccgcccctgtatccgggtgttatccccca

SEQ ID NO: 74845 - DNA, 295 bp, Triticum aestivum
  unsure (1)..(295): unsure at all n locations
  Clone ID: PAT_TA_74845
tcacgggtggccgcgtttacggaagcagctaggccaccaaggcggcgcgcaagtacggcgccggccactggcggcgtagaagaagccgcaccggttaccgcccgggcaccgtcgcgctagcgcgagatccgcaagtaccatangagcatcggagctagctcatccgcaagctacccctatccagcgcctaggtgcgggagatcgcgcaggacttcaaggacggacctccgggttccagcannctccgccgtgtcggcgctccaggaggcctccgaggcgtacctggtgggcctgt

SEQ ID NO: 74846 - DNA, 115 bp, Triticum aestivum
  Clone ID: PAT_TA_74846
cggcacgagggagcgctctctcgccgacggccgcatacgcagattgtctacaaggtgctgcacacgaccacccgtaagcccctctccacgcgcctgcaactcctccgtgctgtgc

SEQ ID NO: 74847 - DNA, 661 bp, Triticum aestivum
  unsure (1)..(661): unsure at all n locations
  Clone ID: PAT_TA_74847
ccacgcggggcgcgcttatgacaagagggtatccaccggatcagcagcgtctcatctttgccggcaagcagcttgaggatggccgcacccttgcagactacaacatccagaaggagtccactctccacttggtgctcaggctccgtggctggtatgcacgcatcttcgtcaagaccctcacaggcaagaccatcaccctggaggttgagtcctcggacacatcgacaacgtcaaggccaagatccagcgacaaggagggcattcccccggaccagcagcgtcttatcttcgccggcaacgcagcttgaggatggccgcacccttgcggattacaacatccagaaggaatccaccctccaccttgtcctccgccttcgtggtggcatgcaaatctttgtcaagaccctcaccggcaaaaccatcaccctggaggttgagctcctcagacaccattagacaatgtgaaggccaagatccaggacaaggagggcatccccccggaccagcancgcctgatctttgccggcaagcagctcgaggatggccgcaccttgcggattacaacatccagaaggagtccaccctccacttggtgctcaggctccgtggctggcatgcagatctctgtgagagaccctcatctggcaagaccatcagccct

SEQ ID NO: 74848 - DNA, 133 bp, Triticum aestivum
  Clone ID: PAT_TA_74848
ggactacattagatgagatgataactaaatgatgatgagattccatagagacgatataactagacctataatactgatatatctaatactagataatatgagatataatactataatgataagatactatgac

SEQ ID NO: 74849 - DNA, 125 bp, Triticum aestivum
  Clone ID: PAT_TA_74849
tcctggccggcgccgccgccctacctcgttccggcgccgctcgccctaaatcgttccggcgccgctcgccctccactctcctgacctccactactgctccgacccttgctgcatcccaccttcgt

SEQ ID NO: 74850 - DNA, 219 bp, Triticum aestivum
  Clone ID: PAT_TA_74850
ggtaactgcctctacgccctggtgccgccacgccgaggccaaggaggagttcctcctatgccctcgaggcggcagaggcaggtaactcccagtccgcggacattctcccacagatccatgtcaaccttggtattgcaatggaggctgcggggatggtgcttggtgcctgcgagcactatcgagaggctgccatactgtgcccatcccatgcccgcgcgc

SEQ ID NO: 74851 - DNA, 535 bp, Triticum aestivum
  Clone ID: PAT_TA_74851
atatatcaccagagcttccccttcatctataccgatacgacgtataagacttgtccaatcgctatacaacgagaactgaaagcccaagacctgctgttctctcttccataaaggcccatccgaatcgtcctcgatatctgcaacagcacaaccacttcatcacttcatcatctccaatatgcgtttctccgtcatcatcgtcaccttccttgctagcgttgccgtcgctatgcccgatcctcttccacaaggctactcaggcccctgctcaaaggacaactgcggtgtcagcggcaaggtgtgctcaggcggcgcaatctgtgtggggtggccaagcaccgatcccgccaagaggaagggatgcacctgcagccgtggctaagcatttgatgctagaatttttttgcattggcaggcgtgtatgtcatatcatagcgaggttgactggaagcatattggttgtaatctagagggtgtattatttatgaatgatgaagacagaatttcgagaaaaaaaaaaaaaaaaaaaactcga

SEQ ID NO: 74852 - DNA, 486 bp, Triticum aestivum
  Clone ID: PAT_TA_74852
cggcacgagggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctcctatggatggagtgatgaatatgtaagaatgaatgattta

SEQ ID NO: 74853 - DNA, 595 bp, Triticum aestivum
  unsure (1)..(595): unsure at all n locations
  Clone ID: PAT_TA_74853
cagaggggcctcatcggcgaggtcatcagccgcttcgagaagaagggcttctacctcaaaggtctgaagctccagaacgtggagaagtcgttcagccagaagcaagcactactccagatctaagtacctaccaaagcccttcttcagctagagagctcagtaggaagtacatacagtactnccagagcccagagtcagtcagctatagagttctagagagaagagagcaaaagaagcagttcagtcgccactagagacagcaagatcattagagcagccaccatgacgnccctaggcctctagaagcccagagcaccatccagtagtgtagancttgtgagccagtacagaacatacagagcaagagaacagtacataccaataagagaaagcagactacaagttagagagaagttggccagagaaacgagacagatnctgcccctagtagagttcccctagaagaggtgggatgtagcaganggtagggaagagaagcagccaaggcatcatggctaagagaatacttataagaagaggcctaaagaatagtagtacataagaagtaagagtatttagagtagcagagtattca

SEQ ID NO: 74854 - DNA, 264 bp, Triticum aestivum
  Clone ID: PAT_TA_74854
tgttgccggcgcagttgcaaccgacgtgttgtggagctggaaccagcatccgccggtgctgaggacgttttttttgctggaaccaactttcttcttgctggaacttgctactattctttcgctacatctactactttttggattttgtttcatgtgatttttgctggaaccagatgcgccttgcatcgccgaagcagtttttttgctggaaccagctttatgtttagctggaacttgttacacttttgctacatcgacttcttc

SEQ ID NO: 74855 - DNA, 559 bp, Triticum aestivum
  unsure (1)..(559): unsure at all n locations
  Clone ID: PAT_TA_74855
ttggcacgagggttttttttttttttttttttttgaccaccgaccaacccacccaacaataaacatcatccaaaaactacagcatgcatgcaacatgtgaaattatgcccaccctgtgactttgatgccatgtcatgaaaataaccatgtacactgtgtgaaacacaatgtgctgtgtgacaaccatgtgcacaaaataatgtgtaaatgtgtgtgtgcaatggtgcaccatacccacaccactggtgactntttaaccccaatatcttgttttcatgccaagtcaatagaataccatccatccatcggtttcatttcaattctcaacnttaccaatccatcatgtcccactgatgctaagactgcacctccaccataacctccaccaccacctgtaccctgcaccacacacctgcctgtaacctgccacctcctccacctgccacctgcccctcgtgtcgctgacngtgaatgtcactgtccaccaaatcngaagcaccaccngccggctcctgacctgctggtttcttgcctcctcctgccgcctcctgaactgagt

SEQ ID NO: 74856 - DNA, 127 bp, Triticum aestivum
  Clone ID: PAT_TA_74856
aaggaaactagcattagtcatttaacacccttgctgtcatgttatcctgttggttttacaaatgtatcctctttggaatttgaatgttgaaaattctaaccgcttttggaatttgaaattccaaggt

SEQ ID NO: 74857 - DNA, 770 bp, Triticum aestivum
  unsure (1)..(770): unsure at all n locations
  Clone ID: PAT_TA_74857
cggcacgaggcccccggacagccggagagcgaggcgaagcggcgacgcctaccgcaaccatgctcagggtcgcaggtcgacgcatatcctcccatctcgcatggcgccccgccgcggccgcctccgccggcagcagccccctcgccggcggcctccctggcgacgacttcccccgggaccagaatccgcgcttcgccatcgaatcacccttccacgtcgctgccagaggcttttcggctgaatctcttgttccgagggaccaggatgtagagttggctgagctcacaccaactacggcagctctgaagaatccctgtgccaaaattgtctacgatgagtataaccacgagnaggtacccacctggtgaccccagcaagcgtgcctttgcctactttgtgttgagtggtgggagatttgtgtacgcatccttgttgcgtttgctcgtcttaaagtttgtcctgagtatgtcagcaagtaaggatgtgcttgcccttgcttcccttgaggttgacctgtcaagtattgagcccggtaccactgtgactgtaaagtggcggggcaagccagttttcatcaggcgcaggactgaagatgcatgtgaagctggccacagctgttgatgttacatctctccgctgatccacaggagggattgcgggtgcgtgtcagaaccctgaagtggcttgttcgtcttgggtgtcctggccctcacttgggttgcttccccttcccaactctnggggacctccngtggctgggttcttggccc

SEQ ID NO: 74858 - DNA, 190 bp, Triticum aestivum
  Clone ID: PAT_TA_74858
tacgccggagcaacaggtcgacgaggaagactatcagctagccggatctcaagtcaccatggtggtcgcgctcggtccgggcatggttctacggctgtgctgtgcctcccgcgccctgcgcgtcttccccggcgacctgctgtcgaccctgccggcgcccgtcaccgatagctgctgttctgctaggtgc

SEQ ID NO: 74859 - DNA, 619 bp, Triticum aestivum
  Clone ID: PAT_TA_74859
ggctacctccgcagacctgctccgcgccacagctccgtgacggctacctcttccacgaccagctccgcaccaaggctacagctgctccacgtcgccggtgctgcgtcccgctcccgtctacttcgccggaacactgctctcaccaacccccgtcgccggcccgcaacagcgccgtttcagaaccgcaaagaagttgcacgcgcatcctagccatcacccctggtgctttccttccacggttcaacctttttggaatgaaaatccctaagggcccatgctgttaagggagtggtgggaaatttagttccacatggctagttgagagagatgtacaccaacttataaggtgagctcttctcccactagtatgagttggtgtgaaggaaggagaggtgttccacacgcgctcctcctccgccgcccgcctcgtcacgacgcgcgcccgtgccgcgggttgctagctcagccaaagatacaacgcttcacacctccactgctccttggtcgttcctttcactactgttgccctcggtgatcccatcccgtctaccgcgtacacggctgacgggagagcaggcctccgaaaccccgcttctcctgatcctgtacgggagagagg

SEQ ID NO: 74860 - DNA, 104 bp, Triticum aestivum
  unsure (1)..(104): unsure at all n locations
  Clone ID: PAT_TA_74860
aacncggtcttgctggctactatttgctggatccgtcttcctgatgcacaagctttggccagtacatactggtcatctaaaacgggactacgagtagggcaact

SEQ ID NO: 74861 - DNA, 107 bp, Triticum aestivum
  Clone ID: PAT_TA_74861
caacgcttagcctcgcggtacgcaaaagacgcggttgcagacgctcttctacaaaacggcaccgactctgtccctcgtttgctaccacccgcagtgggtccgtattg

SEQ ID NO: 74862 - DNA, 598 bp, Triticum aestivum
  Clone ID: PAT_TA_74862
acgagggtgctctcatggctgttacccaagtcgaagaggaagacgaaatcggacatgtcaccgagcactgccgaatgtgagaacatgtcgcagcttctcaaggagtggggggtgttttcagtagaatctctgaagaaggagcttgcggaggccaatgagcatagggacgctgctcttcaagaagttggagagatgagatcatctttgggagaactaactagcaagctgctgagcttggaagcgtattccacagaactgaagaaggctctaaagaaagcaacaagcacgaaaaacgcgcaatctcactcgaagaggtcagcaaggtcagtgggtgtcagcagggacgattcattgcccgtcagccaggaagtaatggtggaagggttcttgcagatagtatcggaagcccgtctctccatcaaacagttctgcaaggtgctgctccagcaagtcgaagacgccgacaatgggctggcagataagctgaacttgctcctgcagccatatcaactgacactcgccgacaagcactcgaaagtgatactgtatcatctggaagctctcatgaaccaagcgatgtaccaagacttcgagaact

SEQ ID NO: 74863 - DNA, 113 bp, Triticum aestivum
  unsure (1)..(113): unsure at all n locations
  Clone ID: PAT_TA_74863
atggctggcggtcngctggaaggagggacgcctagctacgcgccaagcaggctacatagcgctcccgccagnctactccaccaacgcgatacgcaggtaggcgagaagcagaa

SEQ ID NO: 74864 - DNA, 516 bp, Triticum aestivum
  Clone ID: PAT_TA_74864
acttcggctacgcgcgcgccgaccgcaagatgcatgggccgcgagtccatcgccgccaatgctcgtcgccgacctcatcacggaggcgggcgcgcaccgcgtgctcgcctgcgaactccaattcgggcaagtccatcggctaacttcgacatccccgtggaccacgtctacggccagcccgtcatcctcgactacctcgccagcaagaccatctgccccaacgacgtcgtcgtcgtctcgcccgacgtcgggggcgtcgccagggcgcgcgccttcgccaagaagttctccgacgcgccgctcgctattgtcgacaagcggcggctgggccacaaccaggccgaggtgatgaacctcatcggcgacttgagggggaaggtggccgtcatggtggacgacatgatcgacaccgccgggacgatgcacaagggcgcggagctgctccacagggagggggccaggtcggtgtacgcctgcagcacccacgccgtgctcagccctcccgccgtggagagg

SEQ ID NO: 74865 - DNA, 264 bp, Triticum aestivum
  Clone ID: PAT_TA_74865
ggcgccgctcgcgccgtcccctacaaccggcccgacggcgacgcacctcctgtaaccgtctcacgcttacgctctgattcatgttcatgagtagtctgagtaatttacggtccaaggaaatgtgtaggtgctgttggggtccaaattgtagatctggattattatgatcagcaattattgctgttgttgtactgatgaactaaccatggcgaattggcgagatgtcaaactaaaattatacatcatgtgtatgcttagagcatc

SEQ ID NO: 74866 - DNA, 134 bp, Triticum aestivum
  Clone ID: PAT_TA_74866
gccgtcggccgagccaccggcattcctgcaacgcatctgagcacgggaagcatcaccaccataatagctcgcccgtgagtggcaccggcgccataccacaacaatgcatccgagcacaagcaccatggccacct

SEQ ID NO: 74867 - DNA, 504 bp, Triticum aestivum
  unsure (1)..(504): unsure at all n locations
  Clone ID: PAT_TA_74867
gtggatcccccgggctgcagtcgctggccccgttcgtgctcatgactgccatggcggtgcccaaggtgaggccgagtcggtgggcgtcgcaggtaagggggacaaggactggaggctcttcttcaacacgctcttctggaacctcaactactgggactgcgccagcacgatggccggcgaggtggagcggcccgagcagacgttcccgcgggcactggcactcgccgtcgttctcatcgccagcagttacctgctgccgcttattgccgcgaccggcgccatcgacgcgccaccggatgcctgggtcaacggctactttgctgacgcggcaggcatcatcgggggcccatggctcaaatactggacaggggccggcgcagtgatctcctccatcggcatgttcgaagcccagatnagcagcggcgcattccagctccttggcatggcggacttgggcctgctcccagccgtcttctcccgtcgcgccgcccgaaccggcacccc

SEQ ID NO: 74868 - DNA, 555 bp, Triticum aestivum
  unsure (1)..(555): unsure at all n locations
  Clone ID: PAT_TA_74868
tgtgccggaaccctcagtggctgctgcaccgcgcggaagtgtggggcggggtcagcatcgggtacctctacatgaaccgcttcgccgagctcatggtcccccngtcccggcgccggcgccgcctcccgcctcctcgccgcgctgctggcgccgctcgcgtgggcgatatcggcggcgacgggggcgtactaccgggagggcgatcccgatgcgggagcacggcatggagcccgggcacgggttcgcgcggtgcgtgtcgtcgtgcctcatctccatgctccccgacgggttctactacaaggtgaaggaaggcagcgtcgtcttcgcgaggtccaggtccttcggcttctgccacgacggcctggtgctcgacggcgccggcgccgagaagcgcgtcgtgccggccgacgtggtggtcctggccacgggcttccgcggcgacgagaagctgaaaaacatgtacgcgtcgccacgggtgaaggacatcatcgccggatcgtcgaactcggacacggccgtgccgctgtaccgggagtccgtgcacccgcgggatcc

SEQ ID NO: 74869 - DNA, 489 bp, Triticum aestivum
  Clone ID: PAT_TA_74869
caagagttgcaggctgcggtgggttaactacctcagacctgacctaaagagaggcaagatgacaccccaagaggagagcaccatagtccagctccactccttgtggggaaacaggtggtcgacgattgcacgcagcctcccggggaggacggacaacgagatcaagaactactggaggacgcactacaagaagggcaagccctccaagaacatcgagcgcgccagggcgcggttcctgatgcagcggcgggagatgcagcagcagcagcagcaacagaagctgcttcttgggcaggtcaaggacgtcgagctccccggcgccaccgtctcggacgacgtcgacgagaaaatggacggcgccgtgggcccggcggcgacggcgctggctgaccacggccatgaggagctgatcatgcaggacgtgctggacttcctgtgccccatgtcctgcgccctcctccacagcgccgggcagaccggcagctgcgg

SEQ ID NO: 74870 - DNA, 548 bp, Triticum aestivum
  Clone ID: PAT_TA_74870
ccagagtcgatcgacgcaccggcgggaggccagcaaaatgccgacaaccaccgtggaggacttgcctgccgacgtgctggcctacgcgctgcgccgactggacggcccgtccctggccgccgccggctgcgccacggcaggcctccgcgctctcgccgcggacccggggacgtggcgcgcgctctgcctcgcgcaatggccgtcgctgggcctggagaccgagcagcagcgcaacatccttggctccgcggccgtctctccgcagcgcctcttcgccgacgccttccccttcccctccacttccacttccacggatgctgccgcagccgaccaatgtttccccggcgagctgatctctgccgtcgacatctaccagaaggcgaagggcgcgccccggcccctcttctctcggttggtggagacctccacgtcgtcctcgtggttcctgacatcgcccttccgcgtggacgccgtccagtgcgagaacccggtgccggttcgggcggcctcgttctcttcggcggagcttgagctgagctggatcgtcg

SEQ ID NO: 74871 - DNA, 480 bp, Triticum aestivum
  Clone ID: PAT_TA_74871
caccagttcatctcactgagctcgcaggcagccccagccaccagcgaaatggccgcgtcggcgctgcaccagacgaccagcttcctcggcaccgccccgcggcgtgatgacctcctcccgagcggttcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacc

SEQ ID NO: 74872 - DNA, 450 bp, Triticum aestivum
  Clone ID: PAT_TA_74872
ctgaccagcccagaggtgccacggcgatcgccgggagtgtctgtcagcttgctctgccagggagctggtgctcaacacaacaggaagcgtttacaagcccggacaacgtgtcgccgccggagattacaggcagcccgacggagaaggcgctgctgtcgtgggccgtagcggacctcggcatggacgccgacgcgctgaagaggagctgcaaggtgctgcacgttgaggcattcaactcggacaagaagcgcagcggtgtgatgatcaaggacaacgctgcgggcgcggtggtcgcgcactggaaaggtgccgcggagatggtgctggcgaactgctcgatgtacatggacacggacggagcggcgcgtgagctcggagcggagcagaggaggaaccttgagaaggtgatcaacgacgtggcagtcggcagcctccggtgcatcgccttcg

SEQ ID NO: 74873 - DNA, 587 bp, Triticum aestivum
  unsure (1)..(587): unsure at all n locations
  Clone ID: PAT_TA_74873
tccccgggctgcagggggaggagggattggcgtctgcttcgcggcggggaattgcttgctctctctctctctctctgccggacggacatggcgtcgagggacttcttggggcaggttcnggcggcgagaagggctcgtcgtcggacaaggcggggggcggcgccggcgagcccgacgaggtggtcgagctcagcctgggcctgtccctgggcggctgcttcggcgccaactccggccgggacgccaagaagccgcggctggtgcgctcctcctccctcgccgccatgtgctcgctcccgggcaccagcgacgacctcgccgccgccacgcccccgccggcgccgcttatgcgcaccagctcgctccccaccgagacggaggaggagcggtggcgccgccgcgagatgcagagcctcaagcgcctccaggccaagcgcaagcgcctcgagcgccgcacctccatgaactccggcaagtccggcggcagcagcagccgggacgacgcccaggagccgctctaccccagcgcgttccagctccgccgctccgtcgtcgaccaggggaacacctcctcaagcatgccggag

SEQ ID NO: 74874 - DNA, 555 bp, Triticum aestivum
  Clone ID: PAT_TA_74874
acgtgccatggccccagccgtgatggcatcgtccgccaccaccgtcgcgcccttccaggggctcaagtcgaccgccggcctccccgtcagccgccgctccggcagcgccggtctcagcagcgtcagcaatggcggaaggatcagatgcatgcaggtgtggccgattgagggcatcaagaagttcgagaccctgtcttactgccacccctctccacggaggccctcctaaagcaggtcgactacctgatccgctccaagtgggtgccctgcctcgagttcagcaaggttggcttcgtcttccgtgagcacaacagctcccccggctactacgacggtcgatactggacaatgtggaagctgcctatgttcgggtgcaccgacgcaacgcaggtactcagcgaggtggaggaggtcaagaaggagtaccctgatgcctatgtccgcgtcatcggcttcgacaacatgcgccaggtgcagtgcgtcagcttcattgccttcaggccaccaggctgcgaggaatctggcaaggcctaaagtgcaagttgaagtaacgca

SEQ ID NO: 74875 - DNA, 357 bp, Triticum aestivum
  Clone ID: PAT_TA_74875
tgccatctccggcggcatctccccctcctccgccagcagttcgactccgtctcgccgcgcgagttcgacgactttgaggacatgtacaagctctacgaaggcgggcttaagatccccgacatccccgccctggacgagctgttcaaatcgttcccgccgctgaggagcatcatgccggccggcggggacttcctcctcaagatgcccatgccgcatgtcatcaaggaggacaagctcgcgtggcgaacggacgaggagttcgcccgggagatgctcgccggcctcaacccacacatcatcacccgcctgaacgtgttccctccgaggagcacgcttgaagggtacggtgaccagacg

SEQ ID NO: 74876 - DNA, 196 bp, Triticum aestivum
  Clone ID: PAT_TA_74876
ctattgttgccgagccggcggtggaggtggaggtggaggccgatgtggagagtgtcgggtggggtagcagccgagggagtgaggatggaggcgaggagccggtggcgtttgccaaagccgctggaatcagtactcaccggaggccgtagcaggagcaactcaccggccataagtcggaacggtgtggactctggtg

SEQ ID NO: 74877 - DNA, 223 bp, Triticum aestivum
  Clone ID: PAT_TA_74877
ctggcgtccatgatcatccaccattacaagatgcgcgaggacgtcgagtcgttcaacctgggcgagcatggggtgcagcgccggcctcatcgccatcgacctcgccgaggacatgctccaggccaaccccaactcgtacgcggttgtgctcaacaccgataacatcaccctcaactggtacttcgggaaccaccgctccctgctgctctccaactgcatcttc

SEQ ID NO: 74878 - DNA, 375 bp, Triticum aestivum
  Clone ID: PAT_TA_74878
tgcaggatgaaaatgctctacggagtgtatccgacctacacatctggtgatgacaagcaacctgcctcgaacaaatttgatatggaaaaagtgatgaaagggtttggagctcgtgatgcttctggagcttccaatgccccttacgtacaagttggtgaacctccctttgaagtcttcagaagtgtgcccttctaagatcaaaattccaggaaaaagagctcctttggatctcactttaaagactgctctgcagttcgtttcatcatcttctgtgaagtggtgtcacaatttgagtattgctgggcccatcactcacagttatcgtggtgggtctcaaaattcacgatccgcaaggcctgggaaggaattcttgtt

SEQ ID NO: 74879 - DNA, 332 bp, Triticum aestivum
  Clone ID: PAT_TA_74879
tgaagagagcaaatggagaagagggaggtgatgatattgaccatgatcgacggctgctaacctcttccgatggatcacagcgatcaatgaagtgaagatgggtcagttcatggtatgatgtcagaatttggcgataacgattttgttgtggggaactgggaatcaaaggaggtacttagccgtgatggtcatatgaggctttcttcccaggtgttctttgcgtctatagaccagagaagtgagcgggttgctggggcgagtgcatgcacgtcacttgtggctgtcattgcagactggttccaggcaaatcagaatctgatgcctatccagtc

SEQ ID NO: 74880 - DNA, 284 bp, Triticum aestivum
  Clone ID: PAT_TA_74880
gtgtctttggggacaggccgaggaccaggtcaggtgggaggaggaagaaacccggcacggcgttgtccgggccgcaccgccggagcagctccaggagaaggtcgaagagccctttcatcaacatggtcactgctaggacgctcaacgatggcaagacatggaggaagtacggccaaaaatatattcaatgcctctactagcccgaggagctactacaggtgctctcataagccagaccaaggctgccaggccacgaggcaggtccaggaatccgactccaaccc

SEQ ID NO: 74881 - DNA, 475 bp, Triticum aestivum
  unsure (1)..(475): unsure at all n locations
  Clone ID: PAT_TA_74881
cggttctgaagatgaagattattgcattctttgcctgtttcttgttgttttgagcgttgccaacgctatcccagtgaagaacattgaggattttggtggtggctttgctgacggtgttgagattgtgatccacgacnatgtcactgagtgtgttgctgatgcccaagtcaccttcgacgactttgaagctgccatgactgacttggaggatggtttcaagaacaagagtctcactgcacttacaagaggaattgaagagctcggagctggaattgaggaagtggcattggtgttaacagcctgtgatgtaggcaccattgcccaggacatcaacgccnttgcccagcaactcaagagtggtcccgagggcatcctcgacttcatcgtccaggagtccatcaacatcttccaccacggacatgacgtcacaactgacttcaaggctgccattgctgcctggaagtctggagacttc

SEQ ID NO: 74882 - DNA, 250 bp, Triticum aestivum
  Clone ID: PAT_TA_74882
aggtaacgtatttggtttcaaagccctacgtgctctacgttgtggtaggatctacgaattccccctacttattcaaaaactttccaaggcccgcctcatggtatccaagttgaaagagataagttgaacaacgtagtggtcgatcctttattgggatgtactattaaaccataattgggattatccgcaaaaaattatggtagagcgtgttatgagtgtctacgtggtggacttgattttaccaaagatg

SEQ ID NO: 74883 - DNA, 175 bp, Triticum aestivum
  Clone ID: PAT_TA_74883
ggccgcggataaccgcaggcagtggagagccgcgagggggaaccgcgaggacaagtggacgaggaagcgccgcctgctgctggaggcgaccgaggagaaacgccgcgcgcaggtagccgcagaggcggcggcggacgcggcggcggacgcggcggaacgtgaggacgaggaggcc

SEQ ID NO: 74884 - DNA, 152 bp, Triticum aestivum
  Clone ID: PAT_TA_74884
accagatcccgctcttcctcctccgcaagatccttagagccgcagtgcgcgtcggccgacgaggccgggctgctgctcacgagcatggtcaccgggctcgtgaaggagctctgcccgttcaagatgattgacggcgccttcccggccgtcga

SEQ ID NO: 74885 - DNA, 400 bp, Triticum aestivum
  Clone ID: PAT_TA_74885
acacacctagcctgtgcctgagaaacctccctccggcacctacgaagatttagcaggggatgttgatccaccaagcccccggcgccgaaaggcgttggacaccaagttcctgatccgccaggtagggggagtagcgctttgcccgaggccagagcagtgcacccagggccctccgaaatacccagccctgggcagttccaagtgacgacatccttcagactgaagtcataggtacgaactagatcctagtatcctactgctattgtatagcgtcggagaaaaaactgggcagcttccctttggcttctccctgtactgggctgtatatactgtagactcgtaattttatttgggatgaagtgatccagattctatcgtgttatactaacatagtacaaac

SEQ ID NO: 74886 - DNA, 120 bp, Triticum aestivum
  Clone ID: PAT_TA_74886
gcacattagtatcttagcaccttgctaaaccctgcaagtcttagcagaactcgaagcgccataaatttaatggctagcccgacgaagctcgacatggccggccatggcgacgaggtgacg

SEQ ID NO: 74887 - DNA, 501 bp, Triticum aestivum
  Clone ID: PAT_TA_74887
cggcgccggagagcgtaagccggtgcccaccatccgggtcaaggccaggctcgccggcaagacccacgagatctacgtcagcgcggaggccacgttcggggacctgcggaggcgggtggcggagcgcgccggcgcgcacccggaggacctgcgcacgctgtacaagggcaaggagcaggaccccaaggcgttcctcgacatggcgggggtcagggaccgctccaaggtcgccgtggtcgacgaccccgaggcccgcgcgcggcgcctgctcgaggagctccgcctcggcagcctccgcaaggccgccggcgccgtcgccgccgtcgccgccgaggtcgacaagatcgcgcccaaggtgtcggcgctagaggcgtcggtgcgcaagggggagaaggtggcggagaaggacgtggcgacggtgacggagctgctgatgaacgagctgctcaagctggacgcggtggtcgccggcggcgacgtgaaggcgcagaggcgcgtgca

SEQ ID NO: 74888 - DNA, 105 bp, Triticum aestivum
  Clone ID: PAT_TA_74888
tgggcagccgcgtgcgccaaaggcgctcgacccacctccaagaagcagccgaccgccgttgcgctcattgcgcgaccgccttcgacctgaaaacctggaaaatga

SEQ ID NO: 74889 - DNA, 435 bp, Triticum aestivum
  Clone ID: PAT_TA_74889
tcaggacatcgtgcgcatctcttccgttcgctcttcgtagatcctttctttttttccctttccatcttcgtgccatggcctccaggagcttctctcgtctcgggttctcttcccagatcaccgggcccgcccgcctcactctgcccctccgctctagggctgatttttcgcgcacccttccctgtgcctatggctggagcccagtcgtactccacctaccgcgcgaagccccacttcaacatttgcacgatcggtcacgtcgatcacggcaagactaccctcactgccgccatcactaaggtgctcgccgacaccggtctggccaagttccgcgattaccagtccatcgacaaggctccggaagaaattcgcaggggtatcaccatcaatgcttctcacgtcgagtacgagaccgaccagaggcactacggccac

SEQ ID NO: 74890 - DNA, 526 bp, Triticum aestivum
  Clone ID: PAT_TA_74890
accgataatacaatacctatggcccccgccgtgatggcttcgtcggctaccaccgtcgcacccttccaggggctcaatgtccccggccggtctgcccgtcagccgccgctccagcggcagcctcggcagcgtcagcaatggcggaaggatcaggtgcatgcaggtgtggccgatttgagggcatcaagaatgttcgagaccctgtcttacttgccacccctctccacggaggccctccttaagcaggtcgactacctgatccgctccaagtgggtgccctgcctcgagttcagcaaggttgggttcgtctttcgtgagcacaacagttcccccgggtactacgacagccgatactggacaatgtgcaagctgcctattttcgggtgcaccgacaccacgcaggtgctcaactaggtggaggaggtccagaaggagtaccctgacgcctatttccgcgtcatcggcttcgacgacctgcgcccggtgcagtgcgtcagcttcatcgcattcaggccaccgggttgcg

SEQ ID NO: 74891 - DNA, 226 bp, Triticum aestivum
  Clone ID: PAT_TA_74891
cgactgtcttagattgctcactttgatggccagcttcttcatgtatcaaatattggagactcggggtttctggtgataaggaatggagaagtacacgcgaaatcaaaaccaatggtttatggcttcaattttccacatcgaaatcgagaaaggggttgatcccttaaccctcgtagagaattataccattgacatagaggaaggtgatgtcattatagcagccacc

SEQ ID NO: 74892 - DNA, 481 bp, Triticum aestivum
  unsure (1)..(481): unsure at all n locations
  Clone ID: PAT_TA_74892
gaaccaagcctcatacttctcgctgtgcgttttcctcggcgcggcgctctcggtgaccgctctccccgtgctcgcctgcatcctcaaggagctcggcctcctcggagtgcccttcggcgagaccgccatggccgccgccgccgtgaacgacgtcttcngcgtggatgctcctcgccctcgctctcgccgtgtccggcggtagtcgcgagccgaaggggcccgctctcgcgccggtctacatcctctcgtcgggcgcgctcttcgtggcgttcacgttcttcgcgctccgccctctcatggcgcgcctggcgcgccgcgcaggcccctccagctcggacggcgacctgacctgctcatgcgccgtcccgtgcgcgctcctagcgggcgccgtgaccgacgccatcggcgtgcaccccgtgttcggcgcgttcgtgttcgggctagctatgccccgggaggacggcgtcgcggagcgcatcgg

SEQ ID NO: 74893 - DNA, 531 bp, Triticum aestivum
  Clone ID: PAT_TA_74893
aaccttccccatatttcagaccaaaagagaagtagtggcacgggcggcgatcccatctacaccacctcagcctccgtcccctgctcttccccctcgccgctgccggaggtcaccgccgggcgaagcccgtgcggtggtggcggcggcggggcctttccctgtacgctctcgcggcaagacaggcgttggcggctttccatgcggcggttgacggcgccgccggcgcgggtcgggtcttcggccggtgcatgcggcgtccacatccatccagatcggggccaagcaaaactatttgcgatccaggtgtgtgccatcaagtactctaggaagttaagatccaggtcaatggcggctgcttccctgggctctctttctggatgtgatgcgcactacaccaggcactaggagggctcctttgatccgcatgattctgttccatcgacatgcaccgcgggctctccaacagattggacccggcgggccgcttgttctcccctagatcggatcaggcggtatgcgggctctcccccc

SEQ ID NO: 74894 - DNA, 231 bp, Triticum aestivum
  Clone ID: PAT_TA_74894
ttgccagaacgaactccgagagagctacagaagacattacaaaatgctacagaagacatggctacatacgctgcaagtgtcgaagttcactagaagagttaagaactaatggagagatcaaagaaaacaatgcgagtgctatagtggataccagaacgaactcggagagagctacagaagacgttccaaaagctgagaggtgggcaatccataagtggaagttcaacttcg

SEQ ID NO: 74895 - DNA, 234 bp, Triticum aestivum
  Clone ID: PAT_TA_74895
tgctttgtgtagccagctccaaacaattgatttgcaggacaatcaaatcgatcagctcactgttgggggaacccaatacaacaagaaactcatacttttaggaaacccaatatgcaaccgagggaacaacgagcaatactgcaaaaccgcgacacaatccaacccggcggcgccaccatattctacttctaagaactgttctgggctgccatcgacgtgcctcccaagccagct

SEQ ID NO: 74896 - DNA, 431 bp, Triticum aestivum
  Clone ID: PAT_TA_74896
ctcccgcgtgccaagccaccgaccaacatggcagcgtctctccagccgcggctacgcttatgccggccaagatcggcgggcgggccttctccggcgccggccgtcgtcgcacgtcgcccgggcgttcggcgtcgacgctggcgccaggatcacctgctccctgcagtccgacatcagggaggtcgcaagcaagtgcgccgacgccgccgagatggccggcttcgccctcgccacctctgccctcctcgtctccggcgcgagcgcggagggggcgcccaagaggctgaccttcgacgagatccagagcaagacctacatggaggtaaagggtaccggcaccgcgaaccagtgcccgaccatcgacggcggcgtcgactccttccccttccaggccggccagtacgagatgaagaagttctgcctggagccca

SEQ ID NO: 74897 - DNA, 330 bp, Triticum aestivum
  Clone ID: PAT_TA_74897
aaccgaaggcgtcgataccgccatgcggtggttcgaggagatgcggcgccggagctgtgcgccgactggtgtgagcttcaatactcttatgcgcgggtacttcagagaaggcaggtataaggaaggccttaaggttgcttatgagatgctgcagcttggggccgggctgtcggttgcttccatggagattttgattggtgggttgtgccgtggaggcgaggctttgagggcagccgaggtgtttgcggagtttgcggtggatgcggtggtaccggaagggttagattgcttggatcttgttgaatccctatgccatgttggaagggtgga

SEQ ID NO: 74898 - DNA, 303 bp, Triticum aestivum
  Clone ID: PAT_TA_74898
caagctctgaaccccgccgcctccggaagcttctagaaccttctccccttcttccccacctccgtctccggctcccatggccgacgccgccgacgccctctcagctcggagcaaggtgcagggcttcctggaggccgcgtgctccggcgacctcgaggccctccggaagtttgggtccgcgctcgacgaggaggggaagggcgcggccgcggtggccgccggcgtgcgggacgccaacaagcgcaccgcgctgcacttcgccgcgcgggagggacagaccgaggtctgcaagttcctcgtcga

SEQ ID NO: 74899 - DNA, 364 bp, Triticum aestivum
  Clone ID: PAT_TA_74899
tttgaatcggtgggagagagagctgggcagagacgggggcgagcacatcgaagacgatggcctgcgacgtcgccgccgacgagccaccagccatccccaccgtactggagcttcgcgcgctcgacaaggcccccagcgtctgccccgtccaggagccccgcgcgcccgacaagtcccccggcgtctgcaccgtccgggagctccgcgcaggcgaagcaccgtccgccatgggcagggcccccgatctctgcgccggcaacactgagcacgcggcacgcgatagaaaatgactgtttgataaattggagcattgcacttttaagtaagttttcaaccattatttttgtgcataaaattacttatc

SEQ ID NO: 74900 - DNA, 320 bp, Triticum aestivum
  Clone ID: PAT_TA_74900
ggtttacaaggccaggctcaaggacggcagcgtggtggccatcaagaagctcatccattacacgggccagggcgaacgggaattccacggcggagatggagaccatcggcaagatcaagcaccgcaacctcgtcccgctgctcgggtactgcaagggtcggcgacgagcggctcctcgtgtacgagtacatgaagcacggcagcttggacatggtgctccacgacaacgacgacgaggccatggtgaagctcgactgggcggcgaggaagaagatcgccatcgggtcggcgaggggcctcgccttcctccaccacagctg

SEQ ID NO: 74901 - DNA, 423 bp, Triticum aestivum
  Clone ID: PAT_TA_74901
tctccgaccatgagcgcctccgcgcgctcaaggccttcgacggcaccaaggccggcgtcaagggcctcgtcgacgcgggcgtcaccacccatcccccgccatcttccaccacccgcccgagtccctagccgacgcgccccatcatcaccgtggtcaccaccagttcgccatcccggtcatcgacctcgccggcctcgggacgccgtcggagcgagcctcggtggtcggcgtgatgaaggcggccgcggcgaccgtcggcttcttccaggtgacgaaccacggcgtgccggactcggccatgtccaaggtcctcgcggcggtgcggcgcttcaacgaggagccggcagaggccaaggcgccgtactacagccgggacccgaagcggcgcgctaggtaccagtgcaacttcgacctcttccggtc

SEQ ID NO: 74902 - DNA, 191 bp, Triticum aestivum
  Clone ID: PAT_TA_74902
ccaaccttcaaggagacgatgatgagtacagtgacggagctgaagaagctggcggagaactgctgggcgttatggaagaaccttctggggctggcggaagggcaaatcaccaaggtcttctccagaggacggcgactttaagcccttctacggcaccgatgtgagccactacccgccgtgcccgcgcccgg

SEQ ID NO: 74903 - DNA, 189 bp, Triticum aestivum
  Clone ID: PAT_TA_74903
ggatacgcgcggttcgtgaatgtgcgggatgacaccggagcgacgccgctgcaccttgcggcgaggcaggtctggcgccgctgcgtccacgtcctgctggagaacggcgccgtcgtgtccgcctccagcggcgccttcggattccccgggagcacgccgcttctatttggccgcgcgcggcgggagcct

SEQ ID NO: 74904 - DNA, 200 bp, Triticum aestivum
  Clone ID: PAT_TA_74904
ttctgcatccagagcacaattcaagacaaagcagaagctacacacatagtactatagaggacactgtacacattggttcttcgggctctctcttggattagtgtttccctgcttgtcttcttggcttcctggtcatgcgttgcggccagggacgcacgggcacccagtaccggcgacccggccgatgggttcactgcggt

SEQ ID NO: 74905 - DNA, 450 bp, Triticum aestivum
  unsure (1)..(450): unsure at all n locations
  Clone ID: PAT_TA_74905
cactctccaagcgcaccctcctcgggcccctcgcctgcgactgcgaatgcnaccgccgatggtctccgggccgccgtggcacccggccccttgacccgattgcgnngccgagctcctcgggcgcataagccctccccctacccgtcccatccgacctctcgaccgtgagaagctccgtcgtgcggctcttgccgcctccaccctcccgcctccgagcgccgtcctctaccatgacgggtcgtgttcatatttacttcaagatccaatcttcaagagcattgaactcttcaaatatgaccagcttccaactgctgcgaacttgtggtacttatctaccattctgagatagctatctattttactctgctgacctgttttcatgaccatccccttctgtgcctcaagccattttagtattgacatggttacacgaaagactgtctttgtttg

SEQ ID NO: 74906 - DNA, 522 bp, Triticum aestivum
  unsure (1)..(522): unsure at all n locations
  Clone ID: PAT_TA_74906
ccaccagttcatctcactgagctcgcaggcagccccagccaccagcgaaatggccgcgtcggcctgcaccagacgaccagctttcctcggcaccgccccgcggcgcgatgacctcgtccgcagcgtcggcgactttggcggccgcatcaccatgccgccggaccgtcaagagcgcgccccagagcatctggtacggccctgaccgtcccaagtacctgggcccgttctccgagcagaccccgtcgtacctgaccggcgagttccccggcgactactggtgggacaccgcctgattgtctgctgaccccgagacgttcgccaagaacagggagctggaggtgatccactcgcggtgggcgatgctcggcgccctcgggtgcgtgttcccggagatcctgtccaagaacggcatcnagttcggcgaggccgtgtggttcaaggccggcgcccagatcttctccgagggcggcctcgactaccttggcaacccctacctggtgcacgcgcagagcatcctcgcca

SEQ ID NO: 74907 - DNA, 586 bp, Triticum aestivum
  unsure (1)..(586): unsure at all n locations
  Clone ID: PAT_TA_74907
gaaaggatgcctttcccgaaagatacaaaacaaaatcgtgttcgtgtatgtccggctgacagatgaatcgatctcctttcaagtatcaacccagcaaccttcgtgtacgtacatgttttgcttcagggatgcacgggtccattggcctgcgtaccacacatcccttcactaattccatcagtatcattcttaacaaggtaagtatgattccctaatccctgattttattaattgatctttgatgcttcatccctnatgtcgttataccttattgattctataaaagatctcaaacaggaacataccatttttgaggttacgattcctataacttgccttgtcaatttgataaaattacatgtgtaatggaggttgtaacttattacggtttacattgtcagaatgatatctgtgtcatctctgaacatatgtatatatttggtgtgccggattttctgatgtagattctatatnagaggaagctattcgacaatcctgctcaagttggtacggatcagatcgattttattcagtaaatatttatgcttgatagatacaagcctccctcttctgtccttcttttctc

SEQ ID NO: 74908 - DNA, 626 bp, Triticum aestivum
  Clone ID: PAT_TA_74908
cgccgagagagaaaaaaaaggacgaccctcgcagaggaagaggagcacgagacccgagcctcgcgccatggcgggagtagcctccctcaacgccgtgtccctgtccgcgccgtcgccccaggccccgggggccacctccgcccgcgtctcgctggaggcgcgcaaccccacgccggcgcccaccgaggcgctcaccctcctcaacggcgagtggatcctcgcgtacacatcattttcgcaattgttcccactgttggggtctggaaggctacaagctcttgtcaaggtggatgaaatatcacagactattgattccgagaactttgcggtgcagaactgcatcaagttttcaggacctttggcgtcaacttcagtgtccaccaatgccaaatttgaaattagaagccccaaacgtgtacagatcaaattcgaagaaggcatcattggcactccgcagctgaccgattccatcgtactgccagagaagtttgaattatttggacagaacattgacctgagcccgttgagcggcatatttacttcgatcgagaatgcagcgtcctccgtcgccaagaccatctccggtcagcccccactgaagatacctttcaggagcgagagcgctg

SEQ ID NO: 74909 - DNA, 178 bp, Triticum aestivum
  Clone ID: PAT_TA_74909
tcgccgccgccttctaccagtacctcgtaggccttccggatccgacgcgagggccccgtctgctgtcgccgggctccgtcggcttcctggacgggcgctggccgtcgcgggtggccacggcggctcctcttcggggtctacgcgggcatagggtacctcctcatgctcgccgtcatgt

SEQ ID NO: 74910 - DNA, 531 bp, Triticum aestivum
  unsure (1)..(531): unsure at all n locations
  Clone ID: PAT_TA_74910
gctctgactgcggtgactgcctcgcggccgctgctagaagcaacgctacggtctgccgaaccgctgccccgggagcaccaccgtgctcgcctggttcgacccgtgcctcgtccgctactccaacaccaacttctttggcaaagctgaaataggtgaaatctacgcgctgaatggtccaagagccatctgggagccgatgcggtaccgtgatgacgtagtcagaaacttgaacgagtcgatnggggccgcagtggcctcgtcgcagcgattcgcggcatcgtcgacggatccatacacgttggttcagtgcacgtgggacctgccgccggaccagtgcaagcagtgcctggacgtgctgacggccaatgcgtcgaaggactggacttccatggcagtagattgtaagcgtaggagctatagctgttctgttaggtacggcaacaccagcttcgtggttgtgccgttcggcggtgctcctacctcgcagtccgtagaccaagcaagcagaccagctactcagtccagcggccc

SEQ ID NO: 74911 - DNA, 378 bp, Triticum aestivum
  Clone ID: PAT_TA_74911
tccggaaggtgacatacggctctctgttgatgattggatcgacagggactatgattactttgagtatctcacaccaaatatgagaaacagttctcttcagtttgcagggtccatgttaccccatcatatttccaagtataaatgtctactggagctgccagtttattgcacggccatccaatgtctctcttaaacattggcagcagattggtggtgtcagcattgatgaaaacatgctaatagatcagacaattcacaataccatcaactatgaatcttctgtattaaagagatatgttgcagatattgggaaatcttggcctgtgttaatcgtttgtggggggttactccctcttttcctatctttgatttggttag

SEQ ID NO: 74912 - DNA, 408 bp, Triticum aestivum
  unsure (1)..(408): unsure at all n locations
  Clone ID: PAT_TA_74912
gctagctagcaagtctccaagctgcttgagagagggagaggaagaaggagaaggatgttagagatgaagccctgcacggccatagctcttgtgctcgtcgtaaccagacaatgtgccgccctggccaccgncgccggtcccagagtcatcatcgtcggcgccggcatgtctgggatctctgctgggaagaggctgtccgaggccgggatcaccgacttgctgatcctggaggcgacggaccgcatcggcgggcgcatccacaagaccaagttcgcctgggtgaacgtggagattggtgctaactgggtggaaggggtgaacggcgacgagatgaaccccatctggaccatggccaatggcaccggaggcctcaacctcaggaccttccgctccgacttcgaccacctc

SEQ ID NO: 74913 - DNA, 494 bp, Triticum aestivum
  Clone ID: PAT_TA_74913
tcgcattccgatacctctttggcgcaagaccagcagctgttcaacgagcgattccccagcctgatcgacagctgttgggctctctgcccgccgacgagttctcggccgaggccacggaccgccttcgccacatgctgcactacaacgtcctcggaggcaagctgaaccgcgcgttgacggtgttcacggcgatgaaggcgtgcctccaccccgcgcagcccacggagcagcagatccaggacggccttgtgctcggctggtgcatggagctgatccaagccgcgttcttgatggccgacgacgtgatggacaactcggacctgcgccgcctgaagccgagctggcacaaggaggttggcccaatggcgatcaacgacgcgttcatcatcgagggcattgtctaccacatgatccgcaagtacttccgcagccgctcgtggtacatcgacgtgctggagatgatccagaagatcacgctggtcacggagctcggc

SEQ ID NO: 74914 - DNA, 572 bp, Triticum aestivum
  unsure (1)..(572): unsure at all n locations
  Clone ID: PAT_TA_74914
ctaccacgctctccgcggtgccactcgccccgtcttggtccgccggcatcgccgggcgtgtcctgcggttcctgggggagaccggctcgccattgttcctcctcaaagctcacgcgtctgaggccaccgcagaagccaaagtcggcaactcatacgccgcgatgcgggcgctgggcttctccagcatcccgctgatcacggcggagtcggcggagctcggtctcactggggcgctngtgtaccacagctacttgtatcgccgtcgtcctggcggtggcgggaggcggtcgctggcgacagggacgttctgcgtggcgctccagaacgcagatccgacggccctgcaggcaggcctgagctgggcgtgcgggcagggccaggccgactgctccgcagtgcagcccggaggggcttgctacaagcagaacaacgtggcggcgcttgcctcctacgcctacaatgactactaccagaagagcgccagcaccggcgccacctgctccttcaacggcaccgccaccactactgccactgatcccagttcaggatcgtgcgtcttcgcaggaagcacg

SEQ ID NO: 74915 - DNA, 263 bp, Triticum aestivum
  Clone ID: PAT_TA_74915
cttttccaccgcttcaccatcaagatgtcctatcccttgatgccggagggcgctgacggcattagagatccccaccgaccgcccggccttctaccattctttcaagtccttcggtgtccccgcggccgcgaccgcggtccgcctggtcactccgccgacggagacgcgcacgtcccgcccagaatgcatctccatctacatgcctccttcccctcccgagatggtctacttcgcgaagcgcttcgcgtacgcgtacatcaccc

SEQ ID NO: 74916 - DNA, 503 bp, Triticum aestivum
  Clone ID: PAT_TA_74916
acaaaccaagccaacacatccacatggagctaatgcgcagccaccgtcttcctctccgtcgtctcactggtgatccttgcgtccttgcttagccgcagatccaaaaagaagcggtctccaggtccatggtgcctccccttgatcggcaaccttctccacctcctcacctcgcagccgcaggcggcgctgcgggacctggccaggaagcacggcccggtcatgtccctgcggctgggccaagatcgacgcctgtcgtgatctcctctccggcggcggcgcaggaggtgctccgggacaaggacctcaccttcgcgtcgcgcccgagcatgctcacctcggacatcatcctctacgggaacatggacatcgctttcgcgccgtacggcccgtactggcggatgctgcgcaagctctgcatggtccagctcctcagcgcgcacaaggtgcggcagctcgcgcctgtccgggacggcgagacccgctccctcatgaggaaggtcggc

SEQ ID NO: 74917 - DNA, 548 bp, Triticum aestivum
  Clone ID: PAT_TA_74917
tctcccgcgtaccaagccaccgaccaacatggcagcgtctctccaagccgcggccacgctgatccggccaagatcggcggccgggcctcctccgcgcgaccgtcgtcgcacgtcgcccgggcgttcggcgtcgacgctggcgccaggatcacctgctccctgcagtccgacatcagggaggtcgcaagcaagtgcgccgacgccgccgagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcgagtacgagatgaagaagttctgcctggagcccacctccttcaccgtcgaggccgagggcatccagaagaacgagccgccggccttccagaagaccaagctcatgacccgtctcacctacacccttgacgagatggaaggcccgctcgaggt

SEQ ID NO: 74918 - DNA, 338 bp, Triticum aestivum
  Clone ID: PAT_TA_74918
acctcccgcgtaccacgccaccgaccaacatggcagcgtctctccaatgccgcgtgccacgctgattccggccaagatcggcggccgggcctcctccgcgcgaccgtcgtcgcacgtcgcccgggcgttcggcgtcgacgcttgcgccaggatcacctgctccctgcgagtccgacatcagggaggtcgcaagcaagtgcgccgacgccgccaagatggccggcttcgccctcgccgacctctgccctcctcgtctccgtgcgcgagcgcggagggggcgcccatgaggctgaccttcgacgagatccagagcaagacctacatggaggtgaagggta

SEQ ID NO: 74919 - DNA, 386 bp, Triticum aestivum
  unsure (1)..(386): unsure at all n locations
  Clone ID: PAT_TA_74919
gcacgaggccccgaccgcgtgctctacctcggcccgctctccggcgagcccccgagctacctcagcggcgagttcccgggcgactaccggttggaaccccgcgggcctctccgccgacccggagaccttcgccaagaaccgcgagctccgaggtaatccactgccgctgggccatgctcggcgcgctcggctgcgtcttccccgagctgctcgctcgcaacggcgtcaagttcggcgaggcagtctggttcaaggcgggctcccagatcttcagcgagggcggcctcgactacctcggcaaccctngcttggtccacgctcaaagcatccttgccatctnggcttgccaggtcgtgctcatgggcgccgtcgaggggtaccgcgtc

SEQ ID NO: 74920 - DNA, 435 bp, Triticum aestivum
  unsure (1)..(435): unsure at all n locations
  Clone ID: PAT_TA_74920
cttcccaccatattccagttcggcaagctcgccagtcaccaagctcctcctcctccacaggaaagcaacagcgcagcgcggcttcactggtttcgcccctccattccaaaagctagtcttggaaggccttccatggctcagccgtcgctgctcctcggctctccgggcatcgattgtcctccttatcaccttcttccaaggaccggtagtgagcgccatcacgttcaccttcgccaaccggtgcacggacacggtgtggcccgggttgctctcgggctccacctcgccgccnctngagaccaccggcttcgcgctctcgccgggccagtcgcgctcaatctacgggccgaccgggtggtcgggccgcttctgggcgcgctctggctgtaatttcaacggcggcaagggcacctgcgtcacgggggactgcggctc

SEQ ID NO: 74921 - DNA, 263 bp, Triticum aestivum
  Clone ID: PAT_TA_74921
ctcctgctgcacccgacgtcgctccgcggcccgcacggcatcggcgacctcgcgcgaccaggcaatcgcgttcctcgactggctccacggcgcccgctgcacgctctggcaggttcttccacttgttcccccgggaagaaaatccggggaggatggttctccttattcaggacaggatgcaaactgcgggtatacactattgatttctcttgaagagcttgttcaagatcggctgttgatggaaaacgaacttcctgatcctt

SEQ ID NO: 74922 - DNA, 559 bp, Triticum aestivum
  unsure (1)..(559): unsure at all n locations
  Clone ID: PAT_TA_74922
gtgggatcgatcctcccgcgtaccaagccaccgaccaacatggcagcgtctctccaagccgcggccacgctgatgccggccaagatcggcggcccgggccttcttccgcgccggccgtcgtcgcacgtcgcccgggcgttcggcgttgacgcttgcgccaggatcaacctgctccctgcagtccgacatcagggaggtcgcaagcaagtgcgccgacgccgccnagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcgaggccgagggcatccagaagaacgagccgccggccttccagaaaaccaagctcatgacccgtctcacctacacccttaacgagatggaaggcccgctc

SEQ ID NO: 74923 - DNA, 557 bp, Triticum aestivum
  unsure (1)..(557): unsure at all n locations
  Clone ID: PAT_TA_74923
gcgactcgcccgtgacggatatgtcggcggcgccggcccgggaggctggatggccactttggcgacgagtggagcatcttcaagaggcggggaagggagatccttcagagagcgcgagatccagaangctgcgttcggcgccttcgggagaggatgcaaggcttcttcaaattcagatcttggggatactcaattgaaggaagggaaagctacagcgacgattgcgatggtcgttgaggatttgatggtgccggaatatacgcccgtggctgatctggtgagtaattggggagagaaggaggcagtttctagtgcgttcaacctcctggtgaatggggaatttggtgatagttccgtttcttgtgcgaaattaaagccaagagttatcaggtttgatgttgtgacgaactttgaggagggggatgactatttcaagggtacagagcatgattttggtcctcaaactttagccactgcttccagttgctctgctgttcgttcttttcagggaagcatgtcaagccaggactaccctgcggctcaggctggcaagaatc

SEQ ID NO: 74924 - DNA, 453 bp, Triticum aestivum
  unsure (1)..(453): unsure at all n locations
  Clone ID: PAT_TA_74924
tcccgaaccaggaggaacccggcgcgaggagggcaaaggaagagaagaggagaccaccgagcccagcgcgcgcacacgacagcaggcgccgcgatctcgcgcaggagcggagatngggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgagga

SEQ ID NO: 74925 - DNA, 420 bp, Triticum aestivum
  Clone ID: PAT_TA_74925
ctcccacggcgacgcgccaccgtccccaaagtcgcctcgcctcctcatgctagtacaaggctacgagcacatagctgttgccgcccgccctctctcagccgcgccagacatcgagctccacgcacgcacggggcgatcgaggaggatcggctggctagctcgggcggagacgataggcagattgaggcggcggaggaggagaaggtgttcgtcgcggtgccggcggagcccagggcggggcagtcgacgcttgcgtgggctctccgccatctctacggcggcgccgccaccaccaccatcatcgtcacgcacgtgcacgtcccgtcgcagattatacccatcatgggggtcaagttccacgccgataagctgagccccgagccggttcgcgcgttcagaagggcggagcgtgagagggcc

SEQ ID NO: 74926 - DNA, 333 bp, Triticum aestivum
  Clone ID: PAT_TA_74926
cccctctccgcctcgcagctcccccagatccaaaacccaagcgcgtgcccgcccccggaatccaaaccctagcagcgccgcccgctccctgcctgcgatgaggggcctccgggcggacgccggcggcggcggcggtggctcatcctcgtcggcctccaccgcaggtgattgcgattccttccgctgcggcgctgcccagtgatgttctggtgggctgtagtttgctgagtttgatccgcctgccttggctcgcaactcagcggccttaccgtcgaatccgtgccgcagacggcgcttctccgcgtgcttccgctgaatttcgcgtccctcgcg

SEQ ID NO: 74927 - DNA, 384 bp, Triticum aestivum
  Clone ID: PAT_TA_74927
ccgcagcagccgccgccagcagctgcgcaaaggctcgacaaaccctaaccctagtccatagctagcttagcttccttcctctcgatctagctagagccatggcgccgaccaagggcgaggggccggccatcggcatcgacctcggcaccacctactcgtgcgtcggcgtgtggcagcacgaccgcgtcgagatcatcgccaacgaccagggcaaccgcaccacgccctcgtacgtcgccttcaccgactcggagcgcctcatcggcgatgccgccaagaaccaggtcgccatgaaccccatcaacaccgtcttcgatgcgaagcgtcttattggcagaaggtttgctgatgcccctgtccagagtgatattgagatgtggccgt

SEQ ID NO: 74928 - DNA, 122 bp, Triticum aestivum
  Clone ID: PAT_TA_74928
gtgttaaattattgccactgtcatgtgcaaagttggagcttagatgcctggcccaaggtccttgtgaaaatgttaacgcaactgtgttgtacaaggaagatagttactgaacagaaaagttt

SEQ ID NO: 74929 - DNA, 121 bp, Triticum aestivum
  Clone ID: PAT_TA_74929
ccgcgtggcggagaggaaggcgcggaagcagtccgagaggcggacgtaccttgtggccgccgtcatgtccagcctcggggtcacctccatggccatcgcctccgtgtactaccgcttcgcc

SEQ ID NO: 74930 - DNA, 521 bp, Triticum aestivum
  unsure (1)..(521): unsure at all n locations
  Clone ID: PAT_TA_74930
cactcaggccttgaggcaagtggtgtcctgggtgacggttgaagacgttacaggcatctggcgcgacggcgaggagccgtacgctgcggcctgcggcggcgacgagggcccaacgttccggttttccgaccagtgcggccgcgtcacctggacaaacgtggctttcaaccgggcagtgtccggtagggagggcgccgacgctgccatggccccgtcggcggctgcttccgaggtgcgggtggtgctcgccgccnaggatggcgcccccgtgccggcgtggggctcctgtgccggtttcacctgtcgggtgcacgtcccgtacgcatgccctcgccgaggttccctcgtggccccgtgcgacgtgtggcggctagactcttgcggctacctctggcggctcgaccttcaggccaccctcagcctctccctcggcggcttcatttgactgcgtaactgcgtacgcattccttgtacggagacgtatgaaccaatcaaaatcatgtgttagtctgcgctatgat

SEQ ID NO: 74931 - DNA, 484 bp, Triticum aestivum
  unsure (1)..(484): unsure at all n locations
  Clone ID: PAT_TA_74931
aactgcgagcaagaaacgcaaagctaccaaggaaattccaactgcggaggaggatgtcgacgatgtggtcgagattatcgaagcgattgatccacgacgcaagccattgttacttcgaacaagctcaagcagcgtttgcgacagccgacgtggatggctctgggacaatggatgcgctggaattccatcggatgctgaatgccgagctgtgcgagcccatttcaaaagccaaggcgcatgaagtgatgcggcaattggatgtcgatggcagtggcgtgattgatttcaacgaattctttctctggtatgcgtccgagaaatgtcaagattatcccgccnacgcccagaccgagcggattcgagcactgctcaagaccaaacggcgtgccaaagcgacagcactggccgcgttgacggcaagtgtctcgaacggtaccaagcttcgagacacgatggcgcggcaccacaaggaacaacaattgcg

SEQ ID NO: 74932 - DNA, 516 bp, Triticum aestivum
  unsure (1)..(516): unsure at all n locations
  Clone ID: PAT_TA_74932
cgcccacgcacaacaggaggctatcgccgtcgactgcatcctgctcaaacatgcgaaacagattggactactttggcggagcaagggcagagccacacgaagcgaatcggcttcggccgtggaggccagggcggcgaagcggctcaaggccaaggacgaggaggttgagcggatcaggaccatgaactgggcactcgacgagcgcctgaggaacctcttgatggaggctcagatgtggcgcgacgtcgcgcagtcccacgaggccacggccaacgtgctccgcggcgacctacagcgggtgctcgacgctcaggcggtccgtggcagtggaagcggcgacggtcaggaggacgacgccnagtcgtgctgctngggggagaaccaggtgcccctcggcgcggaggaggaggtgggcacgccggtngtggaggagcgtccggcgaccggaacaagaatgtgcaaggcgtgtcacgacggcncggccgttgtgctgctgctgccgtgccggcacctctc

SEQ ID NO: 74933 - DNA, 383 bp, Triticum aestivum
  unsure (1)..(383): unsure at all n locations
  Clone ID: PAT_TA_74933
cactccaaacctgacaagggcaaacaatcatctagggtatcagctggaaagggtagagaaacagctgtgactgaaatgaagaagggcgactggctttgcccgaactgcaacttcttaaattttgctcgaaatcgtcagtgtctcgaatgcaaagtagattgaccaaagaagatagaagcagccaccagtgaaatgaaaatgggagattggatctgtccagagtgcgcttttatgaacttttctcgcaacaagatgtgttttaaatgtgaaggacaacggccaaagaggcagctcaaccctngagagtgggaatgcccctcatgtgattttgtgaacttccgccggaaccaggagtgtaaaaagtgcagccacgaccgccccga

SEQ ID NO: 74934 - DNA, 431 bp, Triticum aestivum
  Clone ID: PAT_TA_74934
gcacgaggggaggaatagctaagttgtttgctcaacatttggaaggtgatgtgacaatcgttatgccagccacacttgctcagtattcgaagatcatacagaatccttcgtattctgagcttcagaaagccgcaagtcaggttaggcgatgcacttgggaaaagctctctgctatcagggcaaactgcgctattgagcttgcattagatgaatgtgttgccctcctgaaccacatgcgtaggctgaagagaagtgcagaaagagcagctgcttcacaaggatatggtgctacaattagactctgtccatctagaaggattccatcatggaatctcatagcaagagaaaattcaactggttctctcgatgaggaaatgctcacatgtcccactgttacgagccatcaagcagttggagggactgctgggcca

SEQ ID NO: 74935 - DNA, 341 bp, Triticum aestivum
  unsure (1)..(341): unsure at all n locations
  Clone ID: PAT_TA_74935
caactactggtggcattttgactcggcgatggttgctcctgctcctgctcggtctggacggcatcgtcgggatcgccctcctgagatacgggcggccgtttttgttcgtgtgcatcgtgcaggcatgcgtcttcttcctgcggattcttagtcggtgacgacnggcgctgctgtgcgtggtcagttggcttaggttgattcaggccggcgttttcactccgcggctcgccggccgtttcgttctcaccggcttggtgggtttccttgcctgaaccgcacggtacggtacgcctgcccgcgcgtcgacggggcatcttgctcgggcaggaccaagagtacga

SEQ ID NO: 74936 - DNA, 378 bp, Triticum aestivum
  unsure (1)..(378): unsure at all n locations
  Clone ID: PAT_TA_74936
actgcacgaggcgtggttggactacctctcgtgcgcagccccggcgcgcccttcacttgtgacgacgacgtatcggcggggtgccatctacacctcctgcgacatcgagtgccccaagggatggacgtcgtccacacctttgccgatacggagcttggccagggtgatgagccatgtacatcgccaccaccgtanagcccgtgcaaggcgggcgtcgtctacattgttgcggacacgacccatcgtcaggcttcgttcgcaccgagtctcggctcgacaaggctgctggctacaccgacaagcttcttgagtgggcgatactgcccaagtctactccaacacccacaccaatgcacatcatcaacattgtcctaacgc

SEQ ID NO: 74937 - DNA, 123 bp, Triticum aestivum
  Clone ID: PAT_TA_74937
acgcacgagggccactagaagcactgaagaggcagagggtgtcaagcatggcgtccaatggtcttcttgtgtttgctctcctgcttgctgctgctatcctcggtctcatcaactgagcaaact

SEQ ID NO: 74938 - DNA, 375 bp, Triticum aestivum
  unsure (1)..(375): unsure at all n locations
  Clone ID: PAT_TA_74938
aacgcacgagggaggccacgacgagggcgatcacgantgtgcggagctggcgttccggtgcctccagcagaacagcgagatgcggccgccgatcagggaggtgctcgacggtctcagaggcatacaagagggcggcgccaaggcgaagaaatacgacgtcgtcgtcgtcccccgctccccgaacaccgtgcacgctccttgggacagcatgagcaccaccccgagcattagcctgtagcgcgtatggccggatcttcaaaatgtcacctcccctcctcagcaaagatgaatgtgaatngaactgtcggttgtgttataggagcgaaaacttgtagctcgtcctagtgtgttgtttcagtttgcatttgtccccta

SEQ ID NO: 74939 - DNA, 159 bp, Triticum aestivum
  Clone ID: PAT_TA_74939
cgctcacatccatcaccgtgtgtgaattaggtgtatccgtctgtctactgcatactctgcatgtgtttgcttaccttacggtgaataagtatcaccagatgtgagaacggccttgcggtgcccgggctgcgacctccatccagctcaaaacaaaattcg

SEQ ID NO: 74940 - DNA, 398 bp, Triticum aestivum
  unsure (1)..(398): unsure at all n locations
  Clone ID: PAT_TA_74940
agcacgaggctccaggacaacttctttgccagctttgctcttggttggttgatcaccaatggtgcaggtcttgccttcttaccccattgacactgtccgcagaaggatgatgatgacctccggagaggccgtcaagtntacaagagctccttggatgctttccagcagatcctgaagaaggagggtgccaagtccctcttcaagggggctggtgccaacatcctccgtgccattgctggtgctggtgtgctctccggctatnatcagctccagatcctcttcttcggcnagaagtacggctcaggcggtgcctagaggggacgaaatgatgacgaacaagagaagtttgttcccagtcctacccttcgaggatctggtgaacttttatctttttaacg

SEQ ID NO: 74941 - DNA, 488 bp, Triticum aestivum
  Clone ID: PAT_TA_74941
tgccaccctgtacgcctcacaaacaaaatctagcacaaacagacacacagcaccacgcactactacctcactcgaaacacaccgacccgaaccagtccatacctctacacacgcccctactccgccacgatgccaaacgtccagggctacgaggcgaagtactacgccgtcggctcgcccgcggccaacgtgctgcgcgtcgagatcaaccggcccgagaagctcaacgccttcatcgagcccatgtggctcgagctgggcgtgctcatgaacgaggtctcgcacgacccgcactaccgcgccgtcctcatcacggccgccggcgagcgcgccttcaccgcggggctcgacgtccaggccgcgagccagagcggcgtgctcgccggcaacagcggcatgaacccggcgcgcacggccaccggcgtccggaggcacattgcccagttccaggactgcatctcgtccgtcgagaagtgcgagaagcccgt

SEQ ID NO: 74942 - DNA, 226 bp, Triticum aestivum
  Clone ID: PAT_TA_74942
aaccaagctttaacatcattcccagcagcactggtgctgccaaggtacgccacgaacagcatattgtgcatttgttttcagacactgttttgaatggactgcttactttttcagtttgtctaattcacatctagatgttttctggatgtcacatctaagctcccacaaataacgcagcaacaaggaacagaaaaaaaagctgggacaaaaaaaaaataaaccacaa

SEQ ID NO: 74943 - DNA, 203 bp, Triticum aestivum
  Clone ID: PAT_TA_74943
cccgagacggaggagcaggggaagctgttcattgagctgaacttccccatgagtgattacgtgggttgcgaccccgccgacgagctgcccgtccatcccggagacgctcaacggcgcgtccgtcgtcagtgttcacaaatcgttgaccaccaccgacttcattgtcgaactttcatcagggaaagaggtcgccgatctccttc

SEQ ID NO: 74944 - DNA, 422 bp, Triticum aestivum
  unsure (1)..(422): unsure at all n locations
  Clone ID: PAT_TA_74944
tgcacgaggatcttatcggtggcagtactacaagcgagtgacacaagttcttgcaccgatcagatccaacttctgcgcaagatgctggacaagctgtgggacgacgtgntggccgggcctcgcccggagacgggcctcgacaagttccgccgcgccgccgccacccaacccctcgccatcaacacagctgcaggggaggcgattaagcagtcgccgtcgatgccgacgaccccgaccacgccggtaacgccgtcgtcgtcgacgccgccgcgtggcggcagcgtgtggcggagcgttttccaccccgggagcaacctggccaccaaaagcctcggcgccaacctcttcgaccgcccgcagcccaactcccccaccgtctacgactggctttacagcgacgagaccaggaccaggagcaacca

SEQ ID NO: 74945 - DNA, 606 bp, Triticum aestivum
  unsure (1)..(606): unsure at all n locations
  Clone ID: PAT_TA_74945
cacatcctggcggccgccacgtacacgctgcaggagcaggcgggggaggagcagcagcagcaggaccgcgcgggcaccgtgtcgctcttctccgtcgacgctngcgctgaggacgagtcccgacgtctccggctgctccacacggtggagaccgccggcgtcttcgacatgaagtggagccccacggcgccgctgctcgcgcaggccgacgcccacggccgcctcgtgctccggcgcctcgagcatgaagacggctcggacgaaggtgttgttctcacagacgtggttgctggaaacatttcttcatcaatgtgcttgtatgtcgactggaaccaaaatgccgattccctggccgttgcattatcagatggttcactgtctgtggttcccatgagagaggaccgcctggaggtatcagaacaatggactgctcatcagtatgaagtttggacatgttatttcgatcgtgcaagaccacacttgttgtacagtgcatcggacgactgctctttcggttgctgggatttgcgggaaagcctatcgaatgctgtgtttcggaattagaagactcatactatgggtgtgtgttgcattgctcagaaccca

SEQ ID NO: 74946 - DNA, 526 bp, Triticum aestivum
  Clone ID: PAT_TA_74946
ccccgaaccaggccacgggcctcgtcgcggcttcccaggccaatttcatgcgcgtcatagtcagctccaccgccccggggctcgagcaacaccaagggacagaccttctctgcctcgtccgcgcgctgctcaagaagatccgccgccgcgtgctcgtcggggacagggtgctcgtcggggccgtcgactggaccgaccgccgcgggatgatcgaggacgtctttgagcgccggagcgaggtggttgatccgccggtcgccaacgtcgaccgtctcgttgtgctcttctcgctggaccagccgcagcctgagcccgccacgctcaccaggttcctcgtcgaggccgagtccacagggatacccttcgtgcttgccttcaacaaggtcgagctcgtgtacaatcagatcatctcctactgaagggacagattgaagagctggggctatgatccactctttctaagtgttgatcagagatctggattatcagctcttgaagagatgctggagggacagacaactgtagt

SEQ ID NO: 74947 - DNA, 586 bp, Triticum aestivum
  unsure (1)..(586): unsure at all n locations
  Clone ID: PAT_TA_74947
gcacgaggctcctttgaggacacacaacaatttgggtatgtcttcaaaatgacaagaaaaacatttagctacatctgcagcttggttatgaagccgtcaatggaagatatgaacaactacacatttgttgacgggagggtactttctttagaagatcgagtggccgttgctctgagaaggttgcaatctagtgagctaccggagtccatagggtcctcccttggtgtgagcgagtcaactctcttgttggtaaccgagagcttcattgtggctgtggacaagagagcagggcaccattcgcgctggccagactccagcgaaatggatnaggtcaaatccatgtttgaaaagatccacaatatgcataactgctgcggtgttatatgtacaactcacatcccatttggacaatgctgggaccgtgagaagaatgaaaccatcctagtacaactcgtcattgatccagcgatgaggttcaggaccatttggtggggacggataagcagcatggaccagtcnagcattttgcatgaatcttattttttcaaggagtgtgagaagggtgctcggctgaatggcagcaagt

SEQ ID NO: 74948 - DNA, 337 bp, Triticum aestivum
  Clone ID: PAT_TA_74948
cgccgcctccgccctctgccgccgcagccgcagccatgggcgcgtacaagttcgtagtcggagctatggaggaggaagcagtccgacgtgatgaggttcgtgcagcgcgtgcgttgctgggagtacaggcagcagcccgccatcgtccgcatcaccaggcccacccgccccgacagggcacgccgtctcggcttcaaggccaagcaggggtatgtggtctaccgtatccgtgtgagacgtggtggcaggaagcgcccagtgcccaagggtatagtttatggcaagcctaagcaccagggtattacccaactcaagttccagaggaacaagaggtctg

SEQ ID NO: 74949 - DNA, 566 bp, Triticum aestivum
  Clone ID: PAT_TA_74949
gcacgaggcctcagcatcagcatcagcagcagcaacagcaagttttgcagcagcagcagcagcagcaacagcaagttttgcagcagcagcaagttttacagcagcagcaacagcaagttttacagcagcagcagcagcagcaacaacaacaacagcagcagcaacagctacagcagcaaagtcaaccacagagttcctcacagcataatcagcataatacaacactcaaaaaccagcagcaagctgctcggactcctgtctcattgactcagaagcctgattctccagccacactacaagctactaatatgcagcttgtggacattgcttctgccgattcagcttctggtgaatccagtaatcggctactctccgagaggagtattcatgatttacttgcacagatcgacccttcggaaaggctggatcctgacgttgaagatgttcttattgacgttgcagaagattttattgaatctgtcggaacatttgcttgttctttagcaaagcatagaaggtcgactactttggaagcccaagatgtactccttcatgcagagagaagc

SEQ ID NO: 74950 - DNA, 496 bp, Triticum aestivum
  unsure (1)..(496): unsure at all n locations
  Clone ID: PAT_TA_74950
tgttcatgtgcggacctttgaaatgctgcaaacagaactattcaagctttactgttcatgtatttcagagaactatttatttgcatttatcgaatgttttttgcatgcaaaatcaacacaatggaccgggtcctcctccccgaattcaacggacgtnggccctcattccccctattaccaatccatcacaatttgctaactggctnatcacgtanaacgtatatnattttttcttagatgtagcattgctccatggaaaacatgttcatgaaaattattattatttgaaacaatggacaccttgtcggttacagtaaagaaattggtgatcgtaactgagttttacacattactcgccaccaaaggaaggttgggtaaaactgaatacggatggatcttttatgaacagcaatgaggcgagggctggaatgattcttcgtaatgatcaaggggagatcatcttctcagcgtgtagggcgctctactcatgcaggga

SEQ ID NO: 74951 - DNA, 263 bp, Triticum aestivum
  Clone ID: PAT_TA_74951
tgttgcttgcagcagctgccccaagcctccaacaaccagacgagcactgagcaagccagtgcggtgcgatggaacccccgggcgcagcgcggaggagtgcctcccgccatggccgtgcccgcgctcctcaccctcctgctcctcctcctcacgctcgccctgtcctccgcctccggggctccggtcggggaggattacgtccggccgccggcccggccccgcgcgggccagcggaaggccctcctcggcctcttcccctggag

SEQ ID NO: 74952 - DNA, 110 bp, Triticum aestivum
  Clone ID: PAT_TA_74952
gtaagtttgaagtagaaggccctcttgcagtctactcttatggacagatcaagaaagccaccatgaatttctctgataaaatcggcgagggaggattcggaagtgttttc

SEQ ID NO: 74953 - DNA, 472 bp, Triticum aestivum
  Clone ID: PAT_TA_74953
gcacgaggctcaagaagatggtgaagttcatgtgtcgcctcaagtttctctcactgagaggacaccatgaaatcaagcgtctgccgagttcaataggtgatctgaggcagctccagacccttgatgtcagacacacttccatagtcaccctgccggtgaacatcaccaagttgcataatttgcagtatatccgtgctggcagcgccaccgcagtgaagaaagcaccaacccagctgtccaaccacagcggtgttcgtcgccctgttggtgttgtggttcctcgggggatcggaaaactgacagcactgcacactcttggtgttgtcaatgtccgtgcttcagcaacaaaggctttcctagaagatatcaagaagctgacccacctgcgcaagcttggagtgtctggcatcaacgagagtaacggcagcgagtttttccttgcaatcacggttcttgtccatctggaatcatt

SEQ ID NO: 74954 - DNA, 507 bp, Triticum aestivum
  Clone ID: PAT_TA_74954
tgagaattcttaattcaagagttatagggagggacttatgtcaccacaaacagaaactaaagcaggtgttggatttaaagctggtgttaaagattataaattgacttactacaccccagagtatgatactaaggatactgatatcttggcagcattccgagtaagtcctcagcctggggttccgcccgaagatgcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtcacgtatttggtttcaaagccctacgtgctctacgtttggaggatctacgaattccccctacttattcaaaaactttccagggcccgcctcatggtatccaagt

SEQ ID NO: 74955 - DNA, 483 bp, Triticum aestivum
  Clone ID: PAT_TA_74955
atgcacaaggaaaaactctgttggagaggtgaatggaaattgtctgacatgcgaatcaaagatggattgtttcgtattgacaaacaagcattgtatgatgcggatgtcgatgggatggctgaagattttaaaaagtacatcgaactcctgaatccttactatgttgtagttgaacaatcctcctcctatagtccaccatattgggaaattcttcaaactgacaccatggttataccagatccgtctaaggacccaaaggcatttcgcagatctctgaagtacatgtctgcacactttgcattcatgccgccagttagcatatatcagtttctttgcctgctatatagcacttgtgatggactaaaggcaaacagcgattaaccatataaaccattgaactttgagccggagaacaattttgaaggttggacactcaaggtctttgaagtatttctgtttaaggaggtcttcaacttttcgagc

SEQ ID NO: 74956 - DNA, 425 bp, Triticum aestivum
  Clone ID: PAT_TA_74956
gcacgaggggaataggaagcgcagcaccaccaccaccgccgtcgggcagcgacgcctggcgcactgtgacgacagacaagcagctcaacccgggagttccgggggggatatgggtcggcgcgtgacgcgcgcagaagtcggcctcccggacggcgcagattgccgcctcgtcgagagcgtcatcgtgtctatcgtcgacttcttcaacgtgcgttatatcacggggctgagttttgtcctggggccgcggcggaggaaggaaacaaccaacaccaccaccgacggcagctgtggcaacgacgaccacgacgatctcgagaaggtcctcgacctgggctacatagccacgaggtcggccgaccgcgtcatactacccgtgcagcaccatgagcagtaccagcggctactgcagggtttccacgtcg

SEQ ID NO: 74957 - DNA, 457 bp, Triticum aestivum
  Clone ID: PAT_TA_74957
gcacgagggccatcctgaattccaactttacacggtgcatacctatcagaaatactgaagatgccacgaaaaaaccacggaaaacttttccagatcttactgctacgagttcaatgatgaatgctagagatgctgctatgactgttccgaaccctctattcagacctttgcatatggttgcacctgttgatcagtactcacttgtcagaaaccgaagaagtacatccacaaatggcacatattataatcagtatgatgctagtagattacctgcggtaaattcgagcacaacaacaaccgtcatgacagcccacattgcattctttcccactcctttaaacaagggttctagtatatacgagagcgagaccagtgtgagagctgtcccaaccttgagagcatgaatagctctccttagatcttctcttccaatactccatgcgtacgcccaccaaga

SEQ ID NO: 74958 - DNA, 529 bp, Triticum aestivum
  Clone ID: PAT_TA_74958
gcagcggcagccgcacatcagcagcttgctctgttccatccggcagcaatggcggccaccaccaccatggcgctctcctcccccgcgatcaagctcgccggagcctcctacgccctcggcggcggcggccgcatcaccatgcgcaaggccgcgcccaaggcctccgcctccaacagcccgtggtacggccccgaccgcgtgctctacctcggcccgctctccggcgagcccccgagctacctcagcggcgagttcccgggcgactacgggtgggacaccgcgggcctctccgccgacccggagaccttcgccaagaaccgcgagctcgaggtaatccactgccgctgggccatgctcggcgcgctcggctgcgtcttccccgagctgctcgctcgcaacggcgtcaagttcggcgaggcagtctggttcaaggcgggctcccagatcttcagcgagggcggcctcgactacctcggcaaccctagcttggtccacgctcaaagcatccttgccatctaggcttgccagg

SEQ ID NO: 74959 - DNA, 225 bp, Triticum aestivum
  Clone ID: PAT_TA_74959
cttgcacagaacccatccttggcaacggccgtggtaggagagcgagatccacagggggctgctgggctgcctccggcagcgtgatgagctaccgccgcgggctgccggcggacggcggcgcaggttgtcgagattttgatgtttcagcgccgaactgttttcctgtttggcgcagtgcgtaagcaggacgtgtggtgaactcttgtggtcggcgacctgtatcca

SEQ ID NO: 74960 - DNA, 295 bp, Triticum aestivum
  Clone ID: PAT_TA_74960
ctctcgcagaattacatgcagctgtttggtgtcttgctcagcaatgctacttgggatcgaccaccatgtgttcctgccttggttcgcttgctgcgagcattccttcggaaaattccaaatgagcttatccaagaaggtaggctgccaaatatcttagtgatattccgtagtctagtttcacgcaggcagcatttaagattctgcattctacatgcttgacacgctagtggaaaatgttggtttggacattatcaatccacacatgagtgagatatggagtgctctctttactcgc

SEQ ID NO: 74961 - DNA, 414 bp, Triticum aestivum
  Clone ID: PAT_TA_74961
ccggcgcttgcgtcaaccgacggcgagcacggctgctagccaaccagccaaggtcttggattcgcaaagtgatacatccctgtgatcaatttaagctcttgcaatctccaatcagttaagatgagtcacatggcgacgctcgagaaggtgatgtctggcagggatcaacacactctttgccacccagtacggcctgcccatggttgatggcgagggcaggtgcattgggttgtctccaagaagcacaaggccaggacatccaattgggtcacccggtgcaactgctgttccccaatgagttcttggtcatagaatgaccttttggtagcagtactgaataataaaaaaattgttgctgtgtgcgcgtctccgtcctccctcactcttgcgtttctttcaatcgactgggcacga

SEQ ID NO: 74962 - DNA, 438 bp, Triticum aestivum
  Clone ID: PAT_TA_74962
caacctcatgtgcgtgctagccacgttctgccgttgcgggcaccctatttgccttggtatgatcgatggaagcacttgggtgatgttctggtgataaaaatgctgaaggtacttgatttcttaccatgttatatgcggttcttacctagccggcatggtgatgatttcttctctttgcttttcagttattatactggccgatacatctatctattgggaggttgttttgctatcaattgggatcctgggtttagggtcttttcatgcttggtaaaaatgtctaaactgtttgaaccatttaggcgttcacagttcaggagaataatgattctttcagttttctatttcttcacgaattcactgtctgttaacagttcaggagaaagccgtaaacaaattacttagtttttaacccagctgacatgttcctactttata

SEQ ID NO: 74963 - DNA, 429 bp, Triticum aestivum
  Clone ID: PAT_TA_74963
tgctccacaagagggccacggtatcgatatcaaagaaagtggcaaagcccatgattgcaagttgacgaaccgaaagtaaattgtatgcaagggactcaacaagcatgaccttctcgatcgtgagatcatgagagatgaccaccttgccaagtcccaataccttagaagatgaggcgtcaccccactcgacattggtgggcatagatagaaccttgtgcacatccaccaccaagtccttacttctggtcatatgatttgtagctccgctatcgagcaaccatgatccaccaccggaagaaaacacctactagagatcaatgcttggttttaggtacccattttgtaatgggtcctttgatgtttgtaacaagggtctttggaacccaaatagaccattcaatgtactcatgaagagaaccaacaaatttg

SEQ ID NO: 74964 - DNA, 679 bp, Triticum aestivum
  unsure (1)..(679): unsure at all n locations
  Clone ID: PAT_TA_74964
tgaaaattagccctaaaagcatcctcaagctcttcccaactcccaattgagttttcggggaggcatttcagccaatgcctagctngtcctttcaacttgaggggcaagtatttgatggcgtggagatcatctccgcgagccatatggatatgaaggataaagtcctcaatccagaccccaggggtctgtcgttccgtcgtacgcctctatattcatgggtttgaatccctctgggaattcgtgatccagcacctcatcggtgaagcatagggggtgcacagcacccctgtatgtggatgtgtcatggcattctgacggttgtagtgttcgtttttgattctgcgccggagcgcgcttcctagatccgtagatggacctggtcagaccggctttttgatgcaagtccccacgtgaatcgtgtgctgacttatgtgcgacatcnttagccgccctatcgcggccacggggtggtcgatccagtgatcggccgttttatttttaggctgtataggttctaaagcctcatcatcgaattcaggcagcagcttgtgctttggatagctttttgtgtggcgactgccaccgtacttttcttcagtgtccagcactttgttccatctgctgtttagcgtgttttgcggggccttaagcctttgcttctgcttcttcgactcctcgc

SEQ ID NO: 74965 - DNA, 191 bp, Triticum aestivum
  Clone ID: PAT_TA_74965
gccgcccgctaccattaccgcggcggccagagtggttttggccactccggcgaccaaatgggccgcggagggcatctaggaggagctggggacgagccgaagctcctggtggagtcagattgcgctcgcgggcggccggaatcggtgccgacggcgagcgaggcggcggccggagctcgggtgtgctcggg

SEQ ID NO: 74966 - DNA, 409 bp, Triticum aestivum
  unsure (1)..(409): unsure at all n locations
  Clone ID: PAT_TA_74966
acgagcacatgtaccggctcaagaactgcggatgatttcaatcacttggtcgtttgaggtttgggggcttgatatggttggacctttcaaaatatctagggataaaaagacacatcttttggtggcagttgacaaattcacgaaatgggttgaggcagagccagtgagcaagtgtgatgcagccatggcggttcagttcatgaaaaaggtcatctttcgctttggttttccacagcattataactgacaatggcactaatatgtccaaaggtgctatggaggagttttgtcaatgtgagcatatccngcttgatgtttcgtcggtagctcacccccagtccaatggtcaagctgagagagaaaatcaggaaatcttaaaaggtctgaagccacgtttatggttccctta

SEQ ID NO: 74967 - DNA, 489 bp, Triticum aestivum
  Clone ID: PAT_TA_74967
ataccaaggagtattacgagaagcatttataagagctaattgttcaccaggaaaactatcatcaataggtagtgggtcatcaagaacattttccaatctagacaaattattagctacaggatactcagctccctttctatcagtaatatgcaaatcaaattcctgtagcaatagaacccacctaataaacctaggtttagtatctttcttttccataagatatttaatagcagcaatatcagtgtgcacggttactttagaatcaactatataagatctgaatttatcacatgcaaacacaaccgctagaaattctttctcagtagtagcataatttcgttgagcactgtctagatttttactagcataatggataacatttaatttcttatcaactatgtgtcctagagaagcaccaacaacatagtcactaacatcacacataattttaaaaggcaagttccagtcaggtggttgaacaatgggtgc

SEQ ID NO: 74968 - DNA, 398 bp, Triticum aestivum
  Clone ID: PAT_TA_74968
tcggcacgaggctcatgaccgtcaaaggtggggcaagatatgttcctcaatcctacagtcaacatagctaaactccaggtggttaaaccgaatcacacagaacaagggagtaccttgctctgataccaattgaaagtgctagttattgactagaggggggggggtgaataggggattgttaagaaagtcttcaaaacgtgtaagttttgaagacaaacaatagaaatgacctaattgatatgcagcggaagataaactacaacaagcaaaccatagtcgagtatgcaataatgtgaaagtacaggactaatagcagcttagtagtaaggatcaggatggaagatagtatgaagccaatcagcgatagtagtcaagcaatgaagtcgaacaggtacgac

SEQ ID NO: 74969 - DNA, 252 bp, Triticum aestivum
  Clone ID: PAT_TA_74969
ttacaggatcgggtacataagttatcaagtctgcgatgtgtgagttatcatgttatttgcataagagttatcgtggtatgtttcaacgactccccccacccctacccccaccacaaagttaccaggactgggtacataatttatcatgtctaccatgtgtgatttatcattttatttgcatggaagttaccgtggtatgttacaacgacttcccccatccctacccccaccgactaagttaccaggactggg

SEQ ID NO: 74970 - DNA, 274 bp, Triticum aestivum
  Clone ID: PAT_TA_74970
ctggatcctcgcctctcttataggatgcttatccgcgcagccaggggaaaacgtaagaataccctggcttttcgcattcgtgacgacacgtggaagaaggccattattgaatgtagaagccaaggagcgcatcatttatgaagcaaccggacactatccagcaaacacatggagcgtgaagaagaacccaccttgcaaacgccgaagacaacatacgcgccgaactcatcgtcattgaagcctggttcgggggctactgagggagtcccggatt

SEQ ID NO: 74971 - DNA, 408 bp, Triticum aestivum
  Clone ID: PAT_TA_74971
tggatttctcatattgagttaaacgagacaataaccattatatgttgcgtcattttctccttatttttcccactgggtttgaagaagttttggcaacatataaaacactatgcgcctcatatttttcccacagggtttttgaaggagtctctaatcaagatgatgattctgcatgaacaagtgtagattagggggagtgttataattaattatgtggataatctccacgttgtaattaggaggcagttagccatatgctaattgtcgcatctttctctcccttctcttccaaacgccgcgtccggtggatgcgtcccctcaggggacatataatgtaaatcatcatcaatgaagaggacagctgaatcattcgttgtctctctcgctcgtctcttttttaaacaccat

SEQ ID NO: 74972 - DNA, 157 bp, Triticum aestivum
  Clone ID: PAT_TA_74972
gccatttttttggcatgccaatgaactctagccaactctagtacattttcttgccaatgtcagccaaatcatgggcaaccaatacctcaaccaaaattttggtcatgacccatagattggtctttgtttggatggttgccatttcttttggcatgcc

SEQ ID NO: 74973 - DNA, 131 bp, Triticum aestivum
  unsure (1)..(131): unsure at all n locations
  Clone ID: PAT_TA_74973
gggtgaactccatattttcttttcagtgaaactgggccgacntcgcttttgttttttgcaccgcattcgggctcaccttaaagaatccagcttcttggagcccaaccattccaccgtggagttcgtgaagt

SEQ ID NO: 74974 - DNA, 132 bp, Triticum aestivum
  Clone ID: PAT_TA_74974
cctcggggccgccttgagccgcctctgctgcgttgatccatccggttcatattgagtcgtcagtctgcctgagcctcctctattattttgaacggatcatttatcatttgaataaatcaagtgatatctatc

SEQ ID NO: 74975 - DNA, 237 bp, Triticum aestivum
  Clone ID: PAT_TA_74975
agggagagagagagaggaaggagtggaagaaggcactcgcgggcaggccgaggccgcgcaggaagtgcgagcagaagattacccgctcgccctcctccggcgccggcgtgatctccttcttcggcgcaagatggacccgcacctggtcctcgccgggcatccgccgcgtcttgcagaggaagtcgatgtggtctgcgtggacattggagctgtcccagtctccgccgtgctgcatga

SEQ ID NO: 74976 - DNA, 139 bp, Triticum aestivum
  Clone ID: PAT_TA_74976
gtggtcttggtcttggcgtcttctgcttctcctgagcttcggctttaccttggctcacctaccttgccttgctcagtgtggtggtgccctgtggctcagactgcccgtgcataggttataggggtacaaaaagtgtacc

SEQ ID NO: 74977 - DNA, 132 bp, Triticum aestivum
  Clone ID: PAT_TA_74977
atggattctcatattgagttaaacgagacaataaccattatatgttgcgtcattttctccttatttttcccactgggtttgaagaagttttggcaacatataaaacactatgcgcctcatatttttcccaca

SEQ ID NO: 74978 - DNA, 333 bp, Triticum aestivum
  Clone ID: PAT_TA_74978
gtcgggccttttgccaatcgtccttttggggctcgtttcatctggcttgcattgtagaagtggaggagacaacctatgtcacttgtcattgcatgtctctgtttcctttttcaagttcgatgttgaagagacatgccctgacttgcgagtcccccccacgactggcaactggcctcgaagtttattcccagttgcaagttcactacctacttgcaactgggctcgatctgtcttcgacccatttttttgctttagtcgcaagtctagcctcgactcgcaactgagtccgaacttttttctttctcagttgcaagcacacccttgactaacaac

SEQ ID NO: 74979 - DNA, 246 bp, Triticum aestivum
  unsure (1)..(246): unsure at all n locations
  Clone ID: PAT_TA_74979
agatacctatggcagggtcgcagcagcggaagaaccctcgcgttcttgtgggggggggcaattctaaggacggggtttgtgtccggatcgcctttcgactaggggccaattaccatggtactgtgttgatcttggagaggtatttaagagatgggaaactcgggcgtgaaattttgcctacctnatcggacggacgaacgtgttgggatggacttctaaaaccaaacgacgaacaaaaaaaaaaaa

SEQ ID NO: 74980 - DNA, 446 bp, Triticum aestivum
  unsure (1)..(446): unsure at all n locations
  Clone ID: PAT_TA_74980
aaccaacttgtgccatatgagtccaccacatctacctatatgcggtattttcgtgccgttccaagtaaatttgtatgtgccaactctaattttcaaaaggaatttcctttttgtgtacccgtaccgctcatgaagcggcaggggatgaccaatatttttccatgctagatgtgttattctcaagatgggtgtttattcacttgtcattgcacgagagtgtggcggtaatagggatgccccgtcccgaaatgaaaaataaatttactttatgttctcaaataataaattccttgggaagtgttggtatggaaggcacccgtggatacagctagccntgaattatgaaggaatggtggaaaagggaatacattttactttatgtttgggaactgcctatgatgtactccctccgtcccataatgtaagacattctttgacaatacact

SEQ ID NO: 74981 - DNA, 220 bp, Triticum aestivum
  Clone ID: PAT_TA_74981
tggttgacgggaagatgctttatggacaatgaacctaaccatccatagcttattgatctgcaacagacaatataaacatttaatcaactattagattcagatcatgcaggaacaaactcgcagccgggagttcaagattcatatcatcacacaataaacacttgccctggaggcagatcggagaggggcagatcggagggcgatacttgtaacacaagga

SEQ ID NO: 74982 - DNA, 203 bp, Triticum aestivum
  Clone ID: PAT_TA_74982
aatgagtacaaagaggggtacaactcatgacacgaacgcacgcaggcgtgaacatggtgtccagagcagacaagcaaggggtgcttggcccgaatagagaatacatcacagctgaacctaccaagcctgaaccgagatcggcaatgccaaactagcaagacttccaacataagccagaaaacggggacaccgcgagcgagcaa

SEQ ID NO: 74983 - DNA, 264 bp, Triticum aestivum
  Clone ID: PAT_TA_74983
gggtgcggaaggctcggaatccagaaaggagtccaacaccttggagttctgagctgcgcgaaggacaagactggtgttcggctcgatcgccgtagggattgcagcccccgaggcggtgtccagccacccggcctcgatcggcgcggtcggctccgagctaagggtcggagcggacaccttagcagccttctgggcactgcccggcggcagagctagatcatgcccatcgtgacagtgcggcgcgctcggctgtggctcgaatcc

SEQ ID NO: 74984 - DNA, 223 bp, Triticum aestivum
  Clone ID: PAT_TA_74984
tggaacggtgttcatcctttcatactaccatatccgcctgctggcttcttgacgcctggccacgcgacacacgtctcagatagatatttgcaaaggtatgtatactatatatttgtgaatctcattttctggtgtcgccctgtttgatagcacagtattttctaagtattcttaaagtactacagttttttaaaatcctggacctttttttaaaaaacatagc

SEQ ID NO: 74985 - DNA, 112 bp, Triticum aestivum
  Clone ID: PAT_TA_74985
tcgcatgttacatctaacaactttgcaatacagcactactactacactctaacacaataaatcatatgtgtttttagttttactagatatcatattgttacttataattatt

SEQ ID NO: 74986 - DNA, 233 bp, Triticum aestivum
  unsure (1)..(233): unsure at all n locations
  Clone ID: PAT_TA_74986
tgcaccttcttccgtataaagcttcgaaaggtgccatcttcaaactggtttggtaactgttgttataagaaaactccacatacggcaagttaagntttgaacgcgataggctcaaggtagcccagtcaaggcagaagagctacgcagattctaaacgcaaggagacagtctacgaaaccggagacagagtttatcttcgagtatcccaacttcgaggagttgagcgctttgga

SEQ ID NO: 74987 - DNA, 460 bp, Triticum aestivum
  Clone ID: PAT_TA_74987
catacggatgtatatagatgcattttaagtgtagattcattcattttgttccgtatgtggttcatggtgaaatatctacaaagacttatatttaggaacagaggaagtacttgtatagtacgtactgtaatttatcagtgagatagtacaatgctatgaagcttcccagcttctgttacatgtatcttgcgtccaaggttgcccgttgcaacatttcatcaaatacaaaggagactaacatgcatgctattgcatctcaatgattgacatatcatagcaaatatcggttcctcaaaaatatcatagcaaatatgtactccctccgtcccaaaataagtgtctcaactttatgctcaatatggactacatacggagcaaaatgagtgaatctacactctaaaatacgtctatttacatcagtgtttggagtatgtactagtagttcatattgaaatctact

SEQ ID NO: 74988 - DNA, 401 bp, Triticum aestivum
  Clone ID: PAT_TA_74988
gacatctgagcggatgcccaacaaatcatacgatgcgatgttggctgcttccgcaaatctttcccagatgcgtctgagctgccacacacctaaagtaaaatgaagaattcccttcgtgcagttggaattggatatgatatgatccatgtttgtaagagaataattgtgtactgtaaaggaaggattatgccaacttaagtgaatgctcgaaatgcacatcatcaagatggaaagatggcgatgctatgaagaggattcctcataatgttctgagacattttccagttacacccagattgcagaggttgtttcatgatgcttaaaccagagaggatgtactgtggcattctaggaaccaggagtacagagatcagaatgtagtgagccttccatctcatggt

SEQ ID NO: 74989 - DNA, 294 bp, Triticum aestivum
  Clone ID: PAT_TA_74989
acagaaacatgagcgggcggtcgaaaatgtgtatggtccattgaattttgatccaatggttgagaaaggaggagggagatcggctgacccagaattttttatcaggcgattgacaactaggccagtcccttaatatcttcatggtagtgtccaacgtgccacactagctgcatgcaggcggtagtgtatgcgtgtgcgcacagtttagaaaagagaatcgactgatcttaattgcttattcagtcaactgatatagctgaagcgtgaaactaatccaaatttctttaattcaga

SEQ ID NO: 74990 - DNA, 299 bp, Triticum aestivum
  Clone ID: PAT_TA_74990
gaaagtaaatacggccacgtacgtacatacaggcggggtctcgaacgcctactcgcgcatacgtacggccagggcttgtgtacatagttgtggctgggttggaatggagaaactgtgtcgtcgtcgtgttcatggcgaggcaacggaatgcgtcgtgttcgtcgggaggcaacggaacacgtgttgttcatcgggagccaaccggcttggatggaatagccaatggaaacaaggcctggcataccgcagaatggaggaaacggccttgtgtttggaccgaccaatggtagaaacgggga

SEQ ID NO: 74991 - DNA, 318 bp, Triticum aestivum
  Clone ID: PAT_TA_74991
tggatcccccgggctgcagggccagaagcactgcagccgtcgccagggcactgcccaactgccacaaacctaggagcaaacggcccactactggaagtggagcccaatccctataggactagtgcagtttgaacaggggatgcgcaatggtcaaggacgagtggaagtggaggaggctatgatcatggtgtagaccgtcgtggggagagaatgaatctgccaccgtgggggtggcaatagcttttttgaagactaatccaccacaagtagtcatgaaaatgcatgcgaggtaagccaatccagaatatcagtgcatcg

SEQ ID NO: 74992 - DNA, 225 bp, Triticum aestivum
  unsure (1)..(225): unsure at all n locations
  Clone ID: PAT_TA_74992
gtggaccccggctgcaggatacggcacgaggccaaacttatttgaagtcatgaaacttatcatgttgtcatatggacaccattacaaagtgcctttgtacttttttttgtncaatttgagaccagttttgatgtaatctttatcttattacaaatgggagattattaataattgggaaccacatatcccaaatggattatttatttgaaccgtgagcgttagacc

SEQ ID NO: 74993 - DNA, 294 bp, Triticum aestivum
  Clone ID: PAT_TA_74993
ccgcctcgggcaccgcgtatcattaatgtgggcgacagatggacggacgtacggcacttttgtcgtttgaaggcggagcaatcgcctgcaccgggaagcggggcgggcggcgctcactgttccgcgcggagataactttacttggagagtatgacaatggggacccaccaggtccatagcctcacgtaccgaagtgcctccttattatatatctattactatgatttattttgcttcctcctggtttcctgacatcacggtccctcaccattgtcgacctatgtagtagtctat

SEQ ID NO: 74994 - DNA, 245 bp, Triticum aestivum
  unsure (1)..(245): unsure at all n locations
  Clone ID: PAT_TA_74994
tgctctgatcgcaaacattttagatagaacacccatacgcaaagtgagagtagcgtagatttgtgcatcccttgaacgcaaatggttgttttggatgacccatgtgcaaccacgtacaaacaatttggtaagatttgtgaatccttgtaacactgcgatttgtcanaaatatgaacctaaaaatcactagcaatatctaatttttgcaactaaaattcagtaattaagcatagatttcattcata

SEQ ID NO: 74995 - DNA, 276 bp, Triticum aestivum
  unsure (1)..(276): unsure at all n locations
  Clone ID: PAT_TA_74995
gccctgcactcgggggcttagctgcagtccagtactcgcctaactataaaaaaatcttacctagtggtgagcaaccctcccactcgggggcttagttgcagtccagtactggcctaangtttaaaaaaatcctaccgagtggtgagcaaccctcccactcgggggcttagctgcagtccagtactcgcctaagtttaaaaatcttaccgagtggtgagcaaccctcccacttggaggcttagctgcagtctattactcgcccaagttgaaagaaaa

SEQ ID NO: 74996 - DNA, 363 bp, Triticum aestivum
  unsure (1)..(363): unsure at all n locations
  Clone ID: PAT_TA_74996
ttgcaaaacagattcagcataggcagcatccccctcttcacatttcaaggctatcttccggttcccatggactgtaatggtgcccttgtgacccggcatcttgagctgcaaatatacataacacggtcgagccacgaacttggcataagccggccacccaaacagagcatgatatgggccttttgattttaaccacttcaaaggttaatttttctgctctggaggcatactcatccccnaaggctacttccagcttgatcttaccaactgggtatgccgacttaccaggtaccacaccatgaaaaacagtgttcgattgtttaagatttttatccgtcaatcccatccggcggaacgtctcat

SEQ ID NO: 74997 - DNA, 411 bp, Triticum aestivum
  Clone ID: PAT_TA_74997
ataggatgaagtctttataaccaaaaatataataccattccctctgattcatgttatttgtcgctagtttagtacaaaatatcgaatggagtaataaaaaaaatggtacctaacgaagatccggtcggttgtcttacggtgcaacacatcaggtaacgggcagagaggggagacgaggaggggtggcaagtaacgatcacggtggaattgacttggatcgcaacccagtcatataggcgcttaattattctgcaattcttcctagtatggagtccgtgcgggaggatccgaaatctatctgtgcagcaggcccacaatgtatgtggcgcacagtaggcgtgtgcgctgcctcctcatctggtagcgtcggtgcggccgtgcaagctgctgctgcatgcactgaccggagga

SEQ ID NO: 74998 - DNA, 377 bp, Triticum aestivum
  Clone ID: PAT_TA_74998
atagatatttgtgagctttcctccttctaccacattcattggagatcaaggcctcttaggagaggatccacttgtggatttcaagacctccatcttggagaagactaccatcatcaagacctcatctcctaggactgggaagaactctattattgtatctttcctttgattgtgtttgtgacttttggatcttgtgttgctactctagtggatgtgtaattgggtattgttggagtgaatttctctttgtgatttcttggtgttgatccttttcccccctccgagtgtgaaaagatccatcttagggtttcaccctacaacatgttggtaccatgagcatggttgattcacatcttggagtccctaccctccacttt

SEQ ID NO: 74999 - DNA, 381 bp, Triticum aestivum
  Clone ID: PAT_TA_74999
ccactccaaaaccgtgttttaaaaactaaaatatgttgtacaggccagcccactcagacgtacgtgcttctcttatggactccttgtagtatgctctagcacgagctacagcgaaacaaaaggccaagcccaaaaacacaacatgacacgtgcagatcaatgggagaagaaaaaaaatgccaatatatataatgatgtcatgtgaatgagaccatagataaatttcagctagctgagttccaggtgctccctaaaaaaatgagaccaacccaagggctaaccctcgttggcattttttttataggagaaactcctcgagcgccgcatgtccaagccggggcttgaacttggatgggctggcagctaccccaaatgcccagc

SEQ ID NO: 75000 - DNA, 144 bp, Triticum aestivum
  Clone ID: PAT_TA_75000
cacggcagttccacctataagcggtagtaccgccctgatgggaggtagtaccgctccggtcgggcggtagtaccgctactgcattttgggtcccgtgttctgctcctccagcagtagtaccgctagggtgcgcggtagtaccgc

SEQ ID NO: 75001 - DNA, 429 bp, Triticum aestivum
  Clone ID: PAT_TA_75001
atctcagcctacccactggaaaggatacttaggagccctaactcagccgcgaagggtcgcagagtggaacatcgagttgcaagcgttccagttggagttcagcactaccagggtcatcaaggggggcgcacttgctgactttgtggcagaatggacggatgccccgacacttgaggaaggagaagaccggtccacctccccaggaagtgagcctccggacggttggatcatgtatttcgatggtgacttcatacaccagggcgcgggggctggagcagtgctcatcttgcccacccaggacaagctctactacgtcgtgcaactctgcttttagcacggcgagaaggtctccaacaacattgtagaatacgaaggcatcatagtccgcctgaaggctgcagcagccctaggggtgaagcgcctcaccgt

SEQ ID NO: 75002 - DNA, 215 bp, Triticum aestivum
  Clone ID: PAT_TA_75002
ccgggctgcaggtcagatgccgcacaccatgggagggatggaccacgcctggggcgacgcccggggcaccggcgaggggtcgagcgggcagcagggccgtcttgacgtcctcgccgccatcctggatcttcatccagagcaggtggctcctccgctggtgcaggtgactcttctgccgcggctgcttgactcctccacccgagcccgtggtcgac

SEQ ID NO: 75003 - DNA, 387 bp, Triticum aestivum
  Clone ID: PAT_TA_75003
tccaatggagtacgcgccgtactctttagggagttcggcttttgtccattcggcgacgaagtcagccagtacctgcgacttaatggcccgtcatggtttgtatgttatgtcgaacgggaggagctcgatagcccattttgcaatctggcccgtggcgttgcggttatttattatgtcattgagtggtacttcggaggccaccagattgacactcttgaaagtagggccgtagtttccgggatgccatgaagaccgcgtatgatatcttttgatagtgtgggtaccgtgacttacatagagtgaggacagtggatacatagtataccggcttttgtaatgggaatttatgtccatctatctctcattcgacgacgagcactgtgctta

SEQ ID NO: 75004 - DNA, 540 bp, Triticum aestivum
  Clone ID: PAT_TA_75004
agctaggtttgcaaggcgatatgtcaagctctgcgtaagctggtttcaatggcttatttaaacaggtgcctccttttcttttttatgtgtttttgagtctcttttgtgtaaacatagcatgtagatgtcctgtggtgtgattttatttttttgagttgagctgggtgttatcatagaattcaggttagggagatcaagaaattgtttcgtatgttagcaaaactactgaaggatttgcaggtgagcaactattatatgtgtttagatgactgaatatcagttgtacatcaatatctactgctttatatactttgtcacatacggtcacattcatatatgataaccatatctcaatcgagtgttgtttcttttttcattcagagtgtacattgcttccaatgtagcacgaacggaaaataagatactctctaaatcatgttattttgtatctggcttccactgcctcgattatgccagtacgctcacacgcacgctcttcttttatcattgctgccgtaaatcatttgttgttcaggctat

SEQ ID NO: 75005 - DNA, 504 bp, Triticum aestivum
  unsure (1)..(504): unsure at all n locations
  Clone ID: PAT_TA_75005
ggtcttccgaatactaggggcttcgccgaaatttaaaattatagaattctatggctaagtgagagtgttcaagcattatagtccgattgcctcgttcgttgtgttgagcgcctccctcgaaggacccaataatgggaaaagggagccgctcaagtttatcccgaacaccccagcactcgcggcatgggggcagaagccgacgactcgctatctctcaattttgatnagcagccgcacataaggtaatattttaaattcaaaagcgttgcttagcgcatatgaaacaagttttcagcgtacaggattacctctttggagtactcgtccgtgatacggcgggcacccttcaggacgccctcataatacatctctggcttgcgatgctccttgcccggtggtggtccgtccgtcacaagcttctcagcgtccatcttgccccaatgcactttagcacgggccagggacctacgggcaccttcgatgcatacggagcgcttgatgact

SEQ ID NO: 75006 - DNA, 582 bp, Triticum aestivum
  Clone ID: PAT_TA_75006
ggctccgatccagcagagcttcgctggagagtttcgtcagcacgacggcgtggtgacggtgatagatgttgctaccgacgcagggcttcgcctaagcaccgctacgatatgatcgaggtggattatggtggaggggggcatcgcacacggttgggagagatcaattgatcaacttgtgtgtctagaggtgcccctgcccccgtatataaaggagcaagaggggagtgccggccggcccctgtagggcgcgccaggaggaggagtcctcctcctagtaggagtaggactcccctttcctactcctactaggaggaggaaaggaaggaggagagggagaaggaaggagagggaggaaaaggaggaaagtggggccggccccctagtccaattcggtttgggctaggggggcgccctgcctcctctcttccaccacttggcccatgaggcccattacttctttcccgtattcccgtaactctccagtaccccgaagaatacccgaatcactccgaacctttatgatgtccgaatttagtcgtccaatatatcgatctttacgtctcgaccatttcgagactcctc

SEQ ID NO: 75007 - DNA, 166 bp, Triticum aestivum
  Clone ID: PAT_TA_75007
gtcacgttaaaaaaagcaacatgtcaaatctggtcacgctaaaaaaaacaagtccaatctggtcacgtagtatataaacttgcaattcctgtcatggcgtgtatagcttgattaggtatgatgaaaaaataggactccaaatatgtcactctcccccacgttccca

SEQ ID NO: 75008 - DNA, 302 bp, Triticum aestivum
  unsure (1)..(302): unsure at all n locations
  Clone ID: PAT_TA_75008
cctcgtcgccctgttcttctccgaccatcgcgttcatgtctgacactcgtcgggcccgcgcggagcgccgagccgccctcgcttcctgcgtcgcccagacggctcccgtcggcgggcgcccccgtcgttccccgtcacctgccgtccacgccgccactggcccggcggggaacgagcagcaagcatcgtcccagcacccatccatgaggcgagacggccgcactgctacaccctcgctcacccctnctggttcttcgtctcgcgcatcccgcgcggccatggaggctcgagctgcgctcatc

SEQ ID NO: 75009 - DNA, 371 bp, Triticum aestivum
  Clone ID: PAT_TA_75009
gagagacttttgtaatatttttgttacttcgcaaatctttccaaacacttgtgtttcttcgtgggtaggatgtgatccccctttttgaggtagtgttcccactattccctctataatttcatgcacaatactaggatcaatttcaataaaatttcccttggcaatgcaatccaagagctgtctatgcgacatatttaccccaacataaatattgcaaagtagaattctaaaattcacgtctcgggtgcaattgcaataagattccatcatcctataccaagcatcttttaagttttctccttgcctttgcttgaagtgaagaacttcaaactcgggagacataggagcggataaagaactagccattacga

SEQ ID NO: 75010 - DNA, 555 bp, Triticum aestivum
  Clone ID: PAT_TA_75010
cattaatttaatggagtacctcaccgtggttacgcacgacattatccattgcacccaccggtgagcaaagcccattttatgcattgcctcctccaaaaacttccaatccactcgatcatatgccttcgacaaatctaccttgtacgcacagtaagaattctgtggtgtcgccccatgctccaaaaaatgcaaacattcaaaagcaagtagagcattgtcagtgatgagtctaccgggaacaaatgcactctggctctccgagatgatttcaccaagcagcggccggaacctattgaccaaacatttggacaccaccttgtacagaacattacataagctaatcagccggaagtcctttagctcacatgggttatcaaccttaggaatgagcacaatggaagtatcattcaccccctcgggcataacacctgtctgaaaaaatttcattactgccttaacaatatccacttttaacaaatcccaatttcgttggaagaaacgcgcggggaggccgtccggcccgggcgccttaagtggcccaatctggaacaacgc

SEQ ID NO: 75011 - DNA, 574 bp, Triticum aestivum
  Clone ID: PAT_TA_75011
accacggaagaacgtgagactgccttgacagccacacactaatccagccttgctgatcaaagcccctaaaacaggtcattcagaccccagacacggttaggcaagtccggcataaataaacaaggggcttcctaaccgcgtccccctttacaaggggctgcacgaacgaagaatgagagccaataaagctcaattttattcatttcttaaatcatactctgttttaaatacatttttcgcacgatcttttttcaaactaagttcttctcttttacagatgaacaacgtgctacactcgtccaggatacagcacaacggagacaccggcgcagacgtgcagcagggacccgtcgcaaggattcttttcagattaagaccctgcgtaaaccttttttactgtctcttgttgatacacatccccccggtttcttaccataaccgaggaggaggctgacgttttggcatcggccgcatcagaagatttcgcgcgtacctcggcactaggggcttagggcatcgttctgcttgtttcataaagaccgaataccttagggagtgttcggcgtctcgagtt

SEQ ID NO: 75012 - DNA, 393 bp, Triticum aestivum
  unsure (1)..(393): unsure at all n locations
  Clone ID: PAT_TA_75012
cctgtcaggatgtgccccttcgctcgacgttcgccatggcctgtgccgtggctaccgttgcatatcgcagccgtcgcagcgtgcgatcgctgcgtcaccggcgatccctcgcagtgcgccgccgcgtgacctgcatggctgaaccgacgcacgcggaggacatgcgggcctgtcgcgcattgctgcgcaacggctcgaaatccttcttcgcggcttcgttgctgctgccgcgcgcggtgcgcgagccggcctgttcgctgtatgccttctgccgcatcgccnacgatctggtcgatgacagccaggccgacgagaacgcggtcgcgcacctgcgctggcgggtcgaacaggcctgcgccggacatccgcatcccgaaccggccgaccgcacgc

SEQ ID NO: 75013 - DNA, 518 bp, Triticum aestivum
  unsure (1)..(518): unsure at all n locations
  Clone ID: PAT_TA_75013
tggtcactagaagtggaactaccccaaacatttggtggataagaaggatggcaagggtatatctgatatacagattattgtgtaccttactagtgttcgtagtagcccttgggtatttgatactactggtcttgtcaaccatcaacacttgatgctctttcttgatttctacctttgccgatttcagcatcgcgaagagctcgggaatcgttttcgtcatccccttgcatattatagttcatcacgaagttctagtagcttggtgatnatgactagagaactctctcgatcactatcttatctagaagattaactcccacttgattcaagcgattgtactacccagacattctgagtacatgctcactggccgagccattctcctccatcttgtaggcaaagtacttgttagaggtctcatacctctcgacatgggcctgagtctgaaatactaatttcaactcttggaacatctcatatgctctgtggcgttcaaaacgtttttgaagtcccggttc

SEQ ID NO: 75014 - DNA, 273 bp, Triticum aestivum
  Clone ID: PAT_TA_75014
cgactggcgagtcgggcaggtcggtggagacggcagtgccggctggaggagtggcaggctggcgaacctcggcatgatcaccgcctcccgcaagggcgcgctagcacgcgcctcattgcttgaggcacgatcaggctaaggctggctggccgcttcaccggccggctcaacgtcttcgccctcctctccttcatcgtcttcgccttcatcgctagaggcgatctcctctgccgagtcctcaccctctgccgggtccagcccgaaccactcctc

SEQ ID NO: 75015 - DNA, 592 bp, Triticum aestivum
  Clone ID: PAT_TA_75015
accgggcgggtagagacaggtctcaaccccatcaattgtcccgtgaaagatgacgttgcgatgaacttgctgcgattggaatcacgcttggacggtgttgttgcctatctggcttagttgaaggatgcgatgacccgagtggatgccgaactctggcctcaggctgaactttctcaagacttcgagtcgctgatgactcgactcaatcagattcctgggcgagtgcaagagtggaagaagtcttctgcttgctgtggtgctgatattgccttgtcattggttcgagtgcactgcaaggaggctaaagaagacaagttggcggccctcaaggtagtgaatactaagaagcactccttccagaccttcatggacaccttccttgaggcagccactcgtattgtcgacagcatcgaccttgacagcttctgcgatccagccagcccttctcccgccgagtgactgaaaaaacattatgcttcacccacatttgcctcggaatgccgagtgatttttttatcgttgaaactccttcgggcctgacgcccgagtactttaatctgtggttagaaacctttgggcttatctttgaata

SEQ ID NO: 75016 - DNA, 435 bp, Triticum aestivum
  unsure (1)..(435): unsure at all n locations
  Clone ID: PAT_TA_75016
ccagtcagatagagccggtaagattccaaatgttatgagatttcaggcggcttcgctatttagcaggcatgtaaccctgggaccaagatgggatgacgttggattgagattatcgaacggttcagacagaatcgacagaaactattatttttcccgcctgatctataaactgcccaacaatattgcatacctatttcaacagattggcgtaatttttctaccgcatgtacaaccctataataatcgtgtttctccnaaggaaaactacaagatcaatgatttcggactcccaaatgttgtattccctctgtaaactactccctccttcccaaaatcttgggcgtctaacgtttttgcacgaaaattagcgcaggtaggcgttacttgagcggtcgtaggctggacgaggaaaattgcctcccacgatctcctctc

SEQ ID NO: 75017 - DNA, 560 bp, Triticum aestivum
  Clone ID: PAT_TA_75017
ggactgacagatagggcccacctgtcaggatgaggtgtgcttgtgtggacaatatgctgagttggacgagggtcccacttgtcagtgactcaagtgcttattaatttttcaccttttcttttttgttcttccttgttttctctctgtaatttacccgaacaggttgtgagcgctagaacatggacatcaccggcgcagccaccagagaggatgtgcgcaacgacgacgcctgactaggctgtcgtgccaggaaaccaggttgtgtatgcgggccgcgtcctggatgtggcaaccagtcggaggtggacgttgacatagccggtgtgggatctcgctggagctcggcgtgccgccgctgaacctagcgcctgtcgtggagaggaacatgggaaccacagtacccacgcggcgtgaacaacaattgcggccggcggcaaggcgtggccatgacaaggcgcgcgggaaccatagtgagtacacacagcacaaacaccaatgacggctggcgacaaggcatggccacgaggaggcgcacgataaccgcaatgcacacgcacggc

SEQ ID NO: 75018 - DNA, 168 bp, Triticum aestivum
  Clone ID: PAT_TA_75018
tactcctagtacagtgagaccagggggctactacacgtgtacaccagagaccagaccggcgaagaaacagagaggcccgtccgtcatggacggtcctcgccggctcctcgcgctcgcggtccttctcgcctcggcgttcggagcggacgccgccggcctcttcgcgcg

SEQ ID NO: 75019 - DNA, 555 bp, Triticum aestivum
  unsure (1)..(555): unsure at all n locations
  Clone ID: PAT_TA_75019
ggcacatactgttttgtacgaatgccctttggattgaagaatgctggttcaacatttgcaagagtagtccacgtcgcctttgagccacagatacacagaaatgtggaagcctacatggatgatatagtggtcaagagcaaggacaaggctacccntgatccaagatttagaagaaacttttgcaaatctgcgcaagatcaacctcaagctcaaccccgagaagtgcgtgtttggagtcccttccagtaagcttctcgggttctttgtgtctcagcggggaattgaagcctaccccgacgagattaaggccatcgagcagattgaagcaccgaagcgcgtcnaggaggtgcgaaggcttgccggttgcgtggctnctctcagcaggtttatctctnagtctgctgagtgcgccctgccatttttcaaaatattgaaaaaggcaggtccaatgaaatggactccggaagcggaggctgcgctgcaggacttgaagaggtacttgtcctccactccgatacttgtcgcaccttagccacaagagaagttgctgctgta

SEQ ID NO: 75020 - DNA, 406 bp, Triticum aestivum
  Clone ID: PAT_TA_75020
cgcacgcgggtgcgacctttcagcggctgatgcacatcgctttggggcggcagctcgggaggaacactgaggcttccatcgccatcttgatttggtgatactctgagaacgcatccaggaagcaagtaggtcgcactcggcggtggagtcgatgatctggtcggtgcgtgggagagggaacggatcttgagggcacgccttgttgaggttggtgaacctgacgcacattcactccttcccgcctttcttcagcaccatgacggggttcgccagccattcagggtatctaacctcacgaaaggcacctgccgcctccaacttgcgggtctcttggacgataaaggcctgcttatccgtggactaccgccttgctcactgcttcacagggagcacattggggcatacc

SEQ ID NO: 75021 - DNA, 520 bp, Triticum aestivum
  unsure (1)..(520): unsure at all n locations
  Clone ID: PAT_TA_75021
cactcgctgttccaagtcacgtcgaggcatgccgtggaaggtaagctttgttaaaaactcgagctcagagggcaccgagccccatcctgggtgccaccgacaaagctcaccagcgcgccatcgcagaacaaacgcggggaagattcgaacacacgactacagtcaaaagttgtccggaaccttacgaagaaatcagccggtggcgaacagacttcgacgagcaagtcacttatttggatcccgtgtgcaatgccaagagctttgacaaggtcgtccggcgaaacgggaggccggtcgccattgatggttaccatcagcactttgccgccnaactggtcgtcaagcgccaccatgccactgttgagcgacatcacgcaacgcccaaaggcaggacggacctcaggatctccggctcggagatccgcgttgaccggcgacatgatggtgcgcttgagtacagggagtacaagagggggatttgggggaactagagtaggaatcgagattccagaggtggggg

SEQ ID NO: 75022 - DNA, 379 bp, Triticum aestivum
  Clone ID: PAT_TA_75022
accaaaagagaccctagaaggttcggtaggaggccagaagacctatgggagagccacgagctcacagagcacgctccagggggtaggcgcgccccctgagcttgtgggccccacgtagctccggttgacctatttttaagcctataaattcacacatattcccaaaccaacacagagccacccaaaacacttttttcgcgccacaagcttttgtttttccgcgatcccatctagaggccttttctggtactctatcgaagggggaattgatcacggagggtgttggtgcaatgataggccccttatgttttagagtttgttgacataaacagtatgagacatatgtgtttgctaatacacacagactaacaggcccttt

SEQ ID NO: 75023 - DNA, 338 bp, Triticum aestivum
  unsure (1)..(338): unsure at all n locations
  Clone ID: PAT_TA_75023
gtcgccaaaatattactaatttttactcagttattgaacctcatgagcatacgtacgcttgtacaagtctctccctataacganaaaatatatttcatctgtactatgctagtggttatttccgaattaaatctttgtttttcaacttgtttttgtctatatttgtgtttgtttgacttgtttttttactaatgtacctattatgtgggtagtaacagtttctttaaaacacatcacatacgtagacgcttacaacacatatattcacccctgtgggatacacgcacataacctcgtcctcgtaggcgatggacacaccattccacaccattccacga

SEQ ID NO: 75024 - DNA, 509 bp, Triticum aestivum
  unsure (1)..(509): unsure at all n locations
  Clone ID: PAT_TA_75024
tggacatggacgacgtgatacctgacaagagatccaagctccacctcttttaaaccagcagatgaaatagtcaaattccaagtccacctcatacggaccctacaaaaacagcctccatcggggcacagttcaaccccgccgtgaacgccgcactacgagagttcctgcacgacaatagggacatattcgcctggcacccctcagacatgccaggaatcccacataggctggccgagcacagcctcgatattctaaagggattcccgccagtcaagaagactcttcggcgtttctctgaacctaagagacaagctatgggagaggaactagccnagttattggaggccggattcattagagaaataaaacacccagactggctagcaaaccttgtgatgatacccaagaaggacaaatcctggcgcctatgtgtcgatttccaggacctcaacaaggcttgcccaaaggatccctcccccctcccccgcattgatcagattatcaatgct

SEQ ID NO: 75025 - DNA, 221 bp, Triticum aestivum
  Clone ID: PAT_TA_75025
tctcagtcacagtcttggcccttggcttcggcctgttggcaagtttcttctgacgttgaggattagcacttgaggaagcacccactggcggcggtggagcactggaggaaccaccagcagactcagatgtgcggtaccgctttgacgttgaacgcccggggttgacacggcggacttgctgctcaggatgttcatcacctggaaccaaacacacgaacaga

SEQ ID NO: 75026 - DNA, 405 bp, Triticum aestivum
  unsure (1)..(405): unsure at all n locations
  Clone ID: PAT_TA_75026
cccgggctgcaggctctgggaaggtgcttgctccggctcccaagacgccggctggtgactccaaccgacgcccctaccagaggcgtccactcggagctcggtcttcatcgaggagcggccgtggcgtacttgtctgctatgaccagcagctcgtcgagggtagccggctcgtcgcagaggagttggtgcttgaggagggtgccctctcggcacccggcggtgaagtattctatggcttgaacctcgtgcaccccctcgcatgagttgcggagctcggctcaccgcgtcacgtagtcacgagtcgattcgctnggcccttggacgcacaaggagagctngcggggcttgggaggccgcttgtacgtgctggtaaagttgcggacgaagacttccatgaagtccagc

SEQ ID NO: 75027 - DNA, 595 bp, Triticum aestivum
  Clone ID: PAT_TA_75027
tggatcccccgggctgcaggtgaaacccaaaaagatttctagttcttctttttacttgttgggagctttcccgtgtaaatgttttattttcttttctttcctttgggggtcaagaagaccatattgaaaatgtttagtggctctcatatgcatgattgtatgaactcgacttctcttgttttttgtaaatatgatgagttcatcgtttctgagtcagctattatgaagtaaacatatttgcaatgacatttaaagattatagttgcttgtgccatgcttgattagctatgagttataattgtttaccttgcgtgccaacatgctattagaatgattatgatgtggtatgatgggatggtatcctcctttgaatgaattgagtgactcgacttggcacatgttcacgcatgtagttgaatcaaatcaacatagccttcacgatatttatgttcatggtagattatatcctactcatgcttgtactcggtgtgaattaattttaatgcatgtttatgactgttgtcgctctctcagttggtcgcttcccagtcttttgctagccttcacctgtactaagcgggaatactgcttgtgc

SEQ ID NO: 75028 - DNA, 497 bp, Triticum aestivum
  Clone ID: PAT_TA_75028
ggtagcggcatcttcactaggaaggccagaaaatttatctttcatgacaagattcaacaaggcagcattaatttcacatgtttcagcatcggtaataggagcaatcggagtactaataaaatcattgttgttggtattggaaaagtcacataatttagtattatcttgagccatcgtgacaaacaatcaatccaacacacaagcacagaagaaacaagcgaaaagagactaatggaaaagggcgaataaaacggccaaggtgaagtgggggagaggaaaacaagaggcaaatggcaaataatgtaatgcgagggagaagagtttatgatgggtacttggtatgtcttgactagtgcgtagatctccccggcaacggtgccagatatccttctcgctacctcttgagcatgcgttggtttcccttgaagaggaaagggtgatgcatcaaagtagcgtacgtatttccctcagtttttgagaagcaaggtatcaatcca

SEQ ID NO: 75029 - DNA, 344 bp, Triticum aestivum
  unsure (1)..(344): unsure at all n locations
  Clone ID: PAT_TA_75029
gcttatcttttacaggtgggattattgacagaattcatgaatgattgcagtacattcttgttggattacctctgatcgtgcgtatcattacctcatatgattgaaaatcctccactcactcaaatgaatttcaagaacctttatggtatatcaattgacncatgtatacatctaaggggtagtatatttcatcatcaagtcaagtaatgcaagttcactcttgtttgttctacattgcacctatctatcttcactttgatgattatctgttttgtcaacaaccgtccaaaaagggggagattgttggtgcaatgaaaggccccttatgtttggaagtttgtcga

SEQ ID NO: 75030 - DNA, 456 bp, Triticum aestivum
  unsure (1)..(456): unsure at all n locations
  Clone ID: PAT_TA_75030
atccggcggatttgactcctctgaagaagcccaccacagagcatgacccgaccttgaagttcaaaccggctgatgagactaagttggttgattttgttcctagcgattcatccaaaaagtttagtatcagtactactctggatccgaaataggaaagcgcgctcatcaagttcatccgtgagaaccgggacatctttgcatggaaaccttctaacatgccaggtgtaccgagggaactcgctgagcacaatctcaatattgatcctnagtttaaaccggtcaagaagtttctccgccgcttcaatgaagaaaggcgcaaggctattggtgaggaggtagcccggctcttagcggctgggtttataattgaggtttttcatacggagtggcttgcttatccggtgctagtgcttaagaagaatggcacttggcgaatgtgtgtggattacacgggct

SEQ ID NO: 75031 - DNA, 346 bp, Triticum aestivum
  Clone ID: PAT_TA_75031
gaactagtctcagttttttttttttttttttatttatagtaggtgcttagttaaactagttaaattaataaaactagttaatttttagtaagaaaatttaggtatatgggatttgataatctaattaaaattttactataggactagtttattatcagtaagaaaattaatagaactagtttatttttttagttaaagcaatttattcccgcattgacttcaacaatccctatcctgcatcctcgtcgtcaactcggcaaaggaggcctgccctcttagaggggccatgtatggtcaatcgtagggatctacttggaagcaacattttgcgaagggaaagaattgg

SEQ ID NO: 75032 - DNA, 458 bp, Triticum aestivum
  unsure (1)..(458): unsure at all n locations
  Clone ID: PAT_TA_75032
atgtagccttgcggcctagcgctctagcccaacacaagtgcctaaccgccaacaccatggcccaatatcgatccatccttcgatttttctcagattcaacgaggattattttccgtcagggatcgtgcttccacatgctcctgtaccagcataagatcgccttgaatcatgaaataggcttcataagatcgatcgaacaatacaacgtatcaactgttttaacaaatcctcttacaaagtagatnaaataggcaagatgaagagaacgccgatgggtttcgaaagctgcgtgtcgttggaggtggttgcgcgccatactggcttggagagctgcccctcgggaggtcttggcgttgctctgctcgcgaggctgaggacccttgcgagggtcttgacttggggggtcctttcatttgtactctttgttagagaagttgacgaggagctaagagtcaccc

SEQ ID NO: 75033 - DNA, 286 bp, Triticum aestivum
  Clone ID: PAT_TA_75033
tctaggcaagtgcggagtgccgcgcgccccaacagcctgcggcctcgtgttgatgcatggcgattgatgggacgtgggcgtctctgcttccccacgcttcctcggtaactgcccgacttgacgagtccctaatgcatgcagagaaaaccatcattacctataatcgtggaggtcgacggttggcttcctccaggctataaataaggagggagcagagcgtccgtcgcccatctcttcctgttccgctcgcttcttctcccttgcttcattgctagcagcgacaccc

SEQ ID NO: 75034 - DNA, 571 bp, Triticum aestivum
  Clone ID: PAT_TA_75034
ttgatcttggaatttttttggtgtttctctaatgaaatagctacttttgtacctaaaaatgtttttttggaaaaaatcacgagcaaactatgagggggttgcagttcaaatttaacccgcttccagctaaaccggtagaaatttgtctttttcacgagaggtggatgaaaacttttgacatccaaccatttggtaaattgtgcattaaatatggcctaatattttataaaattgatttggtgcaattttgcaacaattatttggtgggttcttcacaaaaaaaacatttttgccactcaaaaaatgattaaaaatagctagaaatatgaaaagtgcatacaaattggtcctaatccataaaatgtggtctaactctagtgaaagtttgtgtggtgccattttgcaaaatatttttgatagctactttataaaatccctctatttttagtatttgaaaactattttacatcactgattttctgaaccaatcataactctgtccacggattgatgacattggcgtccatccatccatccatccatccatccatctctccatcccacatccatc

SEQ ID NO: 75035 - DNA, 498 bp, Triticum aestivum
  unsure (1)..(498): unsure at all n locations
  Clone ID: PAT_TA_75035
gctttgaggaaggtgaccttgttctttggcgcgttcaatgggccaagaattccaacaagttgacgcccaagtgggaaggcccttatcaggtaatacgagtcaccaggtccggcgcagtccgcctggagaccgaagatgccattccagtgagtaactcctagaacattgagcatctttgcaagttttacctgtgaggcgcggcttgcccccccccggaaagccaccttttgtacgagccttgccgataacgcatgtaaccctttgtacaaagccaggcgcagaccctgagcataaatnaattaagcgcttgcgccctaagttatagcatgcatgctaggtcgagtctcgtccttagttagggttgatagtgcttagcgattactaacccctagcttagaggtcgagtgtgcgtctctttgtctttcttttgtcttctttggttcacaggacacacagatatccttgccgaacaacttggggagaaaaaaaggaacatac

SEQ ID NO: 75036 - DNA, 159 bp, Triticum aestivum
  Clone ID: PAT_TA_75036
ctatctcgacgattgacgattttccgttctgcgatgccattttgttgtgaggtgtgaggacaagaaacccggtgcgcaatgccttctttttggaaataacgggagagacggcgatactcgccgccccaaatccgtctgaacagttttaatttttgcatc

SEQ ID NO: 75037 - DNA, 333 bp, Triticum aestivum
  unsure (1)..(333): unsure at all n locations
  Clone ID: PAT_TA_75037
gagagagagaggtagtgtcttttctcccaatagggagataaagcggcttaaggcagccacgcatccagttaatttctggatttgcttgaagtctgttgggatagcccactgtgaacagagcctcggattttagccggatttgcttcaattcctctattggaaaatgatgaagcccaagagctttccggcgggcatgccgaanacgcatttttccggattgagcttgatgtcatatgttcggagattgtcgaacgtaagcctcaagtcgtcgattaaagattcaacgtgtctagttttgatgaccacatcatctacgtatgcctccactgtttt

SEQ ID NO: 75038 - DNA, 403 bp, Triticum aestivum
  Clone ID: PAT_TA_75038
tgcgagctctttctctctcccccctctccctctcaccctctcgcgctaaatacatgcattgcctatctagccccccaacctctcgtgcatgcgcacgcaagcacgttgtatatcttggttacttccttcaggactgtctcactctttcctccacacggcgggccacactcgttcgatctcgctctctttatctgagtctcatttaacctcgttttctttcacacataaatgctatatctccctgttcgggcctcgatcgacatactctatactctctcatgcagattgtctatctaggtcagtatgtcgccaccaccactctttcgacctcatggtgggccatgctcactcaatctctctctctctctctgtctccgtatgtctcgattgacctctctctttc

SEQ ID NO: 75039 - DNA, 489 bp, Triticum aestivum
  unsure (1)..(489): unsure at all n locations
  Clone ID: PAT_TA_75039
ccatatcatagcaaacaaaggcacggcatgattctactaaatgcatagaacaaaagtcccttaatgatcatcagccaaaaaggcaaacttgcccatgttaacatagcaagttttattaacagttaaaaactttgcagaaaaacagagcatggcattacacagatttatgatagcaactttgccagctcatgccactcaccacaaggcattgcatgacaatataagcataccaatagcaatatgacatgttcatgaagctaaccatggcaacatcaagaaaataggatgcatggatcactagcaaaaaccatggcaatattgattaacttgttnacattctgccaggaacattttatagcacaagtagagcacgaacagttcatgctagagcactccataattgcaaccggtggcatgaatggatagagaataaccacatgttccaaacatccttactgaagtaactcacaataagcatggatgtcatga

SEQ ID NO: 75040 - DNA, 378 bp, Triticum aestivum
  Clone ID: PAT_TA_75040
atttaccccatgaggtcttcgctctaacttggcatgctgatgttggtaatatcatgcatatagtgccttgcagtgcttactgtatacatcaaagatgtcatctgcttagtttagacatgctttgtgtcaatgccatctgtttagtttctttatcgtatatatgaatcatgcaatgccatcttgtttagccaggcatcatatatgtgaattttgcaatgccaccctagttagcccgtcatcttatatgtgaattatatcatgacatcatttttttattatgtgttaaatttgtccaaaaatttagtacattccattactcttcctatgcatcagccattccgcacggtcatggaaaaatctggagtggaaacatggtct

SEQ ID NO: 75041 - DNA, 486 bp, Triticum aestivum
  unsure (1)..(486): unsure at all n locations
  Clone ID: PAT_TA_75041
ccagggcttgaccctgggagtccactccgagctgctgtcggtgactgcggttgagtcgtccggaagggaagctttccccttcttagacgctttggcctccaaacgcatggaggtcgtcctcttctttctacccccttgcaggggggaatgtctttcttcgtcttcctcctcttcctcgtcgtccttggcggaggagtgagcctcggcgtctttggacatcacgtctaaagtgcccttgcggcggagaccgcccctagtctccttggcctccttcttggccttcttcttcggtgctttatagggtgcctgaaccagcatcttcgtcagaagtgggcctgctaggtcttcgggcaacggagccngacaataaatccgctccgccttctttgtttatctctgagaaaattagtanggaagcttagccgttttcctcaagtatgcgagttaagggtacaccttgaaaacatgtatagacttaccagacta

SEQ ID NO: 75042 - DNA, 272 bp, Triticum aestivum
  Clone ID: PAT_TA_75042
gaaccagtgaagaggtcagtatgaacatccatttttggtttcaaaactggatagagttataagttaactgacaaacctccaacaaaatataggctcagctagagaacaatcaagtaagcagtcctgccatctaaatgcaagaggctgacccacaatcaaccgttagcataacccgacaacgaagtagaagaaaacaacaaagaggagggtaacttccacagcccactacaccccacaccggaaactcataatggcaggaaagaaaatgaacc

SEQ ID NO: 75043 - DNA, 344 bp, Triticum aestivum
  Clone ID: PAT_TA_75043
ctgagacgagagctttcaattatgccgttttggtcaaatcccagggctctttctgatttgattaaatacttctatgttgtatgataatagaaagtcaagatctcactcgctttttctgcttttctcggctgttgcctttttccacatcgattgctataggggagtccatcctcaacctatgtatgctcaaagaactggatcacggaactctcagcccttcgccccaaggctacgaaaacgtttctactccctttcccttcccaacgtcatatctttcttcgaccagaaggacagatcactctttatctaagtgatagaaccactggcacggtacctttcacatt

SEQ ID NO: 75044 - DNA, 450 bp, Triticum aestivum
  unsure (1)..(450): unsure at all n locations
  Clone ID: PAT_TA_75044
ccagcaccacgcaatgcggtcgatcggcaaccgcgcggccgggataaaacggcaaccctagccgaaaaacagactgttccacctcgtcgtnaaggccaggataagacagctcgggtctatacatattaccttcgtcaagacctagacagtagagcaggacatacaagatcgatctacacggatcgcgaggacgtgccttgacacgcgacaactgctacctattcggacgtgacaaacctagtcacgcccgggccgataaccatatacggactccatcagagctacgtcgcgacgcggctcaatatagaggcgccgcacaccctctgtgcttccctgataaagtaatggaccatgaattccccgaagcgttcaaatcctttccatattgaatcatacgacggaacaaccggtcccgcggtatggaccgaggattttattctccacattcac

SEQ ID NO: 75045 - DNA, 482 bp, Triticum aestivum
  Clone ID: PAT_TA_75045
agaaaaatccttcctcatcttgactgtgaaatattgtaacccgccatgatgtcatcacctgaatttattgtaacccgccgtgacgtcacctgtcattaatgcttcacagaacccaaatcttaataaatctcttactttactgtctttccggaaatcgaggcgcccgtatcatcacttatccatttttgcctcctcgattttcgcacctgtcgtctgtccttccaggctttataaatgagacctcgggctctcctctcattcccccctctttccttcccattttcttcttcctccttccgacgcgccgaccctcacaagctctgccgccctcgacctccgccttcgtcttcaactcctgccgctgcatcaccctgaacggaccagagaaccacggcacctccccgccatcttatcagcaccggtaagcccttctttcctccgccatagatctagcatttgggtttctgtcaaagtcgtttacc

SEQ ID NO: 75046 - DNA, 567 bp, Triticum aestivum
  Clone ID: PAT_TA_75046
cggagaagcccggcacgttcagatgctcttttgcccacctgaaactcctttttttgctcttcgacgtacccatccgtcaaaaccatgctgctgataaacttaagcctgatggacaatagtaacctcgcattcagcaggaagaatgtgacacatctagtgtttgcacggttggctacatatcgttctatcattattgtcttcaatcgaatcttatgagaagtgagaaaatcctgatgcttatgaatccaccgattggttataactttcttaccccgtcctgttgcctaaatagacctgaagattgaaaacagttcaggtctaaaaaaagagtgtcgaaagagcaacaactgaacggttaattctagtacactatatgcgggcttccaatgtgcgccaaattatcacctttatatacgacttctccagacctgcaaagcattgcagcaagccaataatcttgttcagatcgaaactcttcatttggatctctcagatcttgacagaatccagcaccattgattggccatccatggagaaactcttcattgagcatagaacatatattgt

SEQ ID NO: 75047 - DNA, 492 bp, Triticum aestivum
  unsure (1)..(492): unsure at all n locations
  Clone ID: PAT_TA_75047
ctcgacttgttctcattaccgcagatcacaagaacaacaaaatgaaacagtagtcaattcctcaattgatggcttgcgttcggtgaaggacatctacttatcatatatataggcttcgtcagctagtagtatttaatgagtattattcctaataaggtaattcttaatgttctcaaataaatagtgatgatnatcttcctttaaatgagacgaatccgatgtgcaacattnatttgtagactatcaaatcctatcaatgcaaatggatgaggatgcatgaatttatttccttcttgaagatatagtgaaattttttacatgtgttaattgtatgtcaaatatttatgtatactagtagtatttaatgttatatttatagtaacccaaaatttggaatgcagaaatatctttagtacactgaggttgctnaggttgacatttaaaacgtgctaacaaaggatggccggaaaccatgatttgtgattgtgtacc

SEQ ID NO: 75048 - DNA, 297 bp, Triticum aestivum
  unsure (1)..(297): unsure at all n locations
  Clone ID: PAT_TA_75048
gcttcttcaacctctggtcttcttgctccagccgcccaagccagcgctgtcgtgccgcatgctcctgcctcccgtggccggttgtgctgccgcagaggcctcaccgccccctactattcccaccgctagtcaggccctgcggcgcgatgcagcctcacacgcgggcttccactgccgcgtcgtccccttcctaggcctcaccgtcgtccaccgccatggtgctctccgcacggcgtggtcagcatggtcnaggaacgacttccatcggaagagtactgtacgtggagaggctgacag

SEQ ID NO: 75049 - DNA, 442 bp, Triticum aestivum
  unsure (1)..(442): unsure at all n locations
  Clone ID: PAT_TA_75049
acaaatggctagctagtctaagtcataccagactagggatgtgacatatcctctctccagaagcgagccaaggacaccgcctccctcctgaagaaagcttcgaatgaaaagatccaccatttgacactggaacgcgagcacggctccattctccaaggtttgcgcgtntcagagctaaccatgccttgggtgctatctataatgagagcgctcctcacccgtacgagagtgactatactagccatcttaacttcttcactgatattgtgacccgcctggaggatcaggctgcgaaggctcggcagcttcttgaggagaggagccggggcctcctcgggcatgcgctctcgcgcgtcttcagcaatctcctgaaccatgattcccactttgatttcnacaccgttctagcccccttgcatgcggctaccctagacaagctcgc

SEQ ID NO: 75050 - DNA, 458 bp, Triticum aestivum
  unsure (1)..(458): unsure at all n locations
  Clone ID: PAT_TA_75050
gcggggagcggatggtgaaaatgtgcttgaaaagaccctagtgcgttcgacaccccaggaaattctcgcacatggacacaaacgcggcaagataggtaatggtgttgggagaaaaatgatggagttgggccccgaagaaattcaagaagccctggaaaaaagggtgcggacggaagtgacgaaccacggtcgacatgggttgcgagcaaaacacactcacccggccgcggctgcggctccgtttccccctccggcaaccgcgcagctatgtggacgatcagcccggactcggccagctcgtccaatcttcctgccgaagcggagatcggatccnatcgccctggatccagcctgacggcagccccgagcgtgacgaagatccccgattcgtcttcttgcctttcgccgcccccgtcgccttcttcgtgcgttccagcgccgccgtcttttccttcccc

SEQ ID NO: 75051 - DNA, 171 bp, Triticum aestivum
  Clone ID: PAT_TA_75051
tgcaggcatggcgccgccggcacgttgtgcgagttgctgctcgtgaagctgggaatcgcgggcggcccctgttggccgcccgcaatccacgcctgcagcccctcaatcaaggtaggcataatggcggtgatcgtcggtcccaggttggtctcgcacttgctcttggactat

SEQ ID NO: 75052 - DNA, 317 bp, Triticum aestivum
  Clone ID: PAT_TA_75052
aatcatatattccatgtccaaattcgtattatcttgtcctaacagtatcagtttgatgacagagactccggtgaatcccatgagtgctaagtccggttaaatgttattcctgtgggtggactaacctgtttattatcatgaattgaatatttttatgagtattatttacttgtgaataaatccctttttgtgatgtcgccccgacgtccgactgtggcatttcttttaaagccctttctgtgatgtcgccccgacgtccgactgtggcatttcttttaaagccctttctgtgatgtcgccccgacgtccgactgtgg

SEQ ID NO: 75053 - DNA, 173 bp, Triticum aestivum
  Clone ID: PAT_TA_75053
tagcgacttatggcgttgagcattcccttgtccgtgcaatttttgcaaaagagtgaaattgcgtcttcctcgcgatagtccttaaccttgctcattacaaggaggaatctagcccaaaagtgatgtactatctcttgggattgttgtataatgtgggaaagattgcttgtatc

SEQ ID NO: 75054 - DNA, 545 bp, Triticum aestivum
  unsure (1)..(545): unsure at all n locations
  Clone ID: PAT_TA_75054
gctcttgcctacatcctgcgaagcgcccgaccgtctccctcctgccccatccgtccaggtatggtactcacaccagttcaagtagtgattttgcaacaagtacagctcctcccctatcaatcttagtgagacaaaaaagagcatcttgatggatgattgctagcntcgcttcatcatcggcagattttcccgtctactggcttgtggttaattccttctatccttctgttgtatctttatttggagacttataattcaagtcattgctgcttttacctctagttagtagagatgcacaacaactattcgttggaatgccgctgacaaacttgttatggacttataataaggcggtaggaattactcgatggatttatactgtgtgcttctctnattcttaaggaaaatgttctttttctgaatatgttcaccagcgtgatgcatgtggtattcgattgatgcattttgaactactagctcacttgatacatatgatgcgttcctatactattgtatgatccaatcttttgatgtacgagcggaaa

SEQ ID NO: 75055 - DNA, 363 bp, Triticum aestivum
  Clone ID: PAT_TA_75055
tccaggcgcccggccactaggtgcgggtccgcgcctaggaggtcttcccgcagcttggtcatccccgaaaagacacgctccaagactattgaggaagtagaagaacttgggggccgaaggcactgcaggaggaggaggcgacgttgttactagagcctgggaagatcaagggctccggagcctttgggacctcatcagccgagccgggtgcaggcacttccagagcctgcggggccacgggggctgactcctcctgccgttgctcctcttggcctcgcgagggcgaccgggctggggaggtgcgagtgttgtcgcctctcttctccacagaggggggcacggccgcggcatcctccttcctct

SEQ ID NO: 75056 - DNA, 335 bp, Triticum aestivum
  Clone ID: PAT_TA_75056
agagagagagagagaagaggagagcaatcccgaagatacaaattatgcctatcatgaacacatggctcttgcttcaaggaaattttcgagcaagaagaacacaaggccgaacttcaaacagaataactcaagtggcacgaaggtcaagcaacgagtgaggacttgctatattgtggcaatgtgagtcactttgtattgaaatgcccttatgagaagagggaagacaatggtggcaagctcatctgaaaagacgaggccaagtccttcccaacaagagcaacttcatcaagaagactcctcccaaggggttggtggcacaagaagagtacaatgag

SEQ ID NO: 75057 - DNA, 526 bp, Triticum aestivum
  unsure (1)..(526): unsure at all n locations
  Clone ID: PAT_TA_75057
atttcatttttttaatttgaaataacacgttaaagccactcacaggtgctccctgcaaaaatcatacacatgtccaaatagacaagcaatacatgtcaaaatatcatcatatatnacaacatcatcaagctttataacttgtttaaaatggagctaagtttctaaatttacaaagtatgcaagttttatatttttctgcagtataacatcatatatnagaacatcatcatgcactacaacatcatcatcatgtacttttaatactactacatgccaacatttgaaaacaaaattaatactataaccaaacatttgaaaaaagtgaagatcctcaccttcttccggcggcggcgatatgggagggatggatatggcggcatcaatgtgggaggagggagagggtggaggagacctgggagggcggcggcggcggcgatgtggccnaagggagtggaggaaggagggaggagggaggaagcagaggaaggagggaggaagtaggagggagggacgagggaggaagggg

SEQ ID NO: 75058 - DNA, 431 bp, Triticum aestivum
  unsure (1)..(431): unsure at all n locations
  Clone ID: PAT_TA_75058
gagagagagagagagagaactagtcggtagataacaggttttgcacgtataagcattagtgttgtcaattcatctcatttctttgtcagaaataaagagacatggtttaaaatagcattaacataataggcattgttcatagttnagatggcaggaaatggcaatgtgcgggagcggccagcttcaccggaccactggattacagatcaagaacacaagcatagatatagttctaaaccacgtataagcatgaatggtgagtgcactctcaatttataccatttaagattagtaaataaagagaaacgatttaaatcacatttatattatatggcattgttcatagttgagacataacaggatatgacattgtgctattgttggtagtctcaccacaccactggattacaaatcaagaacacaagcataca

SEQ ID NO: 75059 - DNA, 431 bp, Triticum aestivum
  unsure (1)..(431): unsure at all n locations
  Clone ID: PAT_TA_75059
gttttgagatcaaattggtcttcaaatatttttctttttttacagcaaaaagtggatttgattgttgtacatcacttaggtcctcccatcactcgtacatcatgcctctcatgtaatcaccgccacggtaagagaactggctccctctcgtgcaacccccaccatgggtaaaagaatagtggcacaaaaacgtggctnacgaggtcctgctcatcattcattgtgcagcctgatgaacttcttggaattcttccattagcggatcgaanagcgcagctgcacgaggatctggcccccgccattgaggtctcgtttgtgagcatgaacaagagccagcgtgagacgaacaacccaagccgatttagtagatgtcatgctagaggggtgaggccgagaacagtgcccataaggcgtccagtctagactaaaca

SEQ ID NO: 75060 - DNA, 446 bp, Triticum aestivum
  unsure (1)..(446): unsure at all n locations
  Clone ID: PAT_TA_75060
cggcgacgcgccatgcttcggcgagaccggatacctgtccagcactcccaagaaggcacctgaaagctggccctcagagtggttttaaattgatgacgttccccttccggatccagttcggacgggtctcgctgagttcagtaacgctccgccgaaggcacgccnaagtttgcgccctcagggcccccaagaggaggataccagagaagtacacttcctgatgagcaggataaagatactggccaaattaggactgacaatagtcgaagttatggcgatatgcataatgcaggagtgcaaccgctgtaatattgggggaagcccatgtggcattacaacggggaagacgatgccacccactgtcgtaaaggtccggactccgccactcctccctgcaggatactgtcctatttctaccaaggggaagaagaagaattccttcatat

SEQ ID NO: 75061 - DNA, 434 bp, Triticum aestivum
  Clone ID: PAT_TA_75061
ccgggctgcaggtatcatgctctgcttgtccttgggaaggatatacccttgaaatatgttgttaaacataatttcctttccactgttctgtttaatctgatgatcatattttccttccattgttggtttaacctttcttgtgaactatatagaatctgagcagtaatattctcctgctgatgtaaacacctcgttgtacaattctgtcagtaagaccctgttacttttgttgatgacattccggtaaccaccgatggacgagaacttcgcctactggtccgcctcattcaacgagcaggaaaatggttctcttcgtccctcgcccttggtaccaacgttgttgccgacataactgacatggtactctctgacatgccttgctatcatgaccgtgtaagatgtcactgctcctgctaaaaaacaaaaaaaaaaaa

SEQ ID NO: 75062 - DNA, 502 bp, Triticum aestivum
  Clone ID: PAT_TA_75062
ctgactcccaatagtaggtcggagatctcaacgagcaccaccaccacccccgcgccacgcggagataagaagctaagatgcaccgagccccttgaaccagacgtcgtgccgccctcgcggccacaatggcagtcgttttcgccgtagaaatccggggctccggcgcagccgccccgacgcccatctccgccataacaaccatgtcatccagggccaccatgtagctccagccgaagatcttgcgatgcgagagatgatggggcctccttcgccatcagtcgcacgagaaggatgaggacccaccaccgccatcagcctagcggccttagattagaggtgtccttcggtagtgacgaggggaggtgggatgggaggaggaaggggcggcgtctgcgctcgtgggtgttagatagatcgatggaagcattcctactcccgattgggagccgtgtgcgtttatttctgagagaccggaatagcccctgtcgtggcgtacaagtct

SEQ ID NO: 75063 - DNA, 549 bp, Triticum aestivum
  unsure (1)..(549): unsure at all n locations
  Clone ID: PAT_TA_75063
gtggcggaaaatagatgcttttcaatattcgagcacttagagattctgggtcttgtagtatttgtcaagcctacctttctagcatagctaaattaaatagctcaaaatctttaaaccccaaaccctccatacctttgggttttgtcattgtctcccatgggacccaatgagggtttgcgctttccatccttagagccccaccataattttctaattaacatgttgagatgctcgcataaccatcttgggagtttaaagcattacatagagtanattgagatggcatgtgcaaccgctttgaccagtacctccttgcctgtcgtgccttgcagcttactccaaaggcaaaccttcagatacttaaaggccccattcttcgaattgctaatatcatatggcatgtaagtgtgtctcaaaaaaaagatggcatgcaagtatttttcgttcaaagtttcatttgggacattcagcaatgttttgatctccaagcgggtactgtctggaacccctttactaaagaagattgaggatttgctatggttcacgcgc

SEQ ID NO: 75064 - DNA, 323 bp, Triticum aestivum
  unsure (1)..(323): unsure at all n locations
  Clone ID: PAT_TA_75064
ggccccatcctcctcctccttccacatcccacatgccccgaccgccggcgcgagcgtgacaccttccacccaatcaccgacccctccaccaaataagcgtcggcctaagccatggngtcacacattatagccaggacctcaaggagcatttggcagcggagaagaaaatcgcggccgcacgcgcggatgaggtcgcgatggctgccattcgtgccgacccccagatcttggaggagcacctcaccgtcgaggccaccgttgacgcctcacacgctgacgccgcgacgtggttagttgctttaaacgacagttcgtgccgttnt

SEQ ID NO: 75065 - DNA, 256 bp, Triticum aestivum
  Clone ID: PAT_TA_75065
agagagagagagagagaactaggtgcttaccaaagcagggaattatctctgctcagttaagtcagattacaggaaaggtttaaacaaaataatggaaaggaaaacgcgattatcagattaaacaaaacaatggagaggagaatggtgattacacacaattattaggagtatatacttcccatggaacagcagaacatggcatacagggtaggagagcaagtacccaaccattcaggtaataagcaaggattaatcc

SEQ ID NO: 75066 - DNA, 547 bp, Triticum aestivum
  unsure (1)..(547): unsure at all n locations
  Clone ID: PAT_TA_75066
agagaactagaataagtaaaggcaaaagatagtggggatgatacgataccggggcacctcccccaagcttggcggaagccaaggggagtgcccatacccgatactcaattttcttttggcgatnaagaagaaggtggtggtgatgaagaagatatcttgtcctcgggtttccatggcagaggtccaccatcataagaggaggagtaagtctcacgggtcctgcaatcggcagccaaactcatacctttaaacctcacctcatattcgaagacttggttttggagatcgtagatcttgctctggaggaagttgatttgctcgttgagggtgaagatgatgtccttcatgggttgccatccaccttgagatcacgggaaaggtctgtgatcatgaggtgattggcattgagtccacgctctaccaaccccttgcaccggaggacctcctgctccatagcttcgagcctggcctccaaggttcccgtccccttggacctggtacatcgcggaggtaagcaccccctcatgcatctgatacctgagggtgt

SEQ ID NO: 75067 - DNA, 488 bp, Triticum aestivum
  unsure (1)..(488): unsure at all n locations
  Clone ID: PAT_TA_75067
aaaccctatgtcttcaagcgaagacaatgagagcaaatcttatctagagtctgatgagtcagctttacttgtagcccaagtcaagctgccgtgtgtgtttgaaatctgaccgttgtgacacgtgtcagttccttagtgacccaggggtcatttcggacaaatcaggtcgggtttcctagtggctataaatagcccaccccctacaccataaattggttgctgctcaaagttagtacacgacttttgtcgtttgagagcaacccacctccgaagcctttaagagagagaaatccttgcgaggacnaagcccaaaacacccagagcccaagagtgtttggcatcactgaagtctttctgtccgcgtgatctgaagacttgttacacttgaggactgtgaatcctccagttggttaggcgtcgcgttctgagcatcccagagtcattgtggattgcccgtgaacgaagtctgtgaaggtttggaggtctac

SEQ ID NO: 75068 - DNA, 499 bp, Triticum aestivum
  Clone ID: PAT_TA_75068
acatattacacaagttgatacatcgcatggcgtctatgcgtacttagtcggagacggtgaggatctcccttggcctgccgagggtgagacgcagagacgctagggaatcaacctcctcctcgctaataggttccagactagaaacgttgtgctgagctagtggagctggtgccgtaggcggaataatacgaatacgagtgggtcgaataggtagtgccgcatgtatgggagtgggtacaacaagtggtgtagagcggacgggagtgggtgcaatatcctggttaaattcctctgtggtaggcagacgacgagcagtggcaagtatggtaggtgagtgagaggttgtggatgacagaaaagtcaatggtggagcggtgtgcaggagttccctccggttagcagcacaaccatgaactgagtccatgtgtgcagctacgaggtcgtccaccatgcagtcgaatgctgcctccagggctcggaggtactcgacaagcatctc

SEQ ID NO: 75069 - DNA, 530 bp, Triticum aestivum
  Clone ID: PAT_TA_75069
gttatcaccccagacaacttatttggcttcaagcatttctctattgatcaccagtgcgcagtcaagtttgctacaacaaacttcagagcttagttccaacccaaccacagcacctcagaccaagacatagactcataaatgctccaccctggaaggactagccaccagacgaggtttgcaattccctcgtgacctccctgtgcattgtctagtggtgaccgcgcagttggcatgcttgtgcacgcgctctgtgcgtagtggccgcgtccagggcgtcatttgcgcttcggcctctcttcctcccgtcggcttcgcgcgcgtgagcatgtccagtgtcttcctctcatcgtcgtcgttcccctggacccctctccccctccgtccacttcctcgtcggcgctcgccgtcgcatgcccacgagagcacagtgccgacgtggcattgaatgcgctcgtcttcttcctccccttgctcccttggctccctctaccccgtgagcttctccctgttcctcctccatcttctacctc

SEQ ID NO: 75070 - DNA, 520 bp, Triticum aestivum
  Clone ID: PAT_TA_75070
tctttttggggggaaagacatgttcatatgaactcatttgaattaagttctattcatatctttcagccctgattttctgtttcctatcttctcccaatatcccatgtaagattcagggggagcaagacacctaagggaaagaaatcagtcaaattcattggatatctttattcttggggacatgttgaatccaatgtggtaccttgtactcactctctacatgtcatcccagtcttggtattcttgtggtttcttttgtttgctctggctagtgaatgtacctgtgttatctaaccttgtttgtgcaggttcattccatcctaagccaactcaagaccacaaggtaagtatatgcatcaaaatcatgagtatgaggagttcttgcttatgtacatactgttgcaagaaggactcatgagcatgaaggtattttccttgatcatcttttgctctgatgcatattgcccagatgcatgttacacattgcctactctgtcatggttatgctctcacatgcctc

SEQ ID NO: 75071 - DNA, 174 bp, Triticum aestivum
  Clone ID: PAT_TA_75071
ccgacggacttaacccagttgcatgaagtggttgtcttaggcggcatggtgaaggaggcagcctaaaccaaagtaaaactggctggttcaaaattaagccggggaaggaatcattacaagtaaatattcagattggcggcttataaaggggcctaatggtatatgactaattac

SEQ ID NO: 75072 - DNA, 493 bp, Triticum aestivum
  unsure (1)..(493): unsure at all n locations
  Clone ID: PAT_TA_75072
ggcgctgatcttcggggtttatggccttgctagaggcccatcaaactcaaagcatgatccgggcactacttgacatgggctcggagtgttggctggcttagtttgactctaggccaacagttggggagatcggatccgtacttgatgtanggtccatgtttgaactcagattggggtcggggcctgactcgatgtcaaggtccttgcctggcatgatagtagccgattcctcagatgggaccaaacccattgggaggtcggatccgaggttcagattggatatcggctccagggtcgagcccacggcaaccgaggggtcattaactaggtcttgagcctagccagaaagaatgagctcaccacgggaatctgtggtgtactccaagcttctgaaggtgactacctngtccaaggcaaagttctcgacgggcgctagatggctcatcgagtctgcatgaagaacaaagctaccaagcacgaatagttgtctagg

SEQ ID NO: 75073 - DNA, 382 bp, Triticum aestivum
  unsure (1)..(382): unsure at all n locations
  Clone ID: PAT_TA_75073
ctctctgatttccttccaaactcaaacaactaaggtgggaggaccacgtcccaaatcccaccagatctaatctctctccgtaaattgtttacttctttccaaataatacaagagatctctttctcctctagtattttctttgcacagatcagaacttccaanactacaagtatttggtgtgatcacgtgatggcaatgaaggaaacgtcaaacttcctgaaatattggcaatatttatttcttttgggcgccggttactagatcatgatctgcgttgtcccctcctagttttcctttcgttctatctctctttcatcaaccgatcaacactccaaacagattttctttgcgttcaacagatgcgatgaacaatagcgggaat

SEQ ID NO: 75074 - DNA, 333 bp, Triticum aestivum
  unsure (1)..(333): unsure at all n locations
  Clone ID: PAT_TA_75074
aaacaccctggaaataccccgttcatctatcactcgatgtacttctctccctgtttgccaacaagtgtaaaaaaggaaagagaatgcatatgagtaactacatgtccgaagaatcctcagagtcagaattagcactggttacgaatcagaatttgccgatcgaggaatggtcaaggccgaagtagctgtagcagcatgggctttgggaactcctttgggaatnaagatggtgcgaggtgcattgggcttgtagataagagtaccagctgtgtcttcaatatcatcatttggtttgacaaacagcaaaacagttgatgcagaacactgtggtag

SEQ ID NO: 75075 - DNA, 127 bp, Triticum aestivum
  Clone ID: PAT_TA_75075
cactatcacttagtccttcataattgctagcactcatgcgatacatgtggttacggagttttagtcggacacagagaaagataggggcttataatttttccccacaaccttttacctcaagggtaat

SEQ ID NO: 75076 - DNA, 217 bp, Triticum aestivum
  Clone ID: PAT_TA_75076
atgttctttccaacatgctgagcttgccaaaggataaaatgaaaaaggaagggtgaagatcgaccgtgactctagcataaggtacagaataatacaagatatgcccttcgtagagcgaagcagaggttgtcatgcgcgtttagggttgatgcacaaaatcttaatgcagaagaacgtcactttatattgccccttgcatgtgaacctttattatgca

SEQ ID NO: 75077 - DNA, 405 bp, Triticum aestivum
  unsure (1)..(405): unsure at all n locations
  Clone ID: PAT_TA_75077
cgtcttttttcttagttgatttaggtggaaagggcatgggttttttaacccatgattctctttctcttccacgttttctagcaaaaagtctcttttatcatatcttttatttttaggttgtgggttatcaagatcaacagctggttctatttcaacatcattatctggttcttaatcattgtctagttgagtgtcttcatgaacatcatcattatatttttcaatatcactagatnaatgttcattaccagattgagcttcagcatcaaaaatagaaacatcattattatcttcaggaggtttttctatttnaggttcactagaggtatgcaaagtcctatcatttttttctttttccttttagaaggactaggtgcatccgtattaattcgctacgagtctttc

SEQ ID NO: 75078 - DNA, 508 bp, Triticum aestivum
  Clone ID: PAT_TA_75078
tgttgaagctgggctcaaatgaatgaatgcattgagtttaaatttggtggaggatggtcatttgggcataggaaaacactataaaaatttgataccatttggacatgtcaaagtggtacttccttgacaatgctcttctctggatagaaacttgggaatttttttgtgagaaattggctaaatggaatgagctcaaatttggtggagggaagttattgtggcaccccggctcagagcaaccggtttaccctgcattgccggcccaaagatcgagtcttctggcaatacacaacaacatggtatagaaataacctctttattgatactagcgggatacatagttctgatattacatcgacatgcgaggacaagcggcacacacggtgttgctggacagtatgtacattatttaatgaacatggctggggcctcgatcacacgaaactacacgacagcggaagaacgacgtaacgggactccatagcacagcggcacccatgtggacacg

SEQ ID NO: 75079 - DNA, 551 bp, Triticum aestivum
  unsure (1)..(551): unsure at all n locations
  Clone ID: PAT_TA_75079
ttcgcacgaggacgaaccaccggtatgttactaagcttgagaacaatcttgcttttcagggcaagatgatatgatcaaataagcaagggattgaataatcctaactcattgatcaaagggtgcaccagaaataaggactaggtagcacgatcaatcttagaatgatgatttaataatcaacacgctaagaatgagaatattgtccatttactaccaagagttgctaggagtattgatttcacacatcatgattcactcgtcagcattccggttgcgacaccacgaaatcaaggagtaaataatgatggcgagaagtatcactacgtcnagaattcataagagagggtgcaattcccatggcattcttgacataagacggtgatacttcagggtagaacagaatcaaaagcttgattgcatttgatctgcggattacaactgctttgacccaatcctgggatatngatgaggtactggagtttgtttctcccagtcattccggatagaatggcttgacggaccacaagagtaatagtcatcaatgcacgaat

SEQ ID NO: 75080 - DNA, 487 bp, Triticum aestivum
  Clone ID: PAT_TA_75080
tgcgcggagcccaaggcggacgaaggtggtcggagtggaggaagaagggcctttcgaggctcttccagaggctaggcggggtctagtgaggtggtggagttgtgcgggggcgagagcgagctcggaggcgctatttatagccggcccgaggcgattgccatgaacggataagtccggtgagcgattacggtggcgctgtggctggacggttggattagaggtttgagcatcatctagacgaagcactggtgccattccagcgtctaacttagcacggcaggggtggttacggcctgtccccgacggaacggccgtacggcacgtcggcggcagagagcatgttctgcgcatgccaggccacagcgacggtgctgcatgcgtgcgctggcaaggagatggctacgcggagctctcaggaggtttgggcggtgtcgaacagcgttttgccgtagtgtgtccccttgtcggccgttacggggtttctgcc

SEQ ID NO: 75081 - DNA, 474 bp, Triticum aestivum
  unsure (1)..(474): unsure at all n locations
  Clone ID: PAT_TA_75081
gcccaaacctttttcccctcctagtcctttgaactctcaaccaagaaccatgaagatccactggtcttcagttcaaaattttcaaactacacctgctgcaagtttggaccagatttatcaaatttggtgaaattcattcaaaaccttctccaaaaattccaagtaaaatcaggcagcctctgggtgcattgagtggtcacctcaccaagttacagctccagaaaaattcatctcattgcanaatcctcctgtcgaacacctgcagtgcactgtctgtatcangttcagaaaagttcagagaacactgcagtggcctgctgtcgttttcttcagagaaggacgtcgatctcgccngtgccaccgcgtcgccttgctcctcgtccccgccctcttgttcctgcaccgcacgaacgcctggcgccttgcgggcgttaaagacgagtagcagaaggtgcgccgccccgtgaccgacgc

SEQ ID NO: 75082 - DNA, 498 bp, Triticum aestivum
  Clone ID: PAT_TA_75082
ggagatcgaggagttgttggagcatgaccgcatggcaggagagcaggagttgttggagcgtgaccgcctggcggaggagcagcgtatcgccgatttgcgccgccagcaggacatggagcagcagcgcaccgacgctctgagtcgcaagcagagcgccctgcaactgggccgacaacgtggaggccggcgcctggcaattagccctagaggctgtcgggcacgcacgcgttcgcgacgcctagttttactaccagctcgttaagttggtttctcgcttggaagccgaagcttcggtggaccacgccggcttggaaagggccaacgcgcgcgagcaacgcgccctatcgcggctcttccaagtctaaggcgaggcgcacgatgccggtaccgacgttgagcgtgtagcatagattgcggccggcatcgtctagttagctaagagtaagttagtacttgtacgctacaagagtattagtgggagtagatagttgacttggc

SEQ ID NO: 75083 - DNA, 174 bp, Triticum aestivum
  Clone ID: PAT_TA_75083
cggttagaaattgagagagagacagagagagagagagagagatgaccaagccttaggccggtcccagttgtcataagctaccctagccccacctgtcattagaggccctggcccacctatcaggattcaacgcggccccactcgtcaggaagtatatgtcaaggtgctttgacc

SEQ ID NO: 75084 - DNA, 494 bp, Triticum aestivum
  Clone ID: PAT_TA_75084
gtttaattacagtaaagaggcactccacctctgcatggacgtatacatgcatagttcttggcaaggtttatttctttcattgacatgcagatacaagcacaagcattacagaacacaaagatggattggagagattacattatttgaattaaaatttggcgttttgcctacaaatttaagattgaaaaaatataaccctctttttgttttccctccttcaagcactacggcagaaggaggaaaagacgagaaaaggagcacccaagcaggagcccacaccggtcttgtcagggcccgtcgggcacgacctgacaagaccgggagtggcgaggctgcggaggaggagcacgggggacggcatgaccccttctggtcgccacctccagagccagcaagaagcctcgacttgagcgccagtggagtcatccaccaaagctcagccggaagactgctggaggtgaggagaaggcaccaagagaacacccctccccggc

SEQ ID NO: 75085 - DNA, 540 bp, Triticum aestivum
  unsure (1)..(540): unsure at all n locations
  Clone ID: PAT_TA_75085
gggaaatgtggataacccaacactgcaaaggcggtcaaatgacgctgaccaggtgtaatggtgacggaagggcaaaaacatcagagtcgttcactttttaaggaaaagttgaagccactttgaaagtaagggcaaaatagacaaatgcgtgccaactagggacagaagtatacatatccgttataggattgatttatgtacaaagatagttgcacaagatataagaaaaaatgtataagggcatctacaacagatgatgtataatagggcaaaactgttttttaggatatttggacccaaaatagatgcaaatttttagggcggccctnaaaattggccctaagtgtcgcaaatacacaacagccgcgcggctaccataatttttttaggccagagggaccaggcaggaccccnagagaacatatgtcttacaccatcttgtgccagaaacaatacttcaacacgtaatgtattttaggtcaccacttctacagcatctgctatgaccgaaattttcctggtactttaaactttctctct

SEQ ID NO: 75086 - DNA, 460 bp, Triticum aestivum
  Clone ID: PAT_TA_75086
tgaagcaacttaatgaaattgttcagtatacatgcttcccacaattctgatcatttgatactctctatctgttgtcgtcggcaaagctcccatcgttctccaaagaacacctgtacgattcaccaatcaccatgaatgtcaagagggttgtacatacatagttacagagatccagagctgaacaaccttgaagaagttttagtgcgttcacctcattattcaacaatttgtatgtatagtaattacaattaatcaatgaatgtgaatctcaaatgatctttacaacattgctaaagtccggataacctctaacctatttgttggttcagtttaacaccaaaactatgccatttggttcaatttacccccgatacaatttatcatttctgtttctccatgcacaagtagaggcttaagttaaaattttatagagtgatagtgggcatcacaatgtatgtca

SEQ ID NO: 75087 - DNA, 393 bp, Triticum aestivum
  Clone ID: PAT_TA_75087
tggatcgcatcgttgacgatgattgaaggagccatcaagccttatgatgaagacacagtggaactctcaatgaaagcaccaatgtcggtgtcaaaaccgatggtcctcatgtaggtcgtgggctgacttgtgtacgtcatagttagtcgccctgtcgcgaccacggggtggccggtccggttgatcggccgttttatttttcggctgagtgagctctaaggcctcatcgccgaattcagacaacaacttgcgctttggatagctttttgtgcggcgattaccgccgtaattttcttccgtgtcaagcaatttattccatctgctgttgagcatattctgcatgctcttaatactttgcttctgcttcttcaggctccgcgcggtttcaatgag

SEQ ID NO: 75088 - DNA, 476 bp, Triticum aestivum
  unsure (1)..(476): unsure at all n locations
  Clone ID: PAT_TA_75088
ctgcaggccatcgactaggtgtagcgcaggagctcacgcaccatgagcaacgtagcatatgcgttcgtcgggccgtgatgagcatgggatgacgagccggccgggggtcagcgacggggtggcggttccttcgttcccgccacacggaggggtgcagcaacaaagcttgtttgctcgtaccctgccgggccggtngtggcattggcggcgggtgatggagaactacagggaggcctgccgattggcgctgtttgggcgaggtgagcggcgagagcggttcggcactcagcacgggctcaacgagcgtcaaccatggagtagcgggtcgccgacgagtcaatcgatggaagagaagcttcgacgcacccctacctggtgcgccnaatgttagattcagggttccgcagacccttgagaggttcgaacactggggtgcgtacgaataactccctcttcccaacctgccggcctagctc

SEQ ID NO: 75089 - DNA, 352 bp, Triticum aestivum
  Clone ID: PAT_TA_75089
ttctccaacaatagtgagtgtgaagcgcatccatgttacagcaacgaagctcttccctctgttgcaaagagaggggtttggggcggtactcctcatggatgtgcgacggatcgcctccaccatcaccatcgtcgctgcggcggaagcccggaggactgcgcggtccgttgaccatcaggacttccgccgtggggtcactgctatcgcactcggatgcagtctcaatggagccagtcgaacaagccatagagagtatcgtcgggcttgattgccgcgacttgtggggtggcagactggcgagccaccgcgttcctcacccaccgctggagccacgaccgaccggaacgctttc

SEQ ID NO: 75090 - DNA, 412 bp, Triticum aestivum
  Clone ID: PAT_TA_75090
ggtgaggcattggcccgctcgacctgcccgttggattgttgttggcccgtccagcttcttgatcggtcgtgcttcaatccatttggtgaacttgtccaccgccaccagcagatgcgtcatgccgcctcgggcggttttgaagggtcccaccatgtcgagtcctcagaccatgaagggccaggcgatcggaatggtgtggagtgctgacgccagctggtggctccgcttgctgaagcgtcggcatccctcacacttgaggatgagtgactcggtgtcttggagggccgtgggccagtagaaaccgtggcggaaagccttggccaccagggatcgtggtgcggcatggtgcctgcattttccctggtgtatgtcgaggaggatatcgatgccttggccctgctcggcgcagcgc

SEQ ID NO: 75091 - DNA, 512 bp, Triticum aestivum
  unsure (1)..(512): unsure at all n locations
  Clone ID: PAT_TA_75091
aaaataaatattaaaaggctgaataaatgggctaggcccatgtagaaaaccgaattggaccgggctgattcttgtgccacatcagcttgccacggtggatgcctacgtggtctggggaggctactagtgaccaaaattttggtcgaagaaacaacgaccttttacagaaggtcggttaattttagtttacgaccgccagcttttgaccttctgttttcggtcaaaaaaggtcgcaaatgaaaaacactgacctttcagcggccaatagtgaaggtcacaagttgacatatttcttgtagtgatgagagcggcaaattcttcattgaaagctttgttaggggagccaaagatnatataatcaacatatagttggcacacaaacaactccccttcgaccttcttagtacaaagagtggggttgattttcccgatctcgaatccacgatcttgtaacaactcagtaagatgctcataccatgcacgtggggcttgtttaaggccatagagctcct

SEQ ID NO: 75092 - DNA, 512 bp, Triticum aestivum
  Clone ID: PAT_TA_75092
ggtggccaatgtgtacctcttggggttaggccaagctctcaccgtgatttggtagatgacaagaaccggattgctaacggttctaagttcgacaccttgttggaattgaagatatggctcgacaactattcggttacgcattatcgttcacacaaggtggtgaactcggacgttaatgtgcgctacatggttgcatgtgcatgtgaagatgaaatatgtccgtggattgtgcgtgcaagaccatggaaaggaggtccaacttgtcatgtagtgagttgtgtgccaactcacttgtgccaaggcaaaatggtggatggcaagattgtgtcccaagaccacaaacaactcacgtccgagttcatcgcttacaggctctccaactcaatatccacacttccaacaatgagcgtccagcatgtcattgatcttgtgaaagccatctttcattacaaggtgaaatacggcaaggcatggaaggcgaagcaagccgcatttaagatgttgtatggtac

SEQ ID NO: 75093 - DNA, 571 bp, Triticum aestivum
  unsure (1)..(571): unsure at all n locations
  Clone ID: PAT_TA_75093
tataggcgtgccagaccacttcagtggcctctgggtgccaaacgatggctctgccgcagtgacttctcgcgcccactgcttcagttggcggtgagaggtatgcagcgaggcgccaccattgacgcacatggcctccgtagctttctggaaatcatgctcgccggacttgtcgtcctcatcgtgaccatcatcttcctccttcttgtcgcggccccgagcaggcctctcttgttgattgtccttgtcgcggtgccatcttcaaccgccatgcttcttgtcggactcctctcaccatcctagcccttctccttgtcgcgcctttcatattccgctttctgcttctctgcaagcagctcaacttgccggcnattctagaggtcgtggccttcggtgcggtggatcttgcagtactacttgtcggagcctcctggcttgtcggcagctgccaaagcccggcaggcgacgcacccggcaacttccttgccggggttgtcaactttggtcttctcggcggcgccagggtcgtcggattcctcgacgactagcacggtcttgcccttactcttcctat

SEQ ID NO: 75094 - DNA, 438 bp, Triticum aestivum
  unsure (1)..(438): unsure at all n locations
  Clone ID: PAT_TA_75094
ctgcaggatgagcacacggacccgggcatgaacatctacatcacgcatgagctgaatgaaccagtcgtcatggtgtttaatactatttagttctggcagttctcaaatcttagacatggccttccattgacgctgggcattgtcacagggcacataaaacatgaaaagaatcctcttcttctcttccgcagactgggcatgtactaaaaaccttcagaggtctccgctttttattcagccaatttgctagtgaatttgtagcagcacgccatgcaaaggagagcactttgggtggtgctggacaagaccaaatcaatttcgagatatctcttcgaccgtccggagagatgctcgtagatnaaattgaggagctattaacctcatcagcagcaagccagtaggcgctgtgcaaaagaaaaaaaaaaaaactcgaggggg

SEQ ID NO: 75095 - DNA, 362 bp, Triticum aestivum
  Clone ID: PAT_TA_75095
ggacgcgatgtggcttgccctccggcggcccgtccttcaccagcttctccgcatccatcttgccccaatgcaccttggcaagggtaagggcccggcgggcaccctcaatacaaacggatcgcttgatgacttccagtcgcggacaggaatccaccatccgcttgatcaggccgaagtagcttgtgggcagaagctcgccaggccatatccggactatgagatctttcatagccacttcggccgccctgtggagttcgaccaactgcttcagttggtcactcagaggctttgcatgttcggccccaacatactgggaccagaacaacttctccgttgagctcccctcctaggcacggtagaac

SEQ ID NO: 75096 - DNA, 278 bp, Triticum aestivum
  unsure (1)..(278): unsure at all n locations
  Clone ID: PAT_TA_75096
atttaactttcaaaagttttgaatatcactcactttcagtcaatcaatcacacaacaatcaatcaaatctatctatttattataacattccaaaatttagaattttgggatgttacaccctcgggcgaaccaatccccaagggaaaaataggtagtggtgaggcaaatggtaaaaccaaggttgtgccttgctggaggagttctattcaaagcgaaccgtcnaggggtccccataacacccaaccgggtaaggaacgcaaaatccaggaacataacgc

SEQ ID NO: 75097 - DNA, 510 bp, Triticum aestivum
  Clone ID: PAT_TA_75097
ctgcccagtgcgagagtaaaaaaaaggagttctcagaccataatcgactgcccgcagttaaccacggtctcggggactacacccagtgggcgcacttagcatgcccccactagttctggtgtcattcgacctggccagtccagactgagtgacaaaattcagattctcagaccacagtcgactgcccgcagtcaactatagtctcggggactacacccagtgggtgcactaagagtgcccccactagttcaaagattcaatccaagacgactcaaattgactcgtgcaacttcaaaacagtcacaccccagtgggtgaccggacgagaaatatgatcaatcggaaatcaactaacctggacattagtctgcagagcagctccggcgttgaaggccacctgactggcctcatgcaccactttcatctgccccatcacaaggttcaactgaagaagagcttccttggcggcagacggtgggtcgtccgggggtttgataagcagtgaaaagc

SEQ ID NO: 75098 - DNA, 557 bp, Triticum aestivum
  unsure (1)..(557): unsure at all n locations
  Clone ID: PAT_TA_75098
ggccacacttgtgcgccgcgacaaagaggcattccagccaaaagttcagcccgcaccccgacgccatcaaataaaaatgtcaagacatggggaaatacgccatacctgcgagacatattggagaacaaagcaaaacacgcaagatcgatctatggatcgcggggggtagccactatgcgagacgatnaccgtcacgctagatacactaaaagtaagtccggtcgggccgaacactgttggcaagactcatttgagctgcgtcgcaatatagcccagaacagaggggtcgcacaacacctaaaccccacagatgaagtaatggatcaccaaatcccagagggtttcaaacccgtaagtatagaatcatatgacggcacaacagatcctgcagtatggatcgaggacttcctcctgcacatccacatggcccgcggtgacgatctacacgccatcgaatacctcacacttgaactcaaaggaccagctcggcattggctcaacagcctgccagcagaatccattggttgttgggaagatctggaagccgcattcctcga

SEQ ID NO: 75099 - DNA, 338 bp, Triticum aestivum
  unsure (1)..(338): unsure at all n locations
  Clone ID: PAT_TA_75099
gaggagcgttgatgagcttcatcttcaatgcctacaccaatacttcgttttggtatatctcgacaacattctggttttctcgaaaacaaggaagatcatgccaagcacttgcgtttggtttcttgatagctcagggaacacaagttctacgccaagttctccaagtgcgaattttggctcgatgaggttctttatcttggtcatatcatctctgccaagggcattgccgtgaatcctgagaaggtgtctgcaattgtgaattgggaacctcctcagaacatgaagcaactccgtagcttcctcggtctcgcaagctattgccgaagattcgttgaana

SEQ ID NO: 75100 - DNA, 466 bp, Triticum aestivum
  Clone ID: PAT_TA_75100
gagggggcgcctagaacacacaacatgtattgttagccatgtgtggcgcccccctccacagtttaccccactgatcacattttcgcggtgcttaggcgaagccctgcgaggatcacatcaccatcaccgtcaccacgccgtcgtgctgacgaaactcatctactaccttgacaccttgtggatcaagaaggtgagggacgtcacctagttgaacgtgtgcagaacctggaggtgtcgtacgttcggtactcgattggtggagcgcgaagaaagttcgactacatcaaccgtgttgtgaaacgcttccgcttacggtctacgaaggtatgtagacacactctcccccttattgctatgcatctccatggatagatcattgcgtgtgcgtataattcgtatggttttccatgcaatgtttcccaacagtggcatcatgagccaggtctatgcatagattatatgcacg

SEQ ID NO: 75101 - DNA, 275 bp, Triticum aestivum
  Clone ID: PAT_TA_75101
agttggcgttatttacgatcgaatgccaccgcgaagtgcctcacgtaccggttcgttatgtttccctccgatgtgggccaagcacatcctctctcctcctgtttcacacccatcctacctgttgagtcgactgggctcaagcccgcctaggcaggccggcctgctagcgtgacgagaagcgcgccagggatggtaccggtccttcctccctaacgaggtcacctccgacggcgagccacggctcgtcagctcgtacaagaccctcttccacggat

SEQ ID NO: 75102 - DNA, 485 bp, Triticum aestivum
  unsure (1)..(485): unsure at all n locations
  Clone ID: PAT_TA_75102
accataacagagaagatgggtcggcatttttaggctgtggtcctctgaccatgcaaggatataatttttgctcaatggcttcagccttgctctttggcaccaaggagcggtatagacagtcaccccatgggcgcttgatggcattcttttcagcatattcaggtgtgacaaacctgtacttgaaccattgctcagcccaatatcttcggatccactgaatccggttcttgcgcgggttgtagtttcctttaggatctgacttgtacagctcatacagatcaggatgcagatcgagtgcagtgttgccacggtgttacctgccaccctttcgtgcagaatcctttgaagtcgtaatattcagactaattggcttcaacacagtgaatggcttctatctgctggtctgacaagaactggcttcatgtgattcaatgtgatgctnaagattctgctgagaagaacaaaaaggattttggcctcaactt

SEQ ID NO: 75103 - DNA, 600 bp, Triticum aestivum
  unsure (1)..(600): unsure at all n locations
  Clone ID: PAT_TA_75103
tctgctacaagctctttctaccgagatgtctgaccactttcccttgctcctctcatgtgatgctgatttcaatccattttgaagattcagatttgagaaccactgggtccacttggaggggttcccttcttactattcttgagtcttggcagcagattccaaattgtaatgattgcctgctccaggttgcacatgaagcttatttccacaggccgagcacttcgtanatggaattcttgtatgattggcgatttacagttnagagcagcggtctctggtgagctgatttttatgttggaccaagccatggacaagcgcatgctctcggacaatgagaggcaattcagggtggtgctcaaggttaactatctcggaatcgccgcgctgcaacactctatgtgtaggcnacggtccaagatcacctagattcgagagggggatgcaagttcgagattctttcagggcaaggcgactactaggagaagaaagagctttatccaccgcctcacgattgatggggttctcgttaccatcccagttggccaagagcatgccatgttcgatttcttctcgcaacttcttcttcatcatcttagattc

SEQ ID NO: 75104 - DNA, 444 bp, Triticum aestivum
  unsure (1)..(444): unsure at all n locations
  Clone ID: PAT_TA_75104
gttaccttcggtcgggccatggctaccgagggtaacgacatacgccatactcccgccggagcggcgctttaatctggatttagtggtcatgcatgcatctttttgtgctagcactcctatataagggttgaccggtcgcttcccgcggacgtgcgcgggcggaggaagaggaaggagaagggaaccgggctgtggagtaatgttttttaccacattttcttaggaaattgagtgcaataattgagtagttttaccaaactaccangtactacacctgaaacggttcaaaaccaataccaccaccacgcccgtgtctgaccgccctggccgacccaaacccctcccttgccggcacgtgcttgccgcgtgaaacggtcagcgtcgccccggaacgtctgtgccgcattaatgcccggccagagcggaggcgacctctcactggcg

SEQ ID NO: 75105 - DNA, 394 bp, Triticum aestivum
  unsure (1)..(394): unsure at all n locations
  Clone ID: PAT_TA_75105
aaaattatgcaaccaacatgctcacacaataaaatgacaaatgaaatatgtggcaaagcatgcacaaacaattctagcatctatcaangcaattggcgatgactaggtcatctatattttaattaggaattcaattgagaacatttgatcataggtcatactcatcgtttaagaacaagtggggttaccacttttacataaagtgttgttgtgttcacaccattagagttgctttagctcaattcttagagtaaagctcctcctagatatgagatcccccctnagagggatgaactaaccttgggttttgtcgataatgacttcatgtaggtgttgaagatgtggatgctctaagttgatgtagatcattcggagctatcctttggagtgaatt

SEQ ID NO: 75106 - DNA, 510 bp, Triticum aestivum
  unsure (1)..(510): unsure at all n locations
  Clone ID: PAT_TA_75106
agggctcgccgctcacttcgatgtcgaaggaggaattgcccggcacgttgtagactcaccggcgccataggtcttccactccgtctcgcccttcaggcgcacgcggcagctgccggccacgccttccatgatttccggcgcgccggtattgaaggtgagcgtggccggcaggatgacgccnaccgacttcttggtgccgtcggcgaactggatgctgtggctgacgcacttgccgtcgaaatagacattggccttcttgacgacgctgatattgtcgaactgggacatgctcggattcctcgtgttgtcngtaccggacggcaccgcgggtgtcggttgacgtgcctgcacgcatggcaggcggggcgacgggaagaccnncgtcgcccatctcatcgaacggcttacttgccgcgcttgatcgccgcgttggcagcgatgcgcatgcgcagcgcgttcagcttgatgaagccggcagcgtccttctggtcgtaggcccggcgtcgtcct

SEQ ID NO: 75107 - DNA, 367 bp, Triticum aestivum
  Clone ID: PAT_TA_75107
ctggacttagcgtccgttgcccatccaaagtcaaacgaccaggttgagcgagcaaacatcctcattttgtccggaatcaagccccgactggtcgagcctctagagcgttcggccggctactggctcgacgagctgccgaccgtcgtttggagtctgcgcaccactccaaacaagtcaaccggcttcatgcctttcttccttgtatatggtgccgaggctgtcatcccaaccgacatcgagttcgactcacctcgtgtcaccatgtacacggaggcggaagcaaaggaagaacggtgtcgatctgctggaagagggccggctgttggcactcagtcggtccgccatctaccagcagagtctacgacgc

SEQ ID NO: 75108 - DNA, 439 bp, Triticum aestivum
  unsure (1)..(439): unsure at all n locations
  Clone ID: PAT_TA_75108
ctgcaggtagctttccggattcccgatccctccaagccagatacccgcggaggggaggacatcactcagacctgaacttaaagtcaggcgacgggctagtcttaagatagataaagggtcgccgcactgtccctctaccacggcaacgtgatgggtgacctggggagagttaatctctctcagaccgggtttaggcccaatctggtcataatccgtagcgactcccatggcggcgatgcgatccaagagctcgtttagggaagagagctccattggatctagctgctcggcgaattccaagttgacgtgaagattgctttcgatgacccgagaggtcatcgtcggcgcagcagccgaacaggcggtcataaggaaaccacctagccngagagtttggccgacagccaaagctccgttagcaacagtgccgtctttaaag

SEQ ID NO: 75109 - DNA, 497 bp, Triticum aestivum
  Clone ID: PAT_TA_75109
tgctgtattatggacatgtcgtgcgttaggtgttatcctgggctgacatacgaaggctccctgctccatgtggatcagggtgccataggcacggtattagagcagccaggctggcataggttatcctagtcttagattaccgctaccagtaaaccgtaattacctaagggatttgactcaaccctggcatccggcatggccactgttaatccacaggtggcgcagtcgggaccgacatgtcctcaccccactgtccccgcctagttatccatggagcaagtagcagccacatcctttctggtcggccgcaccgcttgcccttcgctattaagggaaaggggccacaccatgcaggcatgtcccgcatagctgcctataaaagcccccttttccgctcgccgtatcgctcactcctcatttagccatgtcccttcagagaagcctagctagtaacactccagtcatgactagcaccctcaaaactactaagttccaca

SEQ ID NO: 75110 - DNA, 326 bp, Triticum aestivum
  unsure (1)..(326): unsure at all n locations
  Clone ID: PAT_TA_75110
gttggactaacacctttatctagtatgtttcagacaagttcaacaagagatatgttgacattaattaccaaaaccaccaagggagcacttgtgctttcaatctccccctttttggtaattgattacaacatacatcaaagctttagaacaaactccgaaggaagggattaatcacttggaggaaataataataagatttattgtatgcttatccttcatcaaattaaattgatgacnagcaatggatttggcatactacttattcttcttgaaaaggattgagaagggatagcacaaaacttgaaaaactcttcatgaaccaccga

SEQ ID NO: 75111 - DNA, 479 bp, Triticum aestivum
  unsure (1)..(479): unsure at all n locations
  Clone ID: PAT_TA_75111
agaagcagagggacttcggtgatgtagggtgcaaccgcccgtagagcccgctcccggtcgacgagagccagctctgtcaagacggcgtccaatggcacaactggattccggtgaccgagccctgagaggattcgtccggcaatagagacggcagcctgcaacccctccttgtccagctccgcccccaccatcacgcggatacggctcagctcctcggagatatnggtgaagaaggagaccatgtcaggaagtcgcagctcattgaagtcgacggggtggtcgaacgggttcagccccacagccgacatggtcacgctggcacaacggtnggcatcgtgcagccncaacacgtgtggaaacatggtccaccaagtggataatgcgatcctngaccttgtcacgatcatcccggtcacgctccagccggctcccctnacggcctatcgtatctcccgctttctgcagcaacactgccgacg

SEQ ID NO: 75112 - DNA, 321 bp, Triticum aestivum
  Clone ID: PAT_TA_75112
tttttatgcacgggatctgcgcccggctttgtacaaaggattacatgcaacagcggcaagacttgtacaaaaggtggttgccggaacaggttccggcaaccgcgccttatgggaaaaacttacgaagatgttctatgttccaggagttgctcaccggaatgccatcttcggtctcaaggcggacagcgccaggccttgtgactcgtctcacccgataagggccttcccacttcggcgtcaacttgttggaattcttggcggactgaacgcactgaagaacaaggtcgccttcctcgaagcttctggctttaactttgtggc

SEQ ID NO: 75113 - DNA, 572 bp, Triticum aestivum
  unsure (1)..(572): unsure at all n locations
  Clone ID: PAT_TA_75113
gccgtatttaattgctgttacttcaaacaaccaatgcattattcggttcataggtacatatgttcaagaattacataagaaccaaataaagaaggatgaaccacatttgtatacttgtactattaaagacggtaaaattacgctctccgggttattacggcacacacgattggtaaaacacaaacgtttgcgatatacaccataatcagagacggttcacagagaggaaacatgtgcaagcatgcacacagttgccgtatgcaaagcgtgtgcgatgtcngacaatatcacaaacggtgcgagcaaactaaatgtttgtgttagttgcctgatcatacacgattcgcaaccatgaactgtttctgatgaagtatgcatcataaatgttgcaccatagaatagcgtgtgcgatagttgtcgtgtacgacgatgttacgacggtccgacgtttcataatcctgtccgacactcgtacgacgattagctaatcttcttaatagtgaaccatttgtgatgggccgtgcatcatacacgttctatcatagtgaaccatttgtgatgggccgcgcatc

SEQ ID NO: 75114 - DNA, 321 bp, Triticum aestivum
  unsure (1)..(321): unsure at all n locations
  Clone ID: PAT_TA_75114
tctgccacttgggccgagacagtgtggaacgcatgggtgcatggcgggtggccgacttgagcgagatgagtaagtaggagccgacgagcacatacgagtgcacggtgaccataggcgggtatctcagctcatggggggccagccgagacggagaagggaagcatggcgggctgggaagctcctcccaggagcagccctggaggcggccgtcgacgactcttgcagtggacaggtcaaggacctcgaaccagggctccaaatcccgttctccctttatctngggaaaggtcgagagggcgtagatcttgtcctccacgtaca

SEQ ID NO: 75115 - DNA, 402 bp, Triticum aestivum
  Clone ID: PAT_TA_75115
gtcatggccctgtgtgcgatggatcttgcagtactgcttgtcggaggctcctggcttgttggcagccgccaaggcccggcaggcggcacacccggcaacttccttgccgaggtcatctgccttggccttcttggcggcgacggggtcgccggatacctcaacggcgagcacggtcttgcctttacgcttcctattgcggcgtctgcccttctttgctgggacagcggcgtcttcatctgtggagtcagtttccgcaccgccgtcctcgccggggtacttccttccttcttcagcccgagcgcatctgtcagccaaaacataaagctcggctacatccttaaccttgttcatcgcctgctcttcacgcatcttgcggttgcgcatgttctaatgaaacacact

SEQ ID NO: 75116 - DNA, 600 bp, Triticum aestivum
  unsure (1)..(600): unsure at all n locations
  Clone ID: PAT_TA_75116
tccggagcttttccttcgacgtcatctcccgggcctgtttcggagataccactccagggggagggagatcttcctccggctcagggcgctgtccgggttcatgtccgagcccagcgtcatcttcaccatcccgtcgctgaggtatctgccgactgcgaagaaccggaggatctggaggctcacgcaggagatccggtcactgatcctggagatcgcgagggggcgccgagcagcgatgggggattccccggggcctgacttcctggggtccatcatcgacnacagcggcgaccagccacggccggacgacttcgtggtggacaactgcaagaacatctacttcgcggggcacgagacgaccgcggtcaccgccacctggtgcctcatgctgctcgccgcccatcccgagtggcaggaccgcgcgcgcgccgaggtgctcgacgtctgcggcggcgccgccggtgccgcagacccggacttcgacgtgatctccaggatgaaaacggtgggtatggttgtgcaggagacgctgcggctgttcccgccgtcgtcgttcgtggtgcgggagacgttccgcgacattcggctgggccagctgct

SEQ ID NO: 75117 - DNA, 381 bp, Triticum aestivum
  Clone ID: PAT_TA_75117
agagagagagagagaactagtctcgtcagaagggacatcctcagtacgagagcgacgagtatagtggagaggaaacggcagagagggtgacggactggagaggatgggggagaggtggaggaggatgatggagaagacgggggtcggtggtgaatgagaaggaacgagaggtgccggaggaagagatgacacactgagataaaaggggggatatctcagtatgtcatcttcaggctatgtggctgttcctcgatgctcggtgatctttgatgacaccaactatgccgagtttgtaggcttcatgcgcattcatatgcgtggtcttcttctctagggtgttctttttggcgaggtcccctatccgccatgccctgttgcgcc

SEQ ID NO: 75118 - DNA, 141 bp, Triticum aestivum
  Clone ID: PAT_TA_75118
cataaagccttgcaagcattgcaactaatgagttagttgtgagatgatgtattatggaacgagtaaagagacttgccgataacgagattgaactaggtattgagataccgacgatcgaatctcgggcaagtaacataccga

SEQ ID NO: 75119 - DNA, 488 bp, Triticum aestivum
  Clone ID: PAT_TA_75119
ccaagtttaaaccggtcaaacagtttcttcgccgctttaacgaggagagacgcaaggcaatcggtgaggaggtagcccggctgttagctgctggttttatcatggaagtatttcaccctgagtggttggctaatccggtgctggttcttaagaaaaacggcacttggcgcatgtgtgtggactacacagatttgaacaaatcttgtccggccgatccttttgctctcccatgtattgatcaaatcattgatgcgacggcaggttgtgagcgtttgagtttcttggatgcttattcaggttatcatcagatcaaaatggcagttaaggaccaggagaagaccgcatttatcactccctttggagccttctgctatgtttctatgccctttgggctcaagagtgcccaggccacttatcaacgttgtgtgcaaaattttcttcacacacagattgggcgcaatgttcatgcctattttgatgacattgta

SEQ ID NO: 75120 - DNA, 540 bp, Triticum aestivum
  unsure (1)..(540): unsure at all n locations
  Clone ID: PAT_TA_75120
gttgattaagccttccccaagctagagtgatactttctccttcacgaggccaaaaattatatatataattccgatcacgatgaactagatgcataggatttttttggtgaaactccaatttcaatcgattccagtttcaagatccaatatcatctcatagcctataccatgccaatgcttttcccttcaaagatnaagggaaaaccttcttcctagtttcatctccggataaacctgcaagcttaaataatccacaaatttcatccacatatatcaagtgcatatcaggatgttcggttccatatcctgcataaggattagctaacagttgttctatcatacccnaaggaatttcatattcaatattttcagtaggtgcagtaggttgaggggtgactaattatggttccggtcaaggtgaagataccccgagcaaacccctcaaaggattgttttccatagtaacaagtgacaataaatttcatcaggtagtaataatttttccttaccaattcccacttaccaagagcgcttcactcc

SEQ ID NO: 75121 - DNA, 397 bp, Triticum aestivum
  Clone ID: PAT_TA_75121
atcctcaagcaggcggtcgcagccatccttgccgcgaaggagaaggacgacgagtggcggcgcatcggcgaggagcagaggcagaagttcatcgacctcgtcagctccgacgaggaggactgagctcctccaccttgtcgtcctcggccgcgagctcatccattttggtatatcgatttcggcctcgccgccttgagaccccccaccccctcactagtgcagaaccggcctttagtgtcgattcgacaaccggcactaaagagtggggactaaaggtcccccaccctttagtaccggttcgtcacgaatcggcgctcaagtgtcaccacgtggcacaagccaggcccgggtgcgtgtaggacattagtaccggttggtaacaccaaccggtactaaa

SEQ ID NO: 75122 - DNA, 434 bp, Triticum aestivum
  Clone ID: PAT_TA_75122
gctgcaggatgttagtgacagaatacaacggtcagtttacccagctatctcgttatgcccacgacgagcacatgacagagaacaagaagatggaaaaattcctggacggcctggcaccggcactaaaatgcctctttgcttgagatcgtcaaattctctcttcttgatttttatgatgctcctggggatgtgtgccccacgaaagccttccttgaattcttcccaggtgatgttgtgttcactgggatgcatgtgtaagaagttctcacaccatgctgcagctgctccagtaaggtagtgtggtgcataaagcaccttctcattatctgagcactgagcaataatcagcttcctctcgatatcacgaagccagtcatcggcttccagcggcctatcagtgtgagcaaaagttgaagggcgagtcttctgtaact

SEQ ID NO: 75123 - DNA, 342 bp, Triticum aestivum
  Clone ID: PAT_TA_75123
gagggttgaccacgagatctagccctttgacttttcacggacgggctttgaacagtggacctctccacccggttgtgtcaggtcagctcagagggacacctgggagcaacatccaggccaaaccgacagctacatcccctccgtgtagacccgatgcgtccgttttcgccctccaggtgccagcggcggtgccgtccgttagggggccacgccccggagatgcatgccacctcttcgaacatgccacaacaccacccggttgtggtaggtcatcccatagaaacacttgagagcaacgtcccctccgtatagacccgatgcggctgtttccaccctccagat

SEQ ID NO: 75124 - DNA, 579 bp, Triticum aestivum
  Clone ID: PAT_TA_75124
ctcggtgtttcttctacgctttgtgtgatgatcaacttgaatcactctctatacttagtcttgatcaaccttgactctttccaactctatgaccaatctttggataattccttaataccaccttggtcaactcataaactccttgaaaccaacacatgtacttcaagaaatgcctatggacaaatccttcaaatataactcaatgcaaccattagtccatagagaatgtcatcaattaccaaaaccacacatgggggcaccgcatgtcctttcagcagccatgcaggtcagtgcattgaatgtactggaaaattcacaccatagagcaatgatgaataatagctataactacatgcatatttggctggtggaggctctaagtttaatttttgcataaagccaatttttccctacaacaaaggaataaattttattttactaccaagttaaattacccatattgtcaaggtaaccccaactcaatcccaaaattcccaaatcattaataacccaacaatttcattaaacagagtgatgtgatcaaccaataattcaaataccagatactcaaaacgtcca

SEQ ID NO: 75125 - DNA, 359 bp, Triticum aestivum
  unsure (1)..(359): unsure at all n locations
  Clone ID: PAT_TA_75125
cttcgcgatgagatcttcctccgctgccgcgcctcccccagtgcgctccggcacctgggacggctccgaggtccacgaagaccatatcgagttcctcttgcggacccgtcggcttccaggcgaggatcgcgtgcaggtgcgtctcgcgccgganggggagatttcccccgccccgcgagagggcgagcgggtcatcttccgctcgcactgcctacgcgggttggggctgccagcgagcagcttcttccggtcgttcatggagttttacggactccagccgcaccacctcaccccaacacagtggtgctgctgtccgccttcgtggctctatgcgagggcttccttggagtcctccccgc

SEQ ID NO: 75126 - DNA, 401 bp, Triticum aestivum
  unsure (1)..(401): unsure at all n locations
  Clone ID: PAT_TA_75126
tgaaggagaacaagaagctgcggggcggcatattcagtatgtgtctgaactatttttaaagtagttcggagataatggaactgatatagttatgattgcaggtatattgatgggccgtcctgaagaggaggttccggatcatcaagttgatctgctgcaagggctgtcgcaagtgcacgagcaggctcagctggcgatgcggagtgttgccaaggccctatggccatccgcctcccctccaggaagtatggaggagcttgtagagctgttcaaaggagcgcggcggcgtatccgactatngaagatatcaacctgccgagagggtgcgcgagaggcctgggccatggtgaagacgcgatgtaccaagctggatcctaatcacatggcccgtgtcggaccgc

SEQ ID NO: 75127 - DNA, 455 bp, Triticum aestivum
  unsure (1)..(455): unsure at all n locations
  Clone ID: PAT_TA_75127
ggtcactcgcactcatgggctttgccaccttctttgatattgataccatggccctcttgtggagcaagactcttaaagtagcctttgttgggcatgtcaagaatggtctctatgtgattaacttttcggagcaacccactaagaccgcgacatgcctnatggctaaagttgatgtgggatggctttggcatcgccgtttagcccacatcaatatgagatctttgcaaagtcttctcaagggggaccatgttcatggactaacgaatgttagttttgccaaagatcgtgtttgcagtgcttgtatcaaaggaaagcttcatgagaaggctcaccctcccacgactatcatctactcgaagagacccttggagctcctacacatggacctcttcggccctccatcttttgatagtcttgggggtagaaagtattgcttggtgattgtggatgattat

SEQ ID NO: 75128 - DNA, 296 bp, Triticum aestivum
  Clone ID: PAT_TA_75128
accgggctccagagccggacttagaggcagacgctaacgtggggccaacaccggatgttcctcctatataggatgcggataggctgtccgctatgaattccgaagtggagagtgccatgaatcaccggcgtcgccgggccgtactccgcgacgcttgtgtgtctcaagaggcgttcgatgccttcaactcgggagacgcgtacattcgagctgctcaaaatggtcttgccagagccacggaccagtatgtaaaggatatacgagtaagaaaatctgataattatgtagatcagtag

SEQ ID NO: 75129 - DNA, 440 bp, Triticum aestivum
  unsure (1)..(440): unsure at all n locations
  Clone ID: PAT_TA_75129
ctccacggccccgccggtagccacttgctttttgctgaatatagcctgctgtttgttaaggccaatattgaatgagcaaatgagctgtcatccttgcttgatcgctactgcatggcgtctgggcnatgagtgaatttattgaaatcatcagtgttctttagtanagggtgttctaatgagttgaggcaggaagtgaaagatgctttgaacatcactnatgaatccttgtcagaacggtatcttggcttgccttctgatgtaggaaacagcaagaacggcgcattcaagttcctcaaagatcgtgtgtggaataaaatcaaggggtggatggagaagatcttgtcggccggtgggaaagaaatactcataaagtctgtggcacaagcagttccagtgttctccatgtcttgtttcaagcttccacgcgagctttgcgagca

SEQ ID NO: 75130 - DNA, 482 bp, Triticum aestivum
  unsure (1)..(482): unsure at all n locations
  Clone ID: PAT_TA_75130
ctgcaggcggcggcctaggccttgaccagctaagtcactgtttaaataaaaaagatgaaggtttacagcgaatatatccggatctgaccctttcccacccaatttagcttttttttagtcagttacatgcaagttccgtgaaaatccattttgggccagntcgatcttttagttcattgatttgtgcttgaagattcgtgcattttttttgtagtggctgatgtattgtttgggcccaaactttgactggccactgtttcgggtcagtcgattttttgttggtctgaaagccatttgggttgcctgttgtcattcctcctttttctgttcttgtgtctttttgctttttcttttttagtcggttttatgggtattattaggatgttgcataagtgtaaaatgtatacatnaaaatattgtataacatgtgctaaattatactagagtgtgaaaagtgcaccactatatgtttatttcttacc

SEQ ID NO: 75131 - DNA, 543 bp, Triticum aestivum
  unsure (1)..(543): unsure at all n locations
  Clone ID: PAT_TA_75131
ctgcattcgccatcaatctcctgaaagactgtgtgcccgcgaaggtggcgaagtttgtcccgatccccatggcggtcgcgatcccgttctaccttggaccatacttcgccatggacatgtgcatcggcagtgtgatactcttttgctgggaatggatgaacaaggctgaggcgcaggcgttcgcaccggcagttgcatctggcttgatgtgcggcgacgggatttgggccctgccacaggcctttctttctcttgccaacgtgaaccctccaatctgcatgaagttcttgtcaagggccaccaatgccaaagtggatgcattcctagggaactagtcatagctnttgaaatagcgtcagattgttttgttatgaagtcgagtagtgatggcttgtctaaatngtgttagatactttcttttgatatttattatagatntagattataagcataatcggtgtgtaaagattgctgctgctatgtaaagtaatttcttagtttgcttctagaagtatctcctgctgtaaaccattcactgcttta

SEQ ID NO: 75132 - DNA, 506 bp, Triticum aestivum
  Clone ID: PAT_TA_75132
ggcttcaagctcagccggtggctgttggaacctgtggaagccgaccagtaagcactcaaactctgctttgctcttgtttttgccatcaaggcttgacatcctccattttttgttaggcccccgcctgcagcgaagaggctgaagggggactcggcggccccactcagggtaatctcatccgttgtggccacgccttcgtctgcgggaaagggaggcagcagggctcgcacctcccctgcccgatcgtcctcgcgaggccaggagggacactctagtggggagccagcccccatggccccgctgactctggaagcgcctgcgcttgacgctgtcaccgagggtcccaaggctcaagaggtcccagcctctcaagccgtgatcacgctgccatcttctcctcctactccgccggctcccatctcctctgcctcttccgccgccttggaccgtgctgcttatgagctgagttggctgcgaaaagatcttcagggtgccaacccccgcct

SEQ ID NO: 75133 - DNA, 119 bp, Triticum aestivum
  Clone ID: PAT_TA_75133
tgagctcaaaattggtgtaggtagttacctaggtacggtcatgcgctggtaaattttcagatcatttgggtaagcctagctagtacttacttcacaaagcttctctcgagggggggccc

SEQ ID NO: 75134 - DNA, 498 bp, Triticum aestivum
  unsure (1)..(498): unsure at all n locations
  Clone ID: PAT_TA_75134
ctggagttatctattacgtagaacgatagtcctggaggcataagcattcccgcaagaagagaaaaaagaacttaacatgctgatagctgaaaatcacggctagaaatcctctatgtgatgcatatatgtgtgctattaaattcaatcctcagtcttcctgtcgtgcggcttttgcacagttctactgacgtccagtcaaattgttttaagacactgctggaactttgaacttccaccagttccttatatttccatgtttggtagtaatgaattgcatagtacagaattctaggtatgtgcttatnaaccttaagagcctaactnggatgcaaattctatagaaatagacataaganaaatgtatcggtactggtaattaccatgaaccagggggatcgaggtgaagaaatgccaaaaacttgtaaagggcagcgaagatcagcgggtggaggtaacctcgaaggccccgcttccactcccaggtgaggtggccgtacc

SEQ ID NO: 75135 - DNA, 448 bp, Triticum aestivum
  Clone ID: PAT_TA_75135
ctgcaggaatcggcacgagggggagaaagaaggcgtgggtaaaaatgaggaaatcttatccccttatagaggcgccgaaagcggtgcgcctccccacttgcctgttgggaattgcttgcttcccaagcgccacgattgatggcgtggtgggattacccatacccgtattgatgaaaatcccgtgataaggggacacgatctctgctttgacgagacgtgtcaaagaaaccgcctcacaatatgcgttgtggctggttataggaaaacggttcgaataatgacccggccgaaatgacacgtcgcgttgtctaaattgtcagcagattgcatttgtgaaatatcattctctctacagcggtatgtgaatattattttgtggatccggacacggtctaagtgttcgacaattattttggagtattcggagaaggaacccgcccagcaatgc

SEQ ID NO: 75136 - DNA, 498 bp, Triticum aestivum
  unsure (1)..(498): unsure at all n locations
  Clone ID: PAT_TA_75136
ctgcaggagctaacgcagtagctgttgcttgtccggatctagtccggcgccctctgcaatattttgtcagattcacgccgcactttgttaattaatcatcttttcaaagtacgtcttaccagcgggggtctctgtggctccccctgtggcggccagtgcggcctcaagttgggccttgcactcttggaggtcctggaacagatnggtattcttctccataagatcctgcataaaaattgatccttaaatcagttattttaactattttaagtctcgggggctactggcatagataactattaaaattacttacacgtatgtctttcacatactgctccgtggctctggttaacccatcttgagcggcacggaggtgcgcatttcccgcatcaaaggcatttaatgcctccngggagaaacacgcgtcacgaagaactgtccggcgacgcctgtgattcatggcgctctccacctcagaccgggtggcggacagcctgt

SEQ ID NO: 75137 - DNA, 157 bp, Triticum aestivum
  Clone ID: PAT_TA_75137
tcacatcataagaataatgaacctatttatacatgcaatttggctggtggaaagctctaagtttagtttttgcataaatctagtttttccctagaataaaagatattattctaccactactttacagcatagggtgagttggtaaacccaacttaat

SEQ ID NO: 75138 - DNA, 416 bp, Triticum aestivum
  Clone ID: PAT_TA_75138
catggtctagtaacatgacctccagaacaggattatcgtaccactctggtgcggattttactctagttgacctacgaggttcggtagtaacttgatctgaagtttcatgaccatcattattagcttcctcactaattggtgtaggtgtcacaggaaccggtttctgtgatgaactactttccaataagggagcaggtacagttacctcatcaagttctactttcctgccactcacttcttttgagagaaactccttctctagaaagattccaaatttagcaacaaaagtcttgccttcggatctgtgatagaaggtgtacccgacagtctcttttgggtatcctatgaagacacatttctttgatttgggtgcgagcttatcaggttgaagccttttcacataagcatcgcagccc

SEQ ID NO: 75139 - DNA, 540 bp, Triticum aestivum
  Clone ID: PAT_TA_75139
ccacgcctaggtttgcggaaactattacggtgtcccatgcagtgatacgattaaagttgctgaccagagcacataacattttaatgatctgaattaaaggaacaatcaacacaaaaccaaattctaagctaaaataagaaaggacagcatataagactagtcatgttgtgcattctatggcatgaagttcaacacaagttgaattatcctgctacatgatactagacttacccttacacaactactccctccgtcccataatataagaacgtttttgacactagtgtagtgttaaaaacgttcttatattttgggacagagggagtatttaataacacttactgcacaaatttatatcactagcatagatcaaagcagcacagaaggtcggcagttctacaaaaacattagtcaggctgttgttcatagagtaattaccaaagaaataccccgtttgagatcaaaatgcttcatcaagcggtggtgcatgtcatatgcattatatttctacgattgggtggcacgaaaagcctttgctgg

SEQ ID NO: 75140 - DNA, 470 bp, Triticum aestivum
  Clone ID: PAT_TA_75140
ggccagcaggcacgtgcagccaatgtcaaaggccagaatgtcaactgagaagcccatagagccggttgcagctgagagcaagaaaagaaaggaaagggtgaagaagattgtggctagagtgcttggcaaagcttccatcatggaagaggaagaagaagaagaagaagtagctgcaccagcacccaaggcacccaagctaatgggagatgccataaaatcagggggagctgcttccaaggccaagccagctccaaagccgaagcctaagaggaacacaagaagcattcctgcagctgagaagaacaaggccccagtgcttgagactgttgcttaaaaagaggaagagaatgtcctaaggaagcttaagcccaagatcccagaccacaacgatgctcatcccgtggcttaggacctgaagctcaggagagattcagggcttaggaagtggagagaagcagacccatattctt

SEQ ID NO: 75141 - DNA, 318 bp, Triticum aestivum
  Clone ID: PAT_TA_75141
gctcactaagattgctgtgcaagaatcggaataagggaacacacaaagaggtcaagtttgtaacctaacttggagatgaacttgctacggcggtaacgacagtgatgatgggttgacgtcgacggaaaccagcggcaggagggcactgtggcaccgagatgcaaaactgctagcagttactgcaactcagtgtgaccgaatttttcaaattggttgcaacgagattaaaacctaaatcaacttaatgaattcggtgagaccgagtagaactaagttggtctgaccgagatgcattaagaggttttggaattttaagcc

SEQ ID NO: 75142 - DNA, 202 bp, Triticum aestivum
  Clone ID: PAT_TA_75142
ccacgcgtcagcatctcagggctggggtttttgttttttttaaagggggggtttttgggggttttggcggggttaatttaggttgttattaggtagctattagagagaagtgtcctctcttatgtctccgtgcttggtttaccaacgctacgtactgctatgcctaaacatggcttagattgaagtgaaggcaacatgtggt

SEQ ID NO: 75143 - DNA, 263 bp, Triticum aestivum
  unsure (1)..(263): unsure at all n locations
  Clone ID: PAT_TA_75143
ctactgggcccataatggcctgctgaaggcccgtcgacgactagtgaaaattgaggtccaacatgcattttggcctgctaaaggcccatggtttcatctcggccgtaacaggccagtacaatattcggcctgttaatggcccaatgctacatgggccaaactaagcgctgggtcgacaaaaggcccaactaaaatataggccggtgtaagtttgggcctggcgcantgtgtgaaggccccaatcattcgggcccaagaaagac

SEQ ID NO: 75144 - DNA, 414 bp, Triticum aestivum
  Clone ID: PAT_TA_75144
gaaagtcgtgtgcagcgggcagcgctctcagccggcgcgccacttcaactgtcatgctctagtcaaaagtcacgcccactctgggctatgaatgcggcgctgacgctctggagccagacaactggcttccagcggaaagcacgcgggcaagggacatggtttttagtggtccaggtttattggacggttgcatcgcagcggtcaatacacccgcaaagtcccccactttgtttctggtttgcgaaaaatttaggtccggacctgtcggcggaccaataatgaccgcattggatggtaaaaacacgtccggaccgcacagtttagacggttgcaggcggtttgagagtagggcgttggagatgcccttatccagtattagaatattttcttcactttgcgagagtttttttttga

SEQ ID NO: 75145 - DNA, 253 bp, Triticum aestivum
  Clone ID: PAT_TA_75145
gggagagagagagagaactatggatgcgatgtatgatcctgcaatggacgtgcagatttatccacttaccgcagtgacctgtcagataggcgagaccgcggttgaagaacgcaattagtctgaaatctttataattcgcagatcttgtgggcacttggcagattacaaccttgagcaaatcaaacttggtatcatgttgactactgtaagatttcgagtattctagggctgtggtgccaaagcagtgcagtgt

SEQ ID NO: 75146 - DNA, 585 bp, Triticum aestivum
  unsure (1)..(585): unsure at all n locations
  Clone ID: PAT_TA_75146
tgagcctgaagtagaaaaacctcccgattatgataatgaaatttctatctctcatgctgaaactcaatctggtaatgaacattcaccttctgataatgaaaaaggaaatgatgaggttcatgaaaacactcaaacaaatagtanagaaccagataatgatgttgagatagaaccaccagttgatcttgataacccacaacctaagaatacaagatatgataaaaaagacttcattgctagaaaacacggtaaagaaagagaaccgtgggttcaaaaacctatgccttttccatctaagtcaactaaaaagaaagatgtgaagaattggaacgctttgctaaaatgctgaggccagtcgttttgcatactcgcttgactgatatcttaaaaatgcctccctacacaaaatacatgaaagacatcatcaccaattagagaaaaatactggaagctaaaatctccactatgcttgcgaattacacttttaaagatggagtaccttataaacttggagatacgggaataccaactataccttgctccttcaaaagaaattatgtgaaaactgctttatgtgatttggga

SEQ ID NO: 75147 - DNA, 273 bp, Triticum aestivum
  Clone ID: PAT_TA_75147
atcggcacgaggagttctagttaaatctgttctccctccgaataccgttatcaagatttaacccagactgtggtccctactcaagcacatgactatcccacaggatgtattctcttgcgaagggagtaccattttccacgagtaacgggattactcagtccctcgggactaattccgtctacggtcttttgattgtaaacacgcctgacctgcacacaccagcttaactcaccagtgcctggaatcacccacgacacctgccaagcaaaactc

SEQ ID NO: 75148 - DNA, 490 bp, Triticum aestivum
  unsure (1)..(490): unsure at all n locations
  Clone ID: PAT_TA_75148
ccacttgtttgttgcgttgtgcgcctccctcgaaggacccaagaatgggaaaaagagcgctcaagtttagcccgaacaccccaacactcgtggcatggggggcagaagctgatgacttgccatctctcanatttaataaacagctgcacaaaaggtaatattttaaattcacaagcgttgcttagcgcatatgaacaagttttcaagtgtacaggataacaaatgcgagtttactcaaaaattacatctttggagcattcacccgctataaggcgggcacccttcaggacaccctcataatacatctcgggcgtgcgatactccctgcccggcggtggtctatccgtcacaagcttctcagcgtccatcttgccccagtgcactttagcacgggcaagggccctacaggaaccttcgatacagacagagcgcttgatgacttcnagccatgggaagccatccacaagccgcctcaccaggctgaagtagc

SEQ ID NO: 75149 - DNA, 160 bp, Triticum aestivum
  Clone ID: PAT_TA_75149
cgtgatacttcgaaagagattgtccgttttgtacacgaaatgcatccagctttttgccgtaaccctctctactttgttgcacatgctttgtgggtgaaatgatgataccatgccaagtttcaaccttttcagagttcatttcaaatgcttttcaatttca

SEQ ID NO: 75150 - DNA, 513 bp, Triticum aestivum
  Clone ID: PAT_TA_75150
ccgtgtcctttgttctgcgagttcgacgtgctgagctttgagatagcggtgagagcatgagctaggggatggagagatcttcgtgcgcaccctagtgttcgaacctcaagggttttgccagaacccgaaatccgacatttggcgtgccaggtaggggtgcgccgaagcctctcttacatcagcagatccgtcagcactctgcagcgccgatgtccggtgacccgagggccgacgccgaccactgggcagcttggcctgcaggggcggcatcgcccgcccaagaagacctcaactccgcgctccaggcggcacaagcaccgcgaaacgccgcggggcgcgggcggcgtggtccgacgccttccaccctcaccccgcggcgcgcgttggctgccggaagggcctcaagctacgccgcggcaacggcgccgcacaccagacgcgagcaagcaaacatgagggccgcactcatagtggcacgggagctgctgcggtgccgactggcagagagcagcc

SEQ ID NO: 75151 - DNA, 420 bp, Triticum aestivum
  unsure (1)..(420): unsure at all n locations
  Clone ID: PAT_TA_75151
tgcaggaattcggcacgaggcgggcatacgcaacgcaagcgggagcgcctgaggctgttggccgattcctgggtgggtggaccagtgtgggccgggaccgattcacgctcgtacaacgatacaggtacagggacgacttccactgcgtgtacgttgattgatgatcgtccctgaatcctactcgtccatcgctaaccgattcctactcccgttgtgcaactttcctctcaatatatgcaacccagacgtccagcagccaacttcacttctcgccgtccgagcttaattcgccggtcacgctnaaaacccaagtcagcgatcagccggccggcaactcaccgaagtgctgtgatttggtagcgtggagagctgttgtggcatggaaccatgtcagcccgggctcgaggagccatgcaccgc

SEQ ID NO: 75152 - DNA, 170 bp, Triticum aestivum
  unsure (1)..(170): unsure at all n locations
  Clone ID: PAT_TA_75152
tcggtagcaagttgtaaaaacagagatcgtgtcccccttattacnaggattatcatcaatacaggtatggatcatccaatcgtgcctgttggcatgaccccatgtttttaggccagtcccgaacgaccacgtttggggacgcttgatattcttcccccctttataaaaaa

SEQ ID NO: 75153 - DNA, 511 bp, Triticum aestivum
  Clone ID: PAT_TA_75153
ctgcaggtgaggtgggaggaggtaccaaaaaaatcatgagaggtgggacgaaaaaaaccctggaagcgagactaccaactgcttcattaaaaattgctactaattgcacccatgatttctcattacattaatctggtctgttatattttactgatttagataatcagacgatcatgattaattgatgtacacttaacggggtgccaataagaaagaaaatgtttgctcttttgatagtagtagagattggtttagatgatgtaaccattataaggcaatatcaggttggaggtgaaaacacggggtataagggataatggagtagagaaacaagaatcatgcattcgtaaaaattattctttaccaggtaccactgtagcttacataactatgtacactaaactcaaaggaaatgatacaaacttaaagctagtggtgaagcagtgatagtgtgatacttcacttgtttgtccaagttcagggatcacaagcatttccatgactgtttccc

SEQ ID NO: 75154 - DNA, 496 bp, Triticum aestivum
  unsure (1)..(496): unsure at all n locations
  Clone ID: PAT_TA_75154
cacgaggggtccaggtccagccctgtgataccacgccttgatgaattccaaggcccggcgctgctccagcccgagccaaggaacccttccaggcctcaagatgaccagccgcgacctccagccaatcggcagtccgactgggagtgcgcagaaccggcatgtctggccacagggcagcaatcgcctgggcgcaggcggagctgatagatgtggaagacgccctcgtcgcgcgtgcggcggcgatcgccgactacgcagacaccagcgtcttcgtccctaatcgggctgaagaaggcggggtggcgccgccngagtggttcgggatgaacccggactatnacgaggactcggcggaggtgatcggttccagcgccgaggaggaaggcgaggcggaggacggagggtagacggaggcgccagaagacggagcgggcgaccaacctcagctcgaccgcgcctccagcaacgagccgcgcccgaccgagccggctgccgc

SEQ ID NO: 75155 - DNA, 335 bp, Triticum aestivum
  Clone ID: PAT_TA_75155
ttttcgcttcggaagttgtcgggagaatcaaatacaacctctaatattagagagcccgtgctgcgggcctctgggcctagcgtattactccctatgaaggtagtattactgtggctgatttttgtcgggtctctccccattttgcggactgtgtcctgatatatcagattaagactactgccgccgtccataaggactcgtgtgagatggtattcgtttattattgggtctaacatcaaggcagccgatccttcatgccggatgcatgttaggtgatccctgcgatcaaaagtgatcgggcaggccaacggttgaacttaggggtgacgggctct

SEQ ID NO: 75156 - DNA, 427 bp, Triticum aestivum
  Clone ID: PAT_TA_75156
atttgcctatggctcagtgctagatgttttgtcaaccatcttgtgtacatcactgccatgtattttgttttcatgtttggtggctgtagcatgttcatttcgttgcatttagatgcctacttgctgcaaatcgcataccggtgtcatatcttaaaacgcttgccatttctaaaccgtatctccgattcctatgatctttatatcgttttcaagcgatttcatcccctctatccagtggcacacttggttttccaagttgatgcccggttcgtgcatctcctgtcatatcttgccttttgcatcccgcatcgcatcccgcatagcatatcgtcatttcatcatattgcttggtcttgcccgtggttgattgtatccttgttgcttgtttgtctttgggtagagcctggagaagagttcactaccgagg

SEQ ID NO: 75157 - DNA, 451 bp, Triticum aestivum
  unsure (1)..(451): unsure at all n locations
  Clone ID: PAT_TA_75157
actgggacgccgtgtcgtgtactcctccgtcgtaagagtggagcgctcgctctcataaatgttctagtccctttccctggcatgtgggacataaagctaccgggtccacgtgccataccgaaatacagtgcagagcagcaggggtgaagcaccccagtcatgccaccggtgtagtaatgagcaatgaggcatcaaatcacaaagctgcacctttcccgtagttgagttggagggacgaagtaataatgctnaaaaaataagttggagggacgaagcaaccatcatttcactcattgctgaatccgcttctccctcctcttcttcaatttaaccacgtgttgcttctgttgttgttctgcctcatgtgggacgcggatcggcttggtaaagcactgacacatgggaccgcatgttagcaaactgccaggccaacatcgtctaagaaaaaaaa

SEQ ID NO: 75158 - DNA, 372 bp, Triticum aestivum
  Clone ID: PAT_TA_75158
cctttttacacgaggttgaatcttaaatgttgggtgctttgtccaagttgagatccgccactgatgacacgagtctgctaccttgctcctttgaagatgaccaaaggcccgcacctcccaccatgagatcctctctcagcttgcaccttttcatgtgagctcctcctcccaactaccactatttgagttgtttgattcatgtttctctttttaaaattgaatcaggtctcaaggaatgagatggatgcgttgttcatgctctatgagaagatgatctgctctatcagtgacaatgaactcatccaattggtacctccaaaaaacatacttcctatgtgttcgtggcaattgttttgaaattctctttatgta

SEQ ID NO: 75159 - DNA, 506 bp, Triticum aestivum
  Clone ID: PAT_TA_75159
tcttgcattgcaaatgcatgaacgtcatgttgataatctagtacatctctattgaacaagtcactcctagttgacaatcgaaacttcaaaattttgaatgagaatacttgatggaatgctgaattaagttgagaaataagtacatctgccaaaagataggattatactccttttatcttgttcgagtttttccaaagtttcttcacacatgttttaacgaggccatccatacaaaacatgcatagtacatatacatttcctccctttttcaactaaacccctttttcaactaaacccaccagggttggtagactcctactccaacacgccttgcaatcctacatcttgcatctcctatctatactttttgcctgcattccacggtggtctcaacacatacaacaatcttcgaaggtctccgtgcactcgcccttttgtgcttacaggtacataaaagcagtttctcattgcaattgaactaccggattaccatgaaaccacacctc

SEQ ID NO: 75160 - DNA, 444 bp, Triticum aestivum
  Clone ID: PAT_TA_75160
ctgcaggatcggcacgaggatttctgtcttctccaatggtccttggtgactcagatattgatttaattctcgggatggactggctttctcagcacaaagctcaacttgattgtgctgccagagagattcaattgacacactcttctgaggatgttatcatctatgccgctcgtgacgaaaccattcggttgttttctctcaatgagaagggcgagttggatactatctctcaggttacagtcatttgtgagtaccaagatgtctttccacaagagcttccgggtatgcctccgcatcggccagttgagttcgttatcgatgttgagcctggcactgaacccgtttgccagtgtccatactagcttggaccttaagaactgaaggaattgaagaaatagctcgatgaacaagagcgtctgggtttgatcagaccgagttcatctc

SEQ ID NO: 75161 - DNA, 110 bp, Triticum aestivum
  Clone ID: PAT_TA_75161
tcggcacgaggggcattgagaaatgtcaaattcctcaaggatcacttatgcggagcctgtgaagctggaaagattaccaaggctaagcatccaacaaagaccatcatgac

SEQ ID NO: 75162 - DNA, 493 bp, Triticum aestivum
  Clone ID: PAT_TA_75162
aacccaacgagctttgccatgcacggaacaccaaagacacacttggccgggttaagcatcatcttatagacccggagattatcaaaggtttcccttaaatcatctatcagggtttcctctttgatggatttaaccacaatgtcgtccacataagcgtgaacattgcgcccaatctgtttatgaagacagttcttgtacacaacgctagtaagtcgcctgtgcacacttgagtccaaagggcatagacacatagcagaaggctccaaagggagtaataaacgccgtcttctcctggtccttaactgccatcttgatcttatgataaccagaataagcatccaagaaacttaaacgtgcacaacctgccgtagcatcgatgatttgatcaatacaggggagggcaaaaggatcaaccggacacgccttgttcaagtccgtgtagtccacacacatccgccaggcgccgttcttcttgagtacaagcaccgagtta

SEQ ID NO: 75163 - DNA, 338 bp, Triticum aestivum
  unsure (1)..(338): unsure at all n locations
  Clone ID: PAT_TA_75163
ggttttgccggaacttcgagggaagacttatgcagcacattgttttggctcaaacttttgcatactatctctgatttagacgtttcttatatcaaaatcgatcgtttcgacaagatgaaggcaacccatgtagaaacgtttctcatatgatgccatcttgggggcgtaattatcccaatagtgttctgaatacaaaatctgaatacttcgaacacaacttcgcctttcgaaatgagaccggatggctatggcccanatatcaaagtttgtccttttgacgatntggagctttctcactttgaacacttctccatttgaggacatcttaattatgttct

SEQ ID NO: 75164 - DNA, 527 bp, Triticum aestivum
  Clone ID: PAT_TA_75164
gcagactaggttcttctcgaaggtaacctcgcagaagacatgaaaattgcagatgttggacactgagttgggtcctatatcttgaggccgcaggtcgaagaagttgagcacgtcgctaaaaaactttgagccgggcgatgcgaagccccggctcatgtgatccgcaaaaatcactacctccccatcctttggctgtggcctctcttctgacgggtcaggagcatggtaggacatgatgtctttcttgggcagatatcctgacttaacaaaatcagctagggtctcgttggtcacattggacctcatccagttgcaagtaatgggagctttggggggcatggtgaaagtcggcagtctatgacaaaaaggaaaaaacatccgggttaattataagccggaggagatctacagttcaaaactaaggtggcggcttatgaaggggactaatggtatataccttagtacagcgggttatttaagccgcagggggcattcagaataccttgattatctacggccttatcaca

SEQ ID NO: 75165 - DNA, 262 bp, Triticum aestivum
  unsure (1)..(262): unsure at all n locations
  Clone ID: PAT_TA_75165
ccaccagctcaagcagtgggcgcgtgagatcacagcagtggagccatcgtttgatgcgcggaagccgctgaaatggtccagcacgcccatcatctttgataccgaggaccaccctgaccgcagtactgcggtcgggtgcttgccattgttggtctccccaacaatccgcaacctcaaggtgacaaggatgtttgtcgacggctgggccggcctgaacctgatctcgcctgccatggtcaaaaagctgcagatccctaatnga

SEQ ID NO: 75166 - DNA, 538 bp, Triticum aestivum
  unsure (1)..(538): unsure at all n locations
  Clone ID: PAT_TA_75166
ggactaccacgatacttgcttccttgttcgtacacctgcgtgtggaagatactacaatttaaatatagcagacgaaaacaaagaaaaaattgctcacaaaaaaatatacatttgctttaaatgttgttggacgttcgtatatgctgtcacctgtattgctgtatggtagagtttattggtcctatgtttggattttgtcgttgggctcttcttgcttgtgcaaaccgtaccgaatccttgaacaccaatgcttttgttgccaatgatccttctgcttgcatcaaaggaaattctgttaccctgtacctcttcattatgaccgcctacaaacgctgggccgtcacaacgcccactctgcgcctttgtgggcatctgtgtcttcaaaccaaaaaataattagaggcatgtgcgagtaaaacttccacgtacgttnaaaccagcgtttcaagttttcgccgttacctgcacaatctgcttagttgagtctctgctgcttagaatgctcctcttcgcaagtgtctgttgcacaccatgctcc

SEQ ID NO: 75167 - DNA, 537 bp, Triticum aestivum
  Clone ID: PAT_TA_75167
gcagatcaacctcaactttgatctggagctggccaagaagaatctcaagaaggcctaggaagaagcagctaccgtgggaggtaacatttgtcgactgtccatcatatgccttttttttttccttttagtcacttgaaccgagtgactccactcgaacagatttgcgtaggtgaaaaccgtcaactccaagctcgtctaaagaatgttatttctttatagaaaatgaagcaggctctagagaagaaggaccaagaacttgccgcagcacagaaggaggcacgagagaaaacgacacttgctgacaagaagttggcctcattcaataagttggaagaggagaattccaagttgaagattgccattactgaatccaaccaggaggttgtgaggttgaagaaggacacggaaaacttgactgacgaggttggaagtctcaaggaccagaagggtgaactggaggcttatctgggacaacttgccgtgaagctagtcttgaagcttgaaggtatttccttttgtccgactgatttttcgatt

SEQ ID NO: 75168 - DNA, 503 bp, Triticum aestivum
  Clone ID: PAT_TA_75168
ccttcctccggacggctccaccaacaccgacgacggcgaagaggagtggccacacagggccaagcccctggcgagatcgtaagtgcccggataccagagtgattcatagtattcctccattgcacaacttttccttatgtcgaacattgtttatacagtccacccaaagaccgtctcgacgtgtcgtcgagcggttccctggattcgtcggatgtgaattcgcttccgatggctacctccccccaccctacggaagacgccgaggtgctgccccaacaggttccaagctgggaggaggtggtcctggaggcgccgcagggcaacctcccagactccaggcgcaatggggattaaacccccaagggctccgagtccggccttgagccggtcactgcgccggaaccttcaatggttccggactccagtaggcagcctccttcccagaggagcgagcctaccgagccggttacctccgtccaaccggaggcaccgcacaatttgct

SEQ ID NO: 75169 - DNA, 304 bp, Triticum aestivum
  unsure (1)..(304): unsure at all n locations
  Clone ID: PAT_TA_75169
agaagagagagagagaactagtctgggagtacccggtgataaccagcgtgaccgaaaggtgtttcggatgccccgacaagcgttggggggcctttatgggccaaggggagggggcacnaccagccactaaggggctgtgcgcccctcccaccccctctcacgtaacctggagaggtgggggcgcctcccctagggcagccgcccctcccggcttggggggctagtttcctaggggtgggggcgcccaaacccatctagggtttcccctgtggccgccgcccctcccctagggaacccaagggtg

SEQ ID NO: 75170 - DNA, 552 bp, Triticum aestivum
  Clone ID: PAT_TA_75170
caggacaatgtacgatcttgttaaatggagaatcatctccctcagcatcatcttcagctgcattgctcttactagacttcttcctctgtgtaaagggaaatgcaatccacattagaagactagccacaaaaaaagagacagagaaaacacagatagaataacaatgaagaaaacaagcattccacttcaacaaacctttggaacaacatccacctcctcgccagagatcaccacaaacatcttcgtcgagatcatcacgggcacgcttgggtgactcttagatgaaccacagtctttgcttctaccactatgaccatccctcacaaaatcagcaagcacaaagtcgtcatcatcagagttgggacctgcagtgacatgtagtcgcttgcaccgagaatcatcctttccaccagcttcagcagttctcttgccaagattcttgttcatgccagcaacacgtggactcggccgaggtgtaccaccttcctcagcaacgatactcagcatcttcttctgcaaagaaggcttcttcaccttggcaaatttggcacc

SEQ ID NO: 75171 - DNA, 489 bp, Triticum aestivum
  Clone ID: PAT_TA_75171
gagagagagagagagaactcaaaaagcatacatagcaactcaactacacataaaataaacttcaaaagattcaattgtattcaatgaataatctgatcataaatccacaattcattagatcccaacaaacacactgtaagaattacatcagactgatctcagaggagatcattgtattgaagatccaagagagagagagagagagagagagcagccatccagctgctactatgtaaaggaaatatgccctagaggcaataataaagttgttattttatatttccttatttcatcataaatgtttattactcatgctagaattgtattaaccagaaacttgatacatatgtgaatacatagaaaaaacaccgtgtcccttgtaagcctctactagactagctcgtttataaaagatggtcaagtttcctaaccatagacatgtgttgtcacttgatgaatgggatcacgtcattaggagaatgatgtgat

SEQ ID NO: 75172 - DNA, 215 bp, Triticum aestivum
  Clone ID: PAT_TA_75172
ggtccaccgccttgtgtgctcttgtgcgcggcatggtcaatgtggtcaaggaacgacttccatcggaagagtactatacgtggagagtgctgacagctgggtccatggccgcagcaaggaagtgcctccttattgcgcgcaataataatgattcctccacgtgacagcagggacccactagacgggccaccgtatttcacgaaaaaaaaaaaaaa

SEQ ID NO: 75173 - DNA, 355 bp, Triticum aestivum
  Clone ID: PAT_TA_75173
ggcgagggagaagacgaaagcgctggcggacgctcgggctggagttctgatgtattgcaagtgcacagggctatgtagcaattttgcagtaaggtttttgatctcacagggagcgaaaaggaaggtattacaatccccgcagctgcgttctcgcttttgcagttatgttcaaatccaaactggagtttggtaatacttcgggttaagtaagttgctaaggaaaacaactaaagaaagaattaaagcaaggtactggaacgaatggaaaataaacactaaatacatagaacataaaccacgagaaatttgatgttttagatgagatcgttggcatctaagtacggtctcgttcagc

SEQ ID NO: 75174 - DNA, 498 bp, Triticum aestivum
  unsure (1)..(498): unsure at all n locations
  Clone ID: PAT_TA_75174
ctcagccaagggaaatccttgctgagtctgagcagtcccaagccgccggagcaaaattcgaatatgaggaagtctggtcgtgggctgaaaccgcaaccacaagatggggagctaccggaagaaatgacctgcagaagggcggatgggccacataggtnggaggggttgggcagtcgctcganaaaaacggagggggcaatggcggccgaaaacctagacgagccaggatccggagaggagcgcagatctaggctgcctggaccggagccgtaggaacgcccggtgagttgaatgagctggaaggggacgcagctccaggagcccgatggagtcgaagccgcacggggggtggatgaaagccaaccaagcgcacctgcaaatgggggtatgcggagccaccaacatcccgatnatccgaaggagccggaagatgacgtagctcgaacataggggtgccggatctggagatgctccagccagtcatggacacaggtccat

SEQ ID NO: 75175 - DNA, 506 bp, Triticum aestivum
  unsure (1)..(506): unsure at all n locations
  Clone ID: PAT_TA_75175
agtcggggatgccgcactgttcaaagtgtgcggacttgtcttgctcgtattatggggtgccataagaagcccctggacaaactctaacataccacagtgtacggatgcaatatcaaatggacatttgtaagaaaaaaatgctcaaataagaataataagctgacgctctatgtgatctcccattgatggataatacatttaagcgtatgtttacaatgaatgccttaagcggagataaataggattatttgacataccctatccgagggcaggctgtgtatagatngataaagcaggtataatgatcataaatagattccacctgggtatttccttctgtgcgcaaagcatgttgcctcctttgttttctctcctatgtaagtccgatnatctggctcttctggagaagctgcactaaagcaatgtcctgaaaggtaaaaggaaaaattaagaaggtgtgtggcggttataccgcactgttgactgagccactgcttcgcctccgc

SEQ ID NO: 75176 - DNA, 449 bp, Triticum aestivum
  unsure (1)..(449): unsure at all n locations
  Clone ID: PAT_TA_75176
ccgtcccccgatccacaacctccggcgggtacgacgccccccaatcctcctccggcgggtacgacgccccccaatccacctccggcgaagaagcagaagcaggcggacagcaaggaaacccgctcctggactattaacccggacccttatcctnagaccacaagggtaccggagccatcactgaagcctctcctcccaaggccttgggaacttagtgaagctgaaaccaaattggccgcgtctgctgattatgagaaatggaaggcggatatgaaggcgataaaagagcctgagcccaagcaagtattcactgagaagcaaaagaagtgggctaaggattttttgacgacaccgtcccaagccgagctgaatatgcctgacgactatggacatgaacttcgtaggcgagcaaaaatattgaaggaggagaaagaaaaaaaaaaaaaaaa

SEQ ID NO: 75177 - DNA, 535 bp, Triticum aestivum
  unsure (1)..(535): unsure at all n locations
  Clone ID: PAT_TA_75177
cgagctacagctcgaccgctcaggtttgtcgacgttccagggatggacccgtgcacaagtgtcatgccaacgtgagtagcccctgtggtgtggtagagaatcaagcacgtgataatcatacatagattaagcatggaacgcaaactagctcatgtaaatgcatgaacgatacgcgccactgggtcacgcccgagcggcttgcggatgatatcacccgaaaggcgcccccagcaaggtaagttaaagacataaaaaagaagggatacatacataccacatggacggatccaggcggcatgggaatgatgcagccctgagggcctcccggctaaatnaacttggaaattttcacctggttccgttgatnaaggggtgttgaggcagctgaaggtacgcggcgaangggttgctcctcacgagccaccggggcccttagcctcgggaggctctgggggtcccggcggttccttgaggaccatttccatctctgccaggactacgtggtgcctggcctcctgacccgccatgacactcc

SEQ ID NO: 75178 - DNA, 461 bp, Triticum aestivum
  Clone ID: PAT_TA_75178
atattcggtacaatttcgatagcttattgagatggtcatgtgtgtaggaaggtggatgctcactttggtattgggaagaagaatacattgatttattgatagaaagaaacttaatagatgtttgtgcagtcgttggtagaattgaggctaatgatgtgactctatgtccaattagagaagaaacttgagggaagcaacatctacttctttagaaccaaagaaggtgaatgaagaatgcaagatcaataatctgcagatcaataatgaaggcatggagaagatgttggtccaactagtgggaggagttatggaagttggatatcttctaaaattcctacttgtaatttttgttttctttggtcttgctattctagcaaagatttggtgaattatgtatcccgtgcccttgaagaaaaaaaaaattacacaaaattgaaatgccaattactgatatatgggcc

SEQ ID NO: 75179 - DNA, 561 bp, Triticum aestivum
  unsure (1)..(561): unsure at all n locations
  Clone ID: PAT_TA_75179
ctccggcaaaaccaaaatggatttatttattaaatcttcatttttcctaaatttgggaaagtcatattattccctctctaaaaaattttataggaaaaactttatgaagataattaaataaatccaaatgatcctattttcaaaatttgagaaatcccaaatatgaaaataatgaaacttccaactctctccgagggtccttgagttcgtgaaattttctaggatcggaaaatgcgagaaaaaatatgatatgcatgatgacctaatgtataacattccaaattgaaaatttgggatgttacaaacctacccccttaagatgaatctcgccctcgagattcgggttggctagaanataggtgagggtggtccttgagcaaaacttcctctctttcccaggtggcttcatcctcagtgtggtggctccactgaactttacaaaacttgataactttgctgcgggtaactctgctggcataatcgagaatcttaacagtttttcctcatatgtcagtctccttcaactgaattgcttcagtggcactgtgtctcttacggtcc

SEQ ID NO: 75180 - DNA, 277 bp, Triticum aestivum
  unsure (1)..(277): unsure at all n locations
  Clone ID: PAT_TA_75180
tccccgggctgcaggtcagcaggtcatcccagtcacgccctcacggacaagctcaaccactcgaccggccagcactttacttgggccctttcctccggcgtcactttcagagaagcgggtttttcagctcggtcgagggagaacggaggaagaccagtcgactatcctggggtcgcctggtcctgacagtagaaccaggtcgactgccaaccatggaccgactccnggaaagtgatggatggaaaacagctctttcccctcgcctggatcgccnagc

SEQ ID NO: 75181 - DNA, 428 bp, Triticum aestivum
  Clone ID: PAT_TA_75181
atccaaagggttggaataatgacccagcggcatcggcacatgctgtggcggtttattgttatgacgaggtggatccaccatgcagcggttgaacctggtgtacccatcccaggtgcctcaacccagtttaacaccgcgcgggttactggttcctactcctggcgtgttaaaaatatttcttgcttcataaacagatggcagacgggtctgatgcctcctcctcatgacatcgtttgaagcattctgatccaacatgagctggtaagactccgcctgaatccgttgtgactgggcgtccaaagcagcctgttcctcaaccatcttagcgctttctgcatttaactcctccttagcctgtgctatctcatcgcgtagtcttgtgatcgccgcgttatgttgatcttgatcctccgggttaaccaccattg

SEQ ID NO: 75182 - DNA, 553 bp, Triticum aestivum
  unsure (1)..(553): unsure at all n locations
  Clone ID: PAT_TA_75182
ctgcaggctaccacgagattgtagaggctaaaccctaagagctagcctatgatggtatgattgtaattgtgatcggccttctaaggaccatcctctccggtttatatagacaccggagagggctaggtttacatggagtcggttaaaggaaggaaacataatatccganatnnttgcccagcttcttccacgccaaggagagtcccatccggacgcgggccgaagtcttgagtcttctatcttcatgcttcaatagtccggacgatgtatatagtcaggctctccgtataccccctaatccaggactcccttagtagccgctgaactaggcttcaatgacgatgagtccggtgcgcagtcttgttttcggcattgcaaggcgggttccctctccgaatactccgatatacccatcatgacgaacagtgtccggcatctcatcaatgttgtactcctcggcttcagttcttcaataatgaccatttccacatgtcgagcgaatgcgaggagtcgaggcatttttgcatttgccaccctcggtccttcgggctat

SEQ ID NO: 75183 - DNA, 590 bp, Triticum aestivum
  unsure (1)..(590): unsure at all n locations
  Clone ID: PAT_TA_75183
cgcagtcacagattgcttgttgtttgaggctcgatcggactgaggctggccgtccgctccgtcttccagtgtgttgtcttcgccctcgtcgcttgaggcgatctcctccactgagtcttcatcatcgtccgggttcagcccgaaccagtcgagcggcaccacggcgccccgctcgtctagngctcagggacgaagacgttggtgtcggcgtactcaacaagcgccgccacgtgttgagcaagctcacggtccacagccaccagctccggcccggcctcaacccagaaagtgggcagctgggccaggttcagcctgggataccacaccttgacgaactccagggccgtccgcgcacccgcccgagctgctgcacccttccaagcctcgaagcggccgactgctacctccagccagtcagcagtccgactgggggtacgcggcacctgggcatttcgccagagggcggccagcacctgggacccggcgtgctgaaggcggcggagcagcagtgggccagctgaaggcgcgtcccgactgccagaagttgctcgttgaggttccgaggcgcgttgggcagaatatccactcca

SEQ ID NO: 75184 - DNA, 519 bp, Triticum aestivum
  unsure (1)..(519): unsure at all n locations
  Clone ID: PAT_TA_75184
gcagtgaatcggcacgagggagagggagagagagagaactaaggaagagtcgatccaaacgccagaacagtcagctatgtcgaacagggtgttagctactaattttgtctgagcctatacgccaaatcagcctatccgtaagaatgatcacaactgaaagaagctgttaaagtgaatgtggacgcgccatttcatgcaaaaactttgtcaggagcttgcagagctatagctcgtgatgattggggcaattttttggcagctgaaacttgtgttctaccccatatctataatgttcactcagtagaattattagcggtttgaagtgggttaattttagcagcaaatttgggatatactaaggtcatcatagagtctgacagcatggtggggttggagaccatatttgatacaaaatgcgtacatnagaatcgatgtttcaatcattgcaaagtgcatcattgtagagtgccctctatgtatcgcctttgtttattgcactagcgaagcaaatactgtgac

SEQ ID NO: 75185 - DNA, 545 bp, Triticum aestivum
  Clone ID: PAT_TA_75185
gcacgagggttgccgtcaactgaaatcaaccccgccgttgctgccatagcgagtctccgccgaactagggtatggactcgatctttgtgctattccccaatccgattcttagcacattgtgatcatcatgattcttgccacgtttgttaaacttctatccagtcaatgaactcatagattaggtttaattcgaaaattttaaggttaggtttccaccgaaaccatctcggacccaccgagttgaaaaactcggtcccaccgatttggcttatgccattgcacaagtgagactcagtctgaccgaaaattacttatcggtgtgaccgattttggaactctgtgaaaccctagcagtcttggtgccactgaactgtgactcggtctgaccgagttcactagtttaggtgccaaaactgcttcggtatcaccgagtttagaaatcggtagatccgagatgctttcagttggaaactaaaactaagtttttgaattattcttttgcaaaaatctctgcattttgtgatgcttatccactctatctcatc

SEQ ID NO: 75186 - DNA, 523 bp, Triticum aestivum
  Clone ID: PAT_TA_75186
cgcagaaattgacagtggtgggctacccttctaacaaatactctgaacttgttataggatccacacccgttgaggtacaatagccaccttctacctctccttctacaaattaacattatttcttattttggaagatgtttgttcatctgtcattcagaaaatgattccgaacaagcttgacccaaaaattgcgcacagtgaaggtcttggcactagaatctataggccccaacctggagcaagttgtcaatttcctgagatgctttccgtgcctggagaagctatatatcgaggtgatgttcctttcctgttaaattttaaccataagggagttcaatttgtgacacctttttccatgtttacaatgacaatgtactacgatttctgaaggattcttttggaggatttcagtacatacatgtcccccccacatattgattgcttgatccatatggttaccataaattagcatttctcctttggattcatctatactagatatttagggaacctttcatccacg

SEQ ID NO: 75187 - DNA, 403 bp, Triticum aestivum
  Clone ID: PAT_TA_75187
gctcagagagagagagagagagaactatatatagggagtgctatttcggccaccgggacaagtttcagggtcaccggcattgtaccgggaccaccgaaagggtcccgggggtccaccgggtggggccacctacccccgggggccatatgggccaagggcaccagccccaaaagggcccatgcaccaagagataaggaaaggaagagtcctaaagggggaaggcacctcctaggtgccttggggaggaaggtctcctccctagccgcacccttccttggaggaagggccaaggctgcacgcccccctctcccttggccctatatatagtgggggggaaggaagggcggcccagtctaagccctggcgcctccctctccctcccgtgacacgtctccctcctccc

SEQ ID NO: 75188 - DNA, 434 bp, Triticum aestivum
  Clone ID: PAT_TA_75188
aagcggatatcacgctttgttagggtgagaggcattcacaatcttccaagctataccccactacgggtacatgaagctcaaaatgcccggacccaatgggattatccctccttgccagtgatccagatacagcactccgcgctgaaaataagacagccgcactggcccccctaagagcttgtccgaagccctagcgacagaggaactaactacgctgcgctccacggtggatagggacgatgtgatactcgataagaggtccaagcccacctcttttaaaccagcagacgaaatagtccaatttcaggtccatccaacggaccccacaaagactgcctccattggggcacaattaagtcctgatgtcgaagccgcactatgagaattccttcgggaaaattgggacatttttgcctggcacccttcagacatgc

SEQ ID NO: 75189 - DNA, 582 bp, Triticum aestivum
  unsure (1)..(582): unsure at all n locations
  Clone ID: PAT_TA_75189
ctgcaggactttcacatatttttggcaacattttatatgatttgttggactaacctattgatccagtgcctagtgccagttcctctttgttgcatgttttttgtttcgcatatccatatcaaacaacgtccaaacgtgataaaaatttacggagaattattttggaatatttgtgatttttgggatgtggaatcatcgcaaatgggggcccacagccaccacaaggcacctaggcgcatcaggcggcctaggcgcgtgatggtggtttgtgacctcctcgtaagtcggttggagctttacttcaggcgcaaggaagcttatatccnaaaaaatcatgttnaaatatcagcacaatcggagttacagatctcccagaatataagaaatggttttcggccagaaaacaggaacgcgaaatagaagagaatagagagggggatccaatctcggaggggctcccgcccctccaccaccatggcaaccatggactagagggtgaactctcctcccatctagggggtaggccaaggaataagaagaacgaggggggctctcacccctctcacccggttgcgcccgaac

SEQ ID NO: 75190 - DNA, 450 bp, Triticum aestivum
  unsure (1)..(450): unsure at all n locations
  Clone ID: PAT_TA_75190
ctggccagtcttcgtaaatccttgacgcgctttggtgcttcaatctgctcaatggccttgatcttgtcgggattggcttcaattccccgctgagacacaaagaacccaagaagcttgcgnngggaggggactccaaacacacacttctcggggttcagcttgaggttgatcttgcgcagatttgcaaatgtttcgtctaaatcttgaataagggtcgccctgtccttgctgttgaccactatatcatccatgtaggcttccacatttctgtgcatttgcggctcaaaagcatgatggactacccttgcgaatgttgaaccagcattcttcaaaccgaaaggcatccgtacgaaatagtatgtgccacacggggtaatgaatgcggtcttctcttcatcctcttctgccatgaagatctgatggtatcctgagtatgcgtcaagaaatgaa

SEQ ID NO: 75191 - DNA, 335 bp, Triticum aestivum
  Clone ID: PAT_TA_75191
gttttttaacgttcttttccatgattaccacagggatggacgaagaaggcggggcagattcattgtccggccccgttgccggaagaaccaaccggaccacttctgacgaagatgctggtcccggtgccttacaaggcaccgaagaaagaggccaacaaaaaggccaatgagactaggagcggcctccgtcgccgcgatgtctcggacatgaagtccgaagactccagtgaccatccctccttcgaagagtacgaggaggaggaagaggacgaggaggaggaagaggatgaggaggaagaagagcttgagtcccctacaaggggggggggggaaga

SEQ ID NO: 75192 - DNA, 529 bp, Triticum aestivum
  unsure (1)..(529): unsure at all n locations
  Clone ID: PAT_TA_75192
gggtcaacccacatgttgacactgcccaccggcagactgttcaaccaggtgtgggctgagccttggagcatgagcggtgcgtagcgcacgacgagtcggtggttgcctcctgtgatgccgattgtggtggtgtagtcggtgagccagtcctctggcttcactgttctgttatacttgggggagttgtgggggagcgtgaaccctttcggaaagggctcctcccgaatgcgcgggccgaagcatgttggcctgactgtgctgccttcctccacctccagggagaaagcaagccggtcgaggcgattgcgagcatcggtgtcgtcnatggcgcgcgcgccgagtcggctggcgaccgggccatggggggttgggtcagttggagtcgaacgccagtcgggttggtcgtccgcgtcgattttccggagccngcttgtcgcctaggccgcctgcagccatcggggtcgggtcacgcttggtccgggtgcggccggagtgcaccttgccgggtggtgaggaagccgtgtgctga

SEQ ID NO: 75193 - DNA, 495 bp, Triticum aestivum
  unsure (1)..(495): unsure at all n locations
  Clone ID: PAT_TA_75193
atatttttaatgaataaagtgtatgtgtttttcagaaggaaaaaaccaacgttagattagacagggncagattgaacaatttttatgacaatttatattggcgcgaggatgaccaatttagtttgcaagcatagcaatttcctggcgaaaaatgtgtatggaggcggatttctcatactcgccaactaaacttgccatccttgatgaacaaatttccataaaaaatgcttgttttgtcatgtctaaaaatccgacattcgccggatatcctagtcctttctatattgcagtattccccactgggtgggcattcggttttagccaaaaatttgggttttcaaaactattacccgatttttttcccgaaaaaagagaaacacgaaaattcgggcacctgaaatttctggttcgggttcagtcccgaatgacccgaattagcacaacaagaaaaatggcagcagccttcaaaaaaaaaaaaaaactcaagggggggcc

SEQ ID NO: 75194 - DNA, 247 bp, Triticum aestivum
  Clone ID: PAT_TA_75194
gaacaagtcaaaaattatagatatgttggagacgtatcaagcatccccaagcataattcctgctcatcctatgagtaggtaaatgataaaaacagaattttgatgtggaatgctacttaacatatttttcaatgtaattttatttattgtggcatgaatgttccagatcccaaaagattcaagacaaaagtttaatattgacataaaaatgataatacttcaagcataccaaccaagcaattatgtt

SEQ ID NO: 75195 - DNA, 567 bp, Triticum aestivum
  Clone ID: PAT_TA_75195
catgaaactaccacacgagcgtccgggctgcgcttgcgctctttgcctcttcgggaagtcgaacaatgatagagtactactgcactggaggagtactacagtacgcttctggccatctgacaccgattgaactgctgcatgtccaccgtgtgcgggagggagagcgtgtagcgaaagcttctcctagtcttgccagccaccatgctcatgggcgagggagggacgctcctgcctttgcgtgtataacaggtgggcccgacaggtgtgtgttcaatctgtcatacagccaaaggcaggtgcagttaagtccgcgagggagaggataatcacacttctcgttaatgtacgagttgacgcgacacatcaaagcactgcactcgatatatttcaataatttgtgtttaccgatgcattaattacaacgcatgcatgcatgccgtgactctccttttgatacttgcatgtgttgatttaatgcaccttgaagtagtataaaatatgtgatggtaaagctttgtaataccccggcccaagtcgagagatggttgtgcacgaggagggcgagat

SEQ ID NO: 75196 - DNA, 319 bp, Triticum aestivum
  Clone ID: PAT_TA_75196
ccgatgcttccagagaccacctggatagttttgctggttgtgtttttagggaaagaactgttgatcaaggtgaaactctgttgaataatgtgctgaccaatgaaaataattggacacttcctgaaccaactcctaagccaactccgaagaaaaggggtgttctatttctcagtcctgaagatatgcaagaggcaaagaaatttatgaaggaaaaaggtataaaagctgaagatgttaagaatttacctcctgttgaagaaatacatggtcttaatttaccgcctgttgaagaaacacttgataacccgacacaagtagt

SEQ ID NO: 75197 - DNA, 527 bp, Triticum aestivum
  Clone ID: PAT_TA_75197
cagagagagagagagagaacttgatgaatttagcacatcgccaaaaggcgatgtgctgaaagatatccgcggaggtaactccatgatcggctgcccaatcaaattcgatatgcatggacgcatgcggttcggggcctttggccggggatgaatccgaggatcaaacgacacaggtctcattggaggtgaagtcagtattcggctctatcgccactgagtgtgtggcctccgaggcggggtccatccgcccgtcctcggacggcgcaatcgactccggatctagggctggagtaagcataggtgtgatgtcccgaacaccgtccggtggcagagctaactcgtgctcgtcgtgactgtgcggcgcacctgacatgggctcgaatccgtcgaagatcaagtctccgcgaatgtcggcggtgtagtttaaatttccaacccttacctgacggccagaggcatagctctcgatctgctccagattgcccagcgagttggcccgcagtacaaagccgccgaatacgaagatc

SEQ ID NO: 75198 - DNA, 199 bp, Triticum aestivum
  Clone ID: PAT_TA_75198
attaaataattgatgctaatatccatccatgttgctgttagcctcgtggccacataaccaggcacgaccaggcgttcgaaatcggtcgcctgggccaagctacttgcagtgtctggagttcagccaggctaattaaagtgcaatggaacccaggccaggtgggctttcttttttacagggtagcaaccaaacaagcgtg

SEQ ID NO: 75199 - DNA, 469 bp, Triticum aestivum
  Clone ID: PAT_TA_75199
gagagagagagagagaataattacatgtagtgattgatcaaaattatcactacatagctagcttgagacctaaattacagaaagaaatcacttacagacaatagcaactgacgatagacttgtcgagtgcgtcttgattgtataactgaaatattgttcgaatactcaacggccagagctttctcatggtagtaatgctcatgcttgacattcaccatgagggaatcgcgattggaaatcttggtaatgttcatataccattgatgcaattcatacattctcgttgggaggttcttgaccttgtctggctcgaccaaaggttggccctggacatatttccgttttatttccgattctctaagcgaagacatgggctcgatttcgaggagttgtccaacagagatcttgggcatttcagcctgcattatttgctcctctgttattaccacatcgcccagcaggggaacgc

SEQ ID NO: 75200 - DNA, 496 bp, Triticum aestivum
  Clone ID: PAT_TA_75200
agctcaacgaatcaaagtagggcaccagaggaggtgggacccacccaggcggcctcccggcgcggccaggggttgggccgcgcccacagggcgcctggggcccccctggccctcctctggctcatcttctggttctgggttccttcgggtgcgtggattttctgtgattttttggtggaattttctgagatacctaaaaatccgttttcctgcacacaataaaaccatacaggcagctctgctgaaaacaacgtcagtccgggttagtttagttcaaatcatgcaagaatgaggtcaaaacaatatcaaaagagtttggaaaagtagatatgttttagacgtatcaacaccccctagcttagcatattgcttgtcctcaagcaattcagttcaacgaactggacgcgacaaagaaaactttgacaaactcttttgtttcattagatgtatataagcatgtactacgaaaagagtctagcaagtattgaaacagtac

SEQ ID NO: 75201 - DNA, 188 bp, Triticum aestivum
  Clone ID: PAT_TA_75201
cggctgtcttccgcttttgctgacgaggcgggctgctcggacgcgccggcgtaggcggagtgccctgatcactcaccggaggaggaggcggtgtgccctgactcaccggaggaggaggcggcggaggcgtccagttcggaaggttgatgagcaccttccgccatagacatggaatctacagagcaaga

SEQ ID NO: 75202 - DNA, 443 bp, Triticum aestivum
  Clone ID: PAT_TA_75202
ggatccggcgaactaacatcacctagatcatgttgacgagcttgatgtttttgtccaccatgctttggatgcacatttgtagcgcaatcatcttgtccgatgtggatcaatttgggcccttctctatccaggaggtgagccacattggagctatggacttgaattcaggagtcgcggcccaggtggtatcgcggggctctgtgatatagaaccacattttctgccactttgacggtctccgcaaaagtacccttgggccatgtgatgttgggcagcttgctcaccatggcgcctccgcactccgtgtgttggaaatccaccaccttcggcttcacgttgaagatcttgagccacagtccgaagtgcggtggaatgtgaaggaaagcctcacacacgacaatgaatgccgagatgttgaggaaagagtttggagttagatcata

SEQ ID NO: 75203 - DNA, 257 bp, Triticum aestivum
  unsure (1)..(257): unsure at all n locations
  Clone ID: PAT_TA_75203
ggccgaagatactcgaccaagaagcaatcactcgaccaagaccaaaccactcgacggtcgggagacctaaaggcactccgcatgctaacggtcggttattaagtagcttttatggtcatcatatcactttattaggggcgttaccagtaacgcccgacattaatgtnatttaaacaatgcacaactgagggcctgaggggtccggcgaactctctataagccacccctctcctcagtgtaaagggttcgcacccctc

SEQ ID NO: 75204 - DNA, 462 bp, Triticum aestivum
  unsure (1)..(462): unsure at all n locations
  Clone ID: PAT_TA_75204
tttgctctcggtgagaccgagtggaactcggtgagaccggaaagttacaaaggggaaacactagagtttacattgcaatctcggtgggaccgattcgctctttcgatgggaccaaaaagttacgaaagggaaacagagagtttgcaaccccatctcggtgagaccgagatccctaatcggtaggaccgaattgctagggtttggcagtggctaatgacaagtgaaactcggtggcgccngataggaagaatcggtaggaccgagtttggcttagggtttaggtcatatgttgatatggaaaaatagttgagggttttggagcatatcactaagcacatgaagcaagaggctcattaagcaacacctcatccctccttnatagtattggcttttcctaaggactcaatgtgattttggatcacttacatataacatgaagagtcttgagcttttgagcttgag

SEQ ID NO: 75205 - DNA, 368 bp, Triticum aestivum
  unsure (1)..(368): unsure at all n locations
  Clone ID: PAT_TA_75205
ccgcagcaggcaagtctggggacccccgttcccagaatgccgacagtagcccccgggcccaatgtgcgctcgggcttgggttcacggtgaagccaagggtcaagtacggagcactgcgggccccaaaagcctgcggcctctgttgacgcgtggcggttgattggacgtgggcgtctccgcttccccacgctgcctcggcaactgcacgacttgacaagtccctacgacatgcaaggaaaaccatcattacctgcgattgtgggaggcgccngttggccttctcctgctataaattgggacggggcggagcccccgtcgcccatctcttccttgtttgcttgcttcttcctccttgctccattgcttgc

SEQ ID NO: 75206 - DNA, 250 bp, Triticum aestivum
  Clone ID: PAT_TA_75206
tgtccttcctcgtttctgcttctgctgttgaccttaatgcttctttgttgcgccgataggcctacacccacgcgaaaggaggaaggaggaagcggtggtattgctcgggaccccatcgcccgcggcggctgcgcccctcttcgtggagaaggggcagtgacagcgctcgcgtttcttcggccagatcgtccttgcaaggcttgggggagcgtcctcaagaggaggtggcccctgctgccccactggctcc

SEQ ID NO: 75207 - DNA, 463 bp, Triticum aestivum
  Clone ID: PAT_TA_75207
gttaaagcagagcatcaaccgcctgctggcacccttcaacctttggctattcctgagtggaaatgggataaaatcagtatggatttcatcactgggtttcccaggactaagagagggaataatgccatcttcgtcgtgatccaccggtctttccgaagtatcccatttcctaccagttcgtgagagtatcactgctagccagctagctgatttatacatctcctgaatagtgtctcttcatggtgtcccattggaaattaactcagaccgtgggagtctcttcacctctcgtttttgggagagtttccaaaatgctatgggaactcgtctctcttttagaaccgccttccatcctcaatcaagtggtcaagtagagcgggtcaatcaaattctggaagatatgctccgagcttctgtcatctctttcggaatgagttgggacaaatgccttccattcccggtg

SEQ ID NO: 75208 - DNA, 277 bp, Triticum aestivum
  Clone ID: PAT_TA_75208
gcaagcgaaagcttcgcttccgagtagtgcttgataaccaccttgaaatggagcgatgtggaacgttaaattttcgctgtggaagttatcgggaaagccgaatataacctctagtagcagggagcccgtgcaatgggcctctgggcctggcgttactcctttaaaggtagtattgctgcggctaatttttgttgggtctatccccattttgcggactgtgtcctgatatattaggtttaaactgctgccgccgtccatcaggactcatgtgaagtgg

SEQ ID NO: 75209 - DNA, 211 bp, Triticum aestivum
  Clone ID: PAT_TA_75209
tcttaggctcattccacagctcgatgctaatcgggatcatgtccctaacaagaaccccacactgagtagaacatgcttccttggtccggaggggtttaatcggttggccatcgcgcgcgattcctgtgatcgtgagcctttcatccgggcacaactttttcttcgggcctcatttctttactgaagtattgcttgatctggagggctatat

SEQ ID NO: 75210 - DNA, 127 bp, Triticum aestivum
  Clone ID: PAT_TA_75210
gttggccatcgcgcgcgattcctgtgatcgtgaacctttcatccgggcacaactttttcttcgggcctcatttctttactgaagtattgcttgatctggagggctatataagagaagaaagaagagt

SEQ ID NO: 75211 - DNA, 421 bp, Triticum aestivum
  unsure (1)..(421): unsure at all n locations
  Clone ID: PAT_TA_75211
gaattgagcaatttctcgcttcatacgagtccaccaatacgactgcttgagatcatgatacatcttcgtacttccaggatgaatggaaaggaaggaattggtgcgcctcattcataatgactttccttagatcatctttagngaaccacaatccggtcctcgaagaacaaagtgtctctgtcatcgatgcgatagcacttgtatttggaaagacccttgtcgataccacgtttcaccttcttcaccatggcatcaaggagttgtgcctcacgaatttgatcttccaaagtaggagatactataaggttggcaagaaagccttgaggaaccacttggagattcagcttgcggaaagcttcacaaagatcccgctggaaaggcttgagaattaagctgttgcaataagctttcctgcttaaag

SEQ ID NO: 75212 - DNA, 354 bp, Triticum aestivum
  Clone ID: PAT_TA_75212
ccagtaatattgctacaattttatgattactttaggaaaatcaaagaaatgtgcttatggtatagacacataacatggccccaaaaaaaccaaaggtacccgatgcaataccccccttagcactgcgtcagtttggtaatttttgttagaaaaagtactcctctgtcctacaatatgatacattcttacatccaaaatactcacatgttaaatgtaatagcgtcttatattatgagatagagggagttgttaattgcatactaatttgatgatgagttttggaaaatgaaagaaacatgtcaaattgtaaggcatttggatgagctctgtgggaggttgtctttttggaaaaca

SEQ ID NO: 75213 - DNA, 154 bp, Triticum aestivum
  Clone ID: PAT_TA_75213
gagctcatcatgcttggggaagcgtcgaggacggctacgatcgccggcgatctcggcggcgcccgaggttgaagacgattgcatggagcgcgatgcagagcttccccgctcggatggctcggcaggaaggacgggggcatcacagcggttcttc

SEQ ID NO: 75214 - DNA, 118 bp, Triticum aestivum
  Clone ID: PAT_TA_75214
ttgttccctcgaaaagcagtcaaagtggcgccgcaagcgccgccccaaatcccacctcgacagaaatagcagtcacacagaccccagcgctgaacaggtcgaaccgctgccggacaac

SEQ ID NO: 75215 - DNA, 436 bp, Triticum aestivum
  Clone ID: PAT_TA_75215
cggttggtgttaccaaccgggactaaaggtcccccagcccccggcgcgggcttgtgccacatggtgggcctttggtcccgggtcatgctgaaccgggactaaagggggggacctttagtcctcaccctttagtgccggttatagaaccgggactaaaggtcctttatgaactgggactaaaggtcgtttttctactattgtaaatgacttgtctcttgttgacccgcatttacattgatacggcttgaatgctaaggagggagagggtagcggttcccgagatgttgaatggtcaatgatgcgtcctccattagcatgtagagcgaattaattggagaagcagaatagagacagcacgatctgaatgcaacacagtttggactctcatataatggcgcccaccactccaatccatctactcctattctctgcgcca

SEQ ID NO: 75216 - DNA, 269 bp, Triticum aestivum
  Clone ID: PAT_TA_75216
cactattatggatagtcaaataatgggaaaaattggattcaattgtcaactggtcctatcgaaagtaggattgactactgattcgagccatcgcacatggtttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttctt

SEQ ID NO: 75217 - DNA, 232 bp, Triticum aestivum
  Clone ID: PAT_TA_75217
tgttgtttttctgttttctaatggatgtatagaagttattttttctgtttttagtgttagatgcttaattagtatgaaatagcgtatagaattttgacatatgcaatgatagcataattagtgttatatagaaatgttagttatcaaaatccaatcattaaaaaaatgttactttttgcgggcatatagctagtatttgttctcaacgatgcccggcccgcatcctcgccgt

SEQ ID NO: 75218 - DNA, 431 bp, Triticum aestivum
  Clone ID: PAT_TA_75218
ctcggaggcttagctgcagcccagtgctcacctaagtgtttaaaatcctaccgagtggtgaatcttcctctcactcgggggcttagcagcagtctagaactcgcctaagcatttgaagtcctaccgagtggtgaatctgcttctcactcggaggcttagtagcagtccagaactcgcctaagcatttgaaatcctaccgagtggtgattctgcttctcactcgggggcttagctgcagcccagtgctcgcctaagtgtttaaaatcctaccgagtggtgagtctgcctcacactcggaggtttagctgcaatccaacactcgcctaagtacgatgatcgttccgacccgcaaggacgacgaggtgaaggtcaactgttaccttctcctccgggcttcggcgcggatacgacccttctcctttgagcttcga

SEQ ID NO: 75219 - DNA, 395 bp, Triticum aestivum
  Clone ID: PAT_TA_75219
ccagttgaccagttgactgagtcaacgtgctgaccgggcagcccccagccactgacatgtgggccccttctgttattagtctaataaatgttttataaataagagtaattagattaacttaaacactcactgaaacccggggcccacacccctaattaatcctgctagattagtttaatccactgttttacttacagaggccgacatgcgggtcccactggactcacaggtcaggtttgaccctggtgagcgcgtctgttgactgctgacgtcaccccccacacgcgatgctaacgtcgtaattatgtttctattaaaattaaataatttcagaaatgtttaaatctttagaaattcatagagaataaaccgtagctcggatggaaaactgtata

SEQ ID NO: 75220 - DNA, 382 bp, Triticum aestivum
  Clone ID: PAT_TA_75220
ttattgactggatattgacatggctcccagatgacgaggaaatcaacgacgcagctacctccaaagctagtaagtcttcctaattcgaatttattcagtcgactggactgctcgtcagtcgtctctctgatttttcttgtttgctgcagctccacgagatgttgttgtggcttcccggacgataagaagatgaagtgcctctgagggaaaggaggaggagagaccacggactaagcaggaaagcgtctgaggttcaggttcctcagtcgacactgatgcctgggacggcggtcgagcgatccgtagacctggctcacaccaacgtccctttcgctttcccgctttcaactgactgtccatcaggatcaactactcagacccc

SEQ ID NO: 75221 - DNA, 353 bp, Triticum aestivum
  Clone ID: PAT_TA_75221
aggacccctcagcaccagcagagtagtagagcttctgagtactcgcagtcgtccggataatgcacgagtgtagtcgtacgagtcatgagatacgtttcatggtatgagattagttggacctgtcatgttatgtatatttcatgtatgagtctatgtataattatgttggaactctattttatttgccgtattttcttcatcatttcggtttttctcgggcttttgttgctggcttttccccaatttattctgaatgcttctcatctcggttgcattgtcttgggaaaaaccacaataggatgccgcacggaggcagcagtagcaacgttcgcgagggtactcttgtttgtcgt

SEQ ID NO: 75222 - DNA, 254 bp, Triticum aestivum
  Clone ID: PAT_TA_75222
caaccgatcgcggcaattaacagcggcggcaatgcccagcgagtcagctaccttatccaccatcgttgtgactccttgctcccaagtaaatccacgttggatgtgacaccgtgcagttccggcaatggaagcaaaacaatcaaggttgagaaaggtagccaatgcgagaggcaaagggagattggtaagaggaagaaaaaagagcggaggaggcagatgattattgattggggtattgtaaaagacacggacca

SEQ ID NO: 75223 - DNA, 359 bp, Triticum aestivum
  Clone ID: PAT_TA_75223
ggaagctcccgcggggaaccttggccacataccgcctcttcacaatcttcacaatgaatatcaccaaaccgtctacgaggccgaaacctccaagagtaataaactcacggactctcactcgaactaatcaatgtggggagctcaaaccaatgcgacaaatgcaatgcaatgccaagcaacaaatgctcaacacactctctcaatcctcacaagatgcacttttgaaagtgggaggttgaggagaggggatgcaatggatatgatcaacaaatggctcacaaatccatccacaaatcccccttcacatagagcggagaaaagggctttgggagaggtgtagagaggctcaaaatggtgtt

SEQ ID NO: 75224 - DNA, 300 bp, Triticum aestivum
  unsure (1)..(300): unsure at all n locations
  Clone ID: PAT_TA_75224
aggctcccgcatcccgagccaccacaccgagccacgcgttgttccgacctcgctcattcctgatgagaatcagcaggaggaatgacgagccgatcagttgcccagcagcgctgcgaggaacaatcgtagtgccacaaggagcacctccttgccgaaaggagctcggctcgatctcgccgaaaccgaagaggtagtagagcggaattgtgcttgtgcgttcaaggagagccnagctgccgtttttatagcccaaccccggtatacggttggcaaggtccaggagaaccgctcgtcgctcga

SEQ ID NO: 75225 - DNA, 336 bp, Triticum aestivum
  unsure (1)..(336): unsure at all n locations
  Clone ID: PAT_TA_75225
ctgcaggccggtacaacgcgaaggataacttgcttgtccgcactggcttacaaacgccgggccgatacatatgtctgcccccgtggccgacttgactatggttgatttcagcttcaacgcggtgaccatcaactccacggcggataatttccggcttaacatatctngtgatatcgtctctctaaatatattttatcagtacatatcattttttttcaaagaacaattactctggtctttgctattcttgggcaggatcattatttgttacaaaggtgtcgcanagggatgtgcgccaagattatcgcactagggctggtccgtgccatgctgctg

SEQ ID NO: 75226 - DNA, 244 bp, Triticum aestivum
  Clone ID: PAT_TA_75226
gattttatcttaacacttttctcgtagttgcggatgttggggaacgcggtaatttcaaaaaaaaatcctatgatcacgcaagatatatctcggtaatccatagcaacaagaggggagagtgtgtccacgtaccctcgtagaccgagagtggaagcgtttagttaatgcggttgatgtagtcgaacatcttcgcggtccaaccgatcaagtaccgagcgcacgacacctccgtgatctgcacacg

SEQ ID NO: 75227 - DNA, 404 bp, Triticum aestivum
  unsure (1)..(404): unsure at all n locations
  Clone ID: PAT_TA_75227
gggcgacgatctacatgccatcaggtacctcccacttaagctcaaaggataggctcggcattggctgaatagcctgccggcaaactccattggcagttgggagaacctggaggacgcattctttgacaacttccagggcacttacttgccgaccaccggacgctgataacttaagtcacataaccnaacagcccggagagtcagccaggaaatactggactcgtttcctaactaaaaagaaccaaatcatcgactgtccggatgctgatgccctagcggcctttaagcataacattcgcaatgagtggcacgcccgacacctcggccaagagaagccgaagtccatggcagccctcacaacactcatgacccgcttttgtgcgggcgaggagagctggctggct

SEQ ID NO: 75228 - DNA, 163 bp, Triticum aestivum
  Clone ID: PAT_TA_75228
aattatcttcttgcaccaaacaagagcatctaccgccttacgggtgcccacaagagaacaggccgcgcctagggggagggcgcgcccccctgtctcgtggccaccccggacaccgtctcacgttgattttacttccgaaaaatcacaaatattccaaaaaaaa

SEQ ID NO: 75229 - DNA, 450 bp, Triticum aestivum
  Clone ID: PAT_TA_75229
ggatcccccggctgcaggaaggttcaatgatctctgaatcaaaagtaattctttataccagtctaaggcaaatcacaacaatcgcttagaggagtatgaagggatggcatacccggactaaatggatgatgtgaactaccttgttgaaggcaacgcaatggatgatttttgcttatcatcggaaatggatagaacccatggtagtaccactgttgaagatgatcctgaccaggaattaccgggaaggtagtccaagatagaatggcacaatggcggtgcaagctgggaacaaaatgcaaatgtgggaatgattctagtaactggggataaactcaacagtagagagtgattccactgtttgaatggttctagcataatcgagggaaccgagagcacaacgacccctgaggaacaacttctagaataagttgcattaaatcctcatggaga

SEQ ID NO: 75230 - DNA, 223 bp, Triticum aestivum
  Clone ID: PAT_TA_75230
atcgcacgaggcgtgtgtgtcttatgcaaacatatcacacatgcatcttcgactacggaagcaaggtgaggagatagtgtgtggttgtttgcaccgagaagagacccttttctctacttttatcgtgtgttgtccatgtctctttcacacacgcacacacactcttttcactcactctttctatttcgcacacacacacacacactctctcgctctctctctc

SEQ ID NO: 75231 - DNA, 364 bp, Triticum aestivum
  Clone ID: PAT_TA_75231
cacgaggccgaacactccggtacgtaaacgccgccaagaggtctcttgtacttctgatacaccttgtctcaaggtgggttatttccgatatcctcttaatccgtctgactcaaattaccagggaacctcccattcatcttctagtgaatcaacagggacgaagcttccaaccgtaaaaacggttcctgggtgagctgattttactaacccgtcatacctttatatttttaatcctcgcattgttctgatgcatacttattattttccagggccaaagccagagccagaaagaatgccaaagtgaacaaaccagctaaagaccccattcaggatgaaacggaaaagactcctgaaccatcacacc

SEQ ID NO: 75232 - DNA, 474 bp, Triticum aestivum
  Clone ID: PAT_TA_75232
tgcaggcacttacaaggatgttgcttcttccgcgtgggattggcaattactgagttagtgcccttatcagggcctacaatgccaagctcattaatgactattgccttgatagaacgatgtgtatcatccaacaacggctggtcagaaacagttgtaccagtggccatgggcgaagaaggtaggcgtaatttcttgcgacacctggaatattgcttttccaagttacggacaagagaagaaccgcacctcctcatagaagcatcaatagcagcctcgttttgagtatccgtcatatctggctggttatgcaatcaatcactagatacattcccagaacgtgcagtaagcataatctgagactcgagaggctgatcggttcctgcagtagcagttccatcaattccggctgaccttaccgacgcattggcagttgcaaacatggttgcacccacatctgcattcgctgcgccacta

SEQ ID NO: 75233 - DNA, 219 bp, Triticum aestivum
  Clone ID: PAT_TA_75233
gcaggatttctttaatgtttccaccaaaattaggggatgttagtaggagtatataattcaactttatgcaaaaacccactggctgttctttggaaaatttgagaaaatcatcctcttttgttctctggtccagttgggtgttttctactgcaaccacattttatcttgccctattgcccttgatctttctcctgcttttaaaccaccctaccaaaccct

SEQ ID NO: 75234 - DNA, 491 bp, Triticum aestivum
  unsure (1)..(491): unsure at all n locations
  Clone ID: PAT_TA_75234
gaatacctcgtcattggtaccatcaatgctaaaatggtcatgatttttgtcatgtcctgccagtaaggtaaggtagaataccatatagtttaaaattttaaaattggacatttgtttttcttaaaacaaaaatttaaagttttgacatgtgtaaattatttttgcaggtacatgcatttattgggtccaataatcaccctggttatcgataaacgattagaaacattggatttgggatgtttgaagtttgctctctgcttgtccgtctgttcttctgtacttcctcaattggtttcatcatggttatacatgctggagataatttgatgcacatattacttactggaggtggtgtgattgcttgacggagccnataacagtcgaggagagtcaacagaggaaactggggcacttgcaactattggaggaaggtgatgtccaagtgccgatcgctggaggaagacgatgacgaaggtgggctctgaaggtgg

SEQ ID NO: 75235 - DNA, 381 bp, Triticum aestivum
  Clone ID: PAT_TA_75235
ctgctctactggatcgcccagctcctgggctccaccgctcgcctgcttcctcctccgcttctccaccggcgggctccccaccggcaccttcgggctgaccgggattcggcgcgtgggaggcggtggtgctggagatcgtcatgaccttcgggctggtgtacactgtgtacgcctaccgccgtgtgaccccaagaagggcagcctgggcaccatcgcgcccatcgccatcggcttcatcgtgggcgccaacatcctggtcggcggcgccttctccggcgcgtccatgaaccccgccgtctccttcggccccgccctcgtcagctgggacctgggggtaccagtgggtgtactgggtcggccccctcatcggcggcagcctct

SEQ ID NO: 75236 - DNA, 321 bp, Triticum aestivum
  Clone ID: PAT_TA_75236
tagactccattcccatcacacacacggacacacctgcaagagcgagagcgtgaaccatggcgggcatgatgaagaagcaggtcgtgacggcgctgatgttggcgctggtgtgtgctggcggcgtgcccggcgtcgcagctcgcggtgtgcgcgtcggcgatcctctccggggccaagccgagcggcgagtgctgcggcaacctgcgggcgcagcaggggtgcttctgccagtacgccaaggaccccacctacgggcagtacatccgcagcccccacgcgcgcgacaccctcacctcctgcggcctcgccggcccgcactgc

SEQ ID NO: 75237 - DNA, 298 bp, Triticum aestivum
  Clone ID: PAT_TA_75237
gcggcccagccccggacgccgccaccgcgccgcgcagccgccggactcgggcaccttctcctccgagctgcggccgtcgccgctccacagcgccgcctccgtcggacggctgccgctcacggaagctcgccgacggcgctcgcttccggtgatcccttccttttccttcttctccttgattcttctctagttttccttcatcaccaaaccccaatcaccactcttactagtagctttctgtggatttttacatcatgtccatttgtgaagaagagtccgcgagatttcatactcggag

SEQ ID NO: 75238 - DNA, 108 bp, Triticum aestivum
  Clone ID: PAT_TA_75238
cacgaggcacgaaccccgtggacgaagcagatcggcggcgcgtacactccaatacaccggttagtgataaatggcgactgtttcggattctctggtctgggagcttgt

SEQ ID NO: 75239 - DNA, 222 bp, Triticum aestivum
  Clone ID: PAT_TA_75239
tgcagtgtggacgtgactgaatagcgtacgggaagttggtactgaggaggcgaccatctctaccaaaatagcacaaccgagtcctggagcggcggctgtgcaatgttccgccgacattttcttcctcacggctgctgggaacggtgacctgaccatcgaggagggctgccgtggctcttacgattggcggccgccaagagggcgatcggttcttacaccagc

SEQ ID NO: 75240 - DNA, 420 bp, Triticum aestivum
  Clone ID: PAT_TA_75240
gcagtgaatcggcacgaggaaaacctttctccttctgtcccgcaaacccccgagagatcacagcatgttcggcttcggtcaccacgtgccaccatggccagtaaccccccggcccacgctccggccggcgcctggaggcaaccagcccaccttcaagatcttctgcaaggccgacgagggctactgcctcttccgtccgtgacggcgacgtcgtcctcgccccgttcaacccccgtgacgagcaccagcactggttcaaggacatgcgcttcagcgcccagatcaaggacgaggagggtaacccctgccttcgccatcgtcgacaaggccactcgcctcgccgtctaagcactcgctcggccagtcccacccggtgaagctcgtgccattcaacccggagtacctcgacgagtccgtgat

SEQ ID NO: 75241 - DNA, 546 bp, Triticum aestivum
  Clone ID: PAT_TA_75241
gcaggctcttcgtctccggtaggccaggtagttaacagctccagcagccatgggaaaggagaagatccacatcagcgttgtggtcattggccatgtcgactctggcaagtcaaccacgactgggccacctcatctacaagcttggaggcattgacaagcgtgtgattgagaggtttgagaaggaagcccgctgagatgaacaagaggtctttcaaggtatgccttgggtgcttgacaagctcaaggcctgagcgctgagaggggtatcaccacttcatcttgctctgctggaaattcgagcaccaccaagtactcctgcactgtcattgatgctcctggtcaccgtgatttcatcaagaacatgatcaccgggacctcccaggctgattgtgctgtgcttatcattgactccaccactggtggttttgaggctggtatctcccaggatggccagagccgtgagcacgctctccttgctttcactcttggtgtgaagcagatgatctgctgctgcaacaggatggatgccaccactcccaagtactc

SEQ ID NO: 75242 - DNA, 445 bp, Triticum aestivum
  Clone ID: PAT_TA_75242
ctcgcactgatgcgcagtcggagggacgactggaggagagtaggaggtaggtacgctgtttacagggtgatgtcgccggcgacggcagggccagtcggccggagctggattgatccggaggtgcttagcaagagaggcggacagcggaccgatggagaagggatcggcatcgggcagttcgaagacccgaaacgggtgcctcatcatctacctcaccgtctctcctccagtacgcggatgctctgctcgacctcttcctcgtcgtggctgctcaacaaaataagcaggagcagccggtgcagccgagcgtccgccttaggcttcaggacatggcgttcaacggttgatgcaggcggcctatgccaagctggtgcgggcgggctgctgtcgttcgtctaccccacgctgcagctgctgcggcacggcgtccggctattcggcgacc

SEQ ID NO: 75243 - DNA, 610 bp, Triticum aestivum
  unsure (1)..(610): unsure at all n locations
  Clone ID: PAT_TA_75243
cacacgtcagccattatgggtgatagaggagttagtaaatccattatctgctgctgcacaacaccatttctccaaatgggttgagaatcctgaatttgtctttgctcttgcttattagattaccagaaaatttggtggattccatggatgagatactgcagccccttgtagatnaggccaatcttgtagggtatagctgcagagaggagtggatttcaggtatagttattgcactgtctacatacttggcgaaagagatatttcctaagcagattgaacttcttcaagaaagtagctcaagtgatgctagcagcacggcggttcaggcaagagtctcgtggcttaaccttgttgatctgatgatatcttttgacaagcgaactcaagatttgatctccggtacaggactgctactttcagtaaaggatgatgagaattggcagaggatctcagtgctctctgtcttctgtgatcgtccagactggcttgaaatatgggcagagattgagagacgggaggtttttgctagcctgaaatcagcaatggagaatgaaaatcattggagtacgaggattgaaggagccatgctcgagtatggatcagatgactg

SEQ ID NO: 75244 - DNA, 430 bp, Triticum aestivum
  Clone ID: PAT_TA_75244
agattggaggaaggttgtaccttaaacagccaggcacaatacgtcacctctctgtaagcaataactgggacggagatgagagtgaatttgagagtacagttgacttgtctcgagtcagatccataacaatttttgggaagtggaggccattcttcatttctgacaagatgaggttgcttcgggtgctggacttggaaagcacttcaggtctggttgatcatcatcttgagcacattgggaagcttttccacctgagatacctttccctgagaggatgtcatggaatttatcacctgccaggttctttgggtaacctgaggcagctccaaacactagatgtcacaggcacaaacataatcgagctgccaaagaacatcatcaagctcaggaagctacagcacgttcatgccaggggcgtcgggaacaacga

SEQ ID NO: 75245 - DNA, 395 bp, Triticum aestivum
  Clone ID: PAT_TA_75245
tgcagggcggagaggataactatgagagagatcatcaatacggacgctacagctgtgattcggactatgagaggagcaggagagatagtagtcggagaagaattgactcgtttgagcatgaacgtgaaagaaaagggttaagttcttgaaagagatgaaagcccatatgtccgccatagccgttctcggtcacgtgggcgtgataaccgatcaagatctcggtcaaggtcatggtctccacgtggcaaaagtcgtaattggggtcaaagggatggcttctatgatgatactcgctttgagagaagaggagaacaggactgggatgaaagaaggcatgatgatttggtggcgccatctgcgactgttgttctcaagggtctgtcccagaagaccaa

SEQ ID NO: 75246 - DNA, 107 bp, Triticum aestivum
  Clone ID: PAT_TA_75246
ttgcgcaactgctacgccgacgagcactacctatccgacatatcctccacatcctgccaccctaagtgtggccgccggacgaactgtgacgtgtgttgactggtccc

SEQ ID NO: 75247 - DNA, 121 bp, Triticum aestivum
  Clone ID: PAT_TA_75247
gagaagaacccgaatggagaacttggtatgccgagtaatgtgcaggttgcttttgtcctctcacctgctctttggtcttcgtctattgctctgctggctcgtcatctccttggttggagat

SEQ ID NO: 75248 - DNA, 462 bp, Triticum aestivum
  Clone ID: PAT_TA_75248
taagccctatccctaaccctgctctcgtctccctccctaggacgcagtcgccctggccatgccgccgccgccgcccacccgtacgtcgccagcaacgggctcgccatcatcctcatgtgcgcccgacgtttccgtctcctcgctggccctaggctcatcgagcttcctctccatgcgttgctgcctcctctggcgccgccaccccatggtctccaccagcgtccctgcggagtacatgggagccgccgctgccgccggggacaaggatacacatggaaaccgccacagccttagcctgataacctcatgatcggatggtgcaggcacgcctgcgggctagcctatgcctactatatccggtgttctggtgcatccggtgcgacctcaaagaatacattcttctagctgagctttgagctcctcagggacgatgcctggggtggaagcagttcaactgcacga

SEQ ID NO: 75249 - DNA, 287 bp, Triticum aestivum
  Clone ID: PAT_TA_75249
tgcccttatgccgatttaacgcgggatcacctctgtttctactctcttctggaagaatcagtggtgcgggcagatactctcggatgcctacccgagagctttctcttatgctgtttatgaagatgccactgtcgagcaatttctcacgatgcacttgcttggtgaaggcttacatctaccagtgtcagttcaggtgcgccaggaggtggcccaactacgctttgagactgccaaaactagcatcaatactatggctactgatgactgggggcctaggtacacgtctg

SEQ ID NO: 75250 - DNA, 401 bp, Triticum aestivum
  Clone ID: PAT_TA_75250
cggctgccggctatcccgcggctccccctgttggttaagggcgccaccagcagcctccggcccctctggaaccctagcccccaaatcccccatctccctctccctcgcccgctctcttcgccccgcgcgagatcgccgcgtcaccaccgctgcgtcgtcgtcaccacgaccaacgatgctctccgccgcgggagaacctaccaggagccccgcgtcgctcgtccacaccgtcctcgcccgcaagctcgagccgcggaggtcgtcatcgccggatcgggcattcttcccctgttttggtcgccgccatcccgccgcgtcgttcagctcctccggtcctcccccgaggctctacgggctggtcccggcctccccgagaataccatccggcccctgccttgacg

SEQ ID NO: 75251 - DNA, 310 bp, Triticum aestivum
  Clone ID: PAT_TA_75251
caagacttctgctgatggccatgtctcctgtgctaaggagatgaccaagctctctggtatctctgacatcatccctgagatggaggtctgtgacttcgacttcgagccctgcggctactccatgaacgccatcaacggatctgccttctccaccatccatgttacccccgaggacggcttcagttacgcgagctacgaggtcatgggcatggacgcttcggcccttgcctatggcgacatcgtcaagagggtcctccggtgcctttggcccttcagagttctcagtggcggtcaccatcttcggtggccg

SEQ ID NO: 75252 - DNA, 480 bp, Triticum aestivum
  unsure (1)..(480): unsure at all n locations
  Clone ID: PAT_TA_75252
gcggagaaggccgagaagacgacggcggcgaagaagaccaaggccgagaagcggccgccggcgtccaaggagggcggcgagaagaagggcaagaagaagtcgaagaagagcgtggagacgtacaagatctacatcttcaaggtgctgaagcaggtgcaccccgacatcggcatctcctccaaggccatgtccatcatgaactccttcatcaacgacatctttgagaagctcgccggcgagtccgccaagctcgcccgctacaacaagaagcccaccatcacgtccagggagatccagacctccgtccgcctcgtcctccccggcgagctcgccnagcacgccgtctctgagggcaccaaggctgtcaccaagttcacctccgcttagatcgtatgttccctgttgtccaggtngatcgatgtttgctctgtaggtagctgttcgtaccatgtcatcttataagttgtgtgggaacacaca

SEQ ID NO: 75253 - DNA, 424 bp, Triticum aestivum
  Clone ID: PAT_TA_75253
ggaattcggcacgaggtatgcaacggcgagacatgctctagaggtgtcaaggaactgcgtgaggccctacagcacgatgtggcagctcattcaggtggcgcccatggcaaagggtctggccatggcaagggccgtggcaagaaacaggtcaaacaacccaagaaggaggtggttgacttggagactctcctcatccattgtgcgcagtcggtttccattgatgaccggcggagtgcaacccgatctcctgaagcaaatcaggcagcatgcatctgctactggcgaatggtgaccagcgtttggcacactgctttgccaatggcctttaggcgaggcttgctggtaatggaagtcagatatacaagttacataccatatcacggtttgcatgcactgatgtgctgaaagcctaccaactgtactt

SEQ ID NO: 75254 - DNA, 147 bp, Triticum aestivum
  Clone ID: PAT_TA_75254
ttccccgtcgatcggccagctccgacatggggcttagcttcgggattgcaacaagatcgtgcggattatgaacggcggcatgcgatcgtcgggatcggacggaggaagcatcatcaccgtcgtcctgcagttccagctgcagcagtc

SEQ ID NO: 75255 - DNA, 251 bp, Triticum aestivum
  Clone ID: PAT_TA_75255
gtaacactccacaaattgaaattgaagctgctgatggtgatcctactagcagatgaacaagagctgccggcttggtatccagatttttgacctcaatgtcgacggaactcgtgagagctgtgaagtgactgagattcccggtgatcctcctgaagaacatgcttctgattctctgcctcatttagttggtcagcatgagatcagcaagcatactctgatcctccagatactcaagtccaagataaacgtgc

SEQ ID NO: 75256 - DNA, 293 bp, Triticum aestivum
  Clone ID: PAT_TA_75256
gcgggcctgcagttccccgtgggccgcgtagcccggcacctcaaggtcggccggtacgcgaagcgcgtgggcgccgggcgcgcccgtctacctactgcgccgtgctcgagtacctcgccgccgaggccctggaaagctggccggcaacgcggcgcgcgacaacaagaagacccggatctcgccgcgccacatccagctcgccgtccgcaacgacgaggagctcagccggctgctcggcggcgtacaccatcgccgccggcggggtgctgcccaacatccactccgtgctcctc

SEQ ID NO: 75257 - DNA, 402 bp, Triticum aestivum
  Clone ID: PAT_TA_75257
gtccggtggggccatctcgcgccaggctcgctctgcagcctcacgctgagcgacgtcgagcgccagctgcacggcgttcacctcgacgacctcctccgcacggccggctcggccaggaggacggctgacgaggtgtggcgggacatccacggcgccaacagcggcaccgccgcccgcgggcccagatgacgctcgaggacttcctgtccaggcccggtagcgacgcggggggcgcccactgggccgagcagtacaatcccccggcccctgtgccgaggcagcagcgccacaacaacgtccggcgtcccctgcagcggccgcttggggtgggcgccgggccggttcttgacgcgctttaccacgaccactacggggccgccatgtccgggcgaacgcgtgccg

SEQ ID NO: 75258 - DNA, 171 bp, Triticum aestivum
  Clone ID: PAT_TA_75258
tcgagaaccgttgctaaccgactcctctctttcttcgcaatggacagacctcctcaagttttggaccattacatcggtgtcgatgtcggtacaggctctgctcgtgcctgtattattgacgacactggcgacatcgaggctttagcctccgagaacatcaagttgtggcag

SEQ ID NO: 75259 - DNA, 500 bp, Triticum aestivum
  Clone ID: PAT_TA_75259
tctcaaccctagctgccaccacccaccctctactgctccaccacgcaccctcctcccctctggatcaggtgcaggcaagccggttgcgcatgcggcggcgctccactcgagggcaaagggaggcaacggcggctgtggccgccgtggacacctgcggctataacgaaccccgccgccaggaggccgccatggaggcccgtcccgagctcgccgcgccgctcctccggtgaccctcgttgcgcctggatccgggcggatccgacgattccccgatgtgcaggcgggccagcacgcggcgctaggcggaggagccctcccatggcggtgtcaatggtggtgggtttgccataggatatgcactggccagtgtgcgcatgccggtttacgcgcacattatgtacctcaagatctcagttctcactataaccacagtgaataggcagagcaacagcaaaggcctgctggtgtgaatttctcagaatgggaattgctacagtggc

SEQ ID NO: 75260 - DNA, 277 bp, Triticum aestivum
  Clone ID: PAT_TA_75260
accgaatctgatcgccagtctgcggaatctgacgacacgcacacccagacgagcaactgcagcagcaccagcgccgaccacggcgtgtcggcgacgtggatcaccacggtgccggagcgccgatcgtgatgcagagcgcgagcctgacgtgccccggcgcctcctcgcgcgactcctcatagacgaccacgacaaccgcacggccgttacttcgggtgccacggaacggctgctcctggacttcttcgcggaggggctcgaccggcgccctgcgtcg

SEQ ID NO: 75261 - DNA, 541 bp, Triticum aestivum
  Clone ID: PAT_TA_75261
cccgggctgcaggagaccctgttattgtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaaga

SEQ ID NO: 75262 - DNA, 175 bp, Triticum aestivum
  Clone ID: PAT_TA_75262
cacagacacatcgatcctacaactcacagagagacctggcaagctagctagatcacgatggcttcctctccctcggctgctcgtctcctgctcctcgtcgcagcagctcttgtgttgagctccgtgtccgccgcctctggtgcttgttgctcgccgccgcttgccgagggcctgt

SEQ ID NO: 75263 - DNA, 191 bp, Triticum aestivum
  Clone ID: PAT_TA_75263
cagccaccatgtccctttcctcatcgaccttcgccggcaggcgctaagaatgtaccatctttggctgtctttggtgaagcgaaagttcacatgcgcaaggaccgtagcaaaggcgaagcaggtttcttccggcagcccatggtacggtgctgaccgtgtgctttacctcggcccactctccggtgagcccc

SEQ ID NO: 75264 - DNA, 250 bp, Triticum aestivum
  Clone ID: PAT_TA_75264
atgcaatggaagaaaggttctacctacagtgcctgccagtgatagagctcctcctcctcctaccaagctcttccactccgcctgcaaggccgccaggtccttcctcgcctcctcccccgcctccgcctccgccccgcgcgccgcctcctccgtcctacgcagacgggaggaacgccgtgctcgccaccctcgccaacctacggccggaactaccaccctccccgacgcatacgaccaccacaccaacgcc

SEQ ID NO: 75265 - DNA, 383 bp, Triticum aestivum
  Clone ID: PAT_TA_75265
cagccgtggcgcttcctgctactcctactggaacagcagccagagctacgtcatgaccaatggctggagccgcttcgtcaaggagaagcgcctcgacgccggggacaccgtctccttcggccgcggcgtcggggaggccgccaggggcaggctcttcatcgactggcgccgcgcgccccgacgtcgtcctcccgaccgggcaccaccgaggctttgctctcccctctgtgcccttctcgccgtggatggcgcatccggccggacccggcggcgctggcggcaggatgttcctccaggcgactacgccggcgaccgtctacgactacgacgcctaccagcaccaccaccagcggcgacacatcgggtacgacggctacggggcg

SEQ ID NO: 75266 - DNA, 206 bp, Triticum aestivum
  Clone ID: PAT_TA_75266
tctccccgatctctataaaacaccgctggatttctgaattctgtcttccccgacgggcaatcacacctggcgcctcctccctcgagtgcgcccggaccgggctcctcccgcggggccggggctggtaccaggggcggcggcggggggcggtggataggcggaggcggctctggaggggagcgagccggtggatctgaccaagcacc

SEQ ID NO: 75267 - DNA, 492 bp, Triticum aestivum
  unsure (1)..(492): unsure at all n locations
  Clone ID: PAT_TA_75267
tggaaatggcgggactcctcatgacatcggggcagcatcttcctatcgtcttaaaagtgtgacaattcgttatggtgatatcattgattcacttacgttttcatatagcgatcacagtgagcacgtacacagtgttggtccatggggtggtactggtggtgccaagnaaaatatacatcaaatttgaaccgtcagagtttctgacagaaatttctggaaaatttggtccatatgcgttatcaacttccaatgtcataacatcgctcatgctggtaaccaatgaggatagatatggaccttttggatttgtacaaggaactcctttctgcaccaacttggaaaacgattgggctatagttggcttttttgcacgtgcggagagatatgttcataaaattggtgtgtatgccagacccaattcgctcgacggaggaactgctgtgcagtccgagctggaaggaggacaagagtagtggtactagtacggtatgt

SEQ ID NO: 75268 - DNA, 557 bp, Triticum aestivum
  unsure (1)..(557): unsure at all n locations
  Clone ID: PAT_TA_75268
tagcaattcacgtgccatggccccagccgtgatggcatcgtccgccaccaccgtcgcgcccttccaggggctcaagtcgaccgccggcctccccgtcagccgccgctccggcagcgccggtctcagcagcgtcagcaatggcggaaggatcagatgcatgcaggtgtggccgattgagggcatcaagaagttcgagaccctgtcttactgccacccctctccacggaggccctcctaaagcaggtcgactacctgatccgctccaagtgggtgccctgcctcgagttcagcaaggttggcttcgtcttccgtgagcacaacagctcccccggctactacgacggtcgatactggacaatgtgaaagctgcctattttcgggtgcaccgacgcaacgcaggtactcagcgaggtggaggaggtcaagaaggagtaccctgatgcctatntccgcgtcatcggcttcgacnacatgcgccaggtgcagtgcgtcagcttcattgccttcaggccaccaggctgcgaggaatctggcaaggcctaaagtgcaagttgaag

SEQ ID NO: 75269 - DNA, 614 bp, Triticum aestivum
  Clone ID: PAT_TA_75269
tccactgggcgcgcatcgagggggcccaccacaccggcgcgctgctcggggtcggggaggaccacccccagggctgggagaagcgctgcgcggcggcccccaagggtggtgatgcacgccgactgggacctcctggatgtactaccactcgttcgacgaattgtcccagaggcacgcggtcggggtggccaggtccagggacggcatccggtgggagagggtggggaaggtgctcgagggaggcgggcctggatcgttcgatgaaggcggtgtgcggcaggggcatgtcgtccgtgaccgcgccgccggtcggtacatgatggcgtacgagggtttggacggcaatggcggggtgagcattgggttggccgtgtcggaggacgggctgcgaggctggaggcggtgcagtgaatcaccagcgctgcgcccgtcggaggatgatgatcagtgggacgtctctcgggtcggcgccccgtgccttgtgcacatggatcggccgtatgattggagactctattacatgggcgtagggaaggatggtgaggctgctatcgggatggcatattcagagggtcagggtcttccgaggttcaacaagtgtgatgctcttctca

SEQ ID NO: 75270 - DNA, 282 bp, Triticum aestivum
  Clone ID: PAT_TA_75270
tagacgggctctgcgagatcgtcgcccgcggcatggcgcgcggcgtgagtgggccgcgcaggtaccacatcaacctgtcggtgttcacctcgctgccggacatgtgggccatcgagcagctcttccccatcatccccatgcagcgcctccaggagcggcccgccgtgtacggcgtgctctcggacctaacctgcgacagcgacggcgaggtggaccagttcatcggcggcaggagcagcctccccctgcacgagctcccgacccacggcacccgcggctact

SEQ ID NO: 75271 - DNA, 596 bp, Triticum aestivum
  Clone ID: PAT_TA_75271
tagggtgctgtgtgactggcgttgaagaagcgcagctgccgacccctgccaatgccgataagctcaatggattccacacggccaatgtggcccatactgacagtgctcagtgtgcctcgacaaagctgcagtgatggatcaagtcgacctggccgcaactccgaaaaagcaggagcaggcatcaacctcaacaatgacggaagtggaggaggtgaagattgtggtgaagttgatgcctatctggtccacctgcatcctcttctggacaatatactcccagatgaccacattctccgtggagcaagccacccacatggaccgtcgcctcaatgccggcttcgaaatccccgccggttccctctccgtcttcctcttcctctccatcctcctcttcacctccctcaacgagcgcttcctcgtgccgctcgccgcccgcctcaccggccgcgcgcaggggctcacctcgctccagcgcgtatgaacgggccttgtcttcgcaaccgtggccattgtcgtggccgcgctagtccagaagattcgccgcgacgcggcgaacggggagtcgcaagttgccatcagcgcgttctggcttgtgc

SEQ ID NO: 75272 - DNA, 455 bp, Triticum aestivum
  Clone ID: PAT_TA_75272
cccctcgtccttcgccgggaaggcggtcacggacctgccgtcgtctgcgctcttcggggaggcgcgcgtcaccatgcgcaagaccgcggccaaggccaagccggtgtcgtccggcagcccgtggtacgggtccgaccgcgtgctctacctcggcccgctctccggcgaccccccgagctacctcaccggcgagttccccggtccactaccggtgggacaccgcgtggctgtcggccgaccccgagaccttcgcccagaaccgggagctggaggtgatccactgccggtcggccatgctaggcgcgctcggctgcgtcttccccgagctgctcgcccgcaacggcgtccagttcggcgaggccgtgtggttcaaggcccggctcccagatcttcagcgagggcggcctcgactacctcggccaccccggcctggtccacgcgcagagcatcctcgc

SEQ ID NO: 75273 - DNA, 614 bp, Triticum aestivum
  unsure (1)..(614): unsure at all n locations
  Clone ID: PAT_TA_75273
tcggcactcatgcaacaaaaggagctcgccatgagcaccgatgagttgctccaagctcaggtggagctctaccaccactctttcgccttcgtcaaatcactggcgctcaaggccgccacagacctatgcatcccggatgccatccagcacctcggaggcgccgccaccttgtcagacctcgccgccgaaaccgggatccaccccacgaagctctccaacctccgacgcctcatgcgcgtgctcaccacctccggagtcttctccgtcaccggtgatcatgccggcgctgtgtacaagctcacccgtgtctcccgcctcctcgtcgtcgacagagcttgcgggcgcacccacctttcccccgtggtgtccgcgtttgtgagcccgtaccccgtgaccacgctcttcagcatgcgcgagtggttcaccgacgagcgggcggcggccatgtcgctnttcgaggtggcgcacggctgcacactgtgggaggctgcggcaatggacggcaccgcgttcaacgctnccatggccgccgacagccgcttcactatngagaacctcctccgggagtgcggcagtgtgttcgaaaccgtgaggggctcactggttgacgtcgg

SEQ ID NO: 75274 - DNA, 542 bp, Triticum aestivum
  Clone ID: PAT_TA_75274
caatctccaagcgcgagcgacagccagctccgcctcaacctcccggcgcatctccgacatggcccgcaccaagcagacggcgaggaagtccaccggcggcaaggcgccgcggaagcagctggcgaccaaggccgcccgcaagtccgccccggccaccggcggcgtcaagaaagccccaccgcttccgccccggcaccgtcgcgctccgtgagatccgcaagtaccagaagagcacggagctgctcatccgcaagctccccttccagcgcctcgtccgcgagatcgcccaggacttcaagaccgacctccgcttccagtcctccgccgtctccgccctgcaggaggccgccgaggcctacctcgtcggcctcttcgaggacaccaacctctgcgccatccacgccaagcgcgtcaccatcatgcccaaggacatccagctcgcccgccggatccgtggcgagagggcctaggctgcaacccatgcgtcgtctgttagatccctgttaggctgagttcgtcggcggaaatgtgtgtgctactgt

SEQ ID NO: 75275 - DNA, 251 bp, Triticum aestivum
  Clone ID: PAT_TA_75275
tgcccatagcccgtctcgctctccgcaaagtttataatcccggcgccggatcgagagagagatagagagagggtgcaccgtgcatggtttaatctgtggcgcgactgcgggagcgcgggcgcgcgcgttaaatatgggcatcctggatcactcggaggacgaggaggaggaggggagccactacggcggcagcggcggaggcgcaaggttcggcgcgcggcggcagaagccgaggtccaagagccaccacc

SEQ ID NO: 75276 - DNA, 333 bp, Triticum aestivum
  Clone ID: PAT_TA_75276
tgtgaaaggcgtcttcgtactcgcctctctccgcgcaaccgagccttcgccctcctccttccccatttcgccagcggcgcagcccaccaaccacccccacccgccgccatgagggagtgcatctcgatccacatcggccaggccggcatccatgtcgggaacgcgtgctgtgagctctattgcctcgaagcatggcattcagccagattgccagatccccggtgacaagaccgttgggggagtgtgatgatgctttcaacgccttcttcagggagactggtgctgggaagcacgtcccccgtgctgtcttcgtagatctcgagcccactgtga

SEQ ID NO: 75277 - DNA, 529 bp, Triticum aestivum
  Clone ID: PAT_TA_75277
gagagttcatggccgccaccgccgcatgccggagcatggagaggagatggagtcttgccggatccacggcgctcgttaccggccggccgccaaagggatcgggcatgcgatcgtggaggagctagcggggctcggggctcgggtgcacacgtgctcccggaaacgcggcggagcttgacgagtgccggcggcagtgggaggacaagaacctccgcgtcaccgtctccgtctgcgacgtgtccgtgcgtgccgagagggagaagctcatgaacacggtgaggcaaaccctgggcggtaagctggacatcctggtgaacaacgcggggcaatccatggtgaaggcggcgacagagtgcaccggcgaggactacgcgctggtgatggccaccaacatcgagtcgtgcttccacctcgcgcagctcgcgcacccgctcctcctccgctcgggtggaggggcgagcagcatcgtccacgtctcctccatcgccggcttcgtcggcttcccgggcctcgccgtctactcgatgac

SEQ ID NO: 75278 - DNA, 495 bp, Triticum aestivum
  Clone ID: PAT_TA_75278
ccgcgtgaggcggtcgcgtggcagcagagcggcatggtggagctgcaggaggagctcgaggcggagcgccgcgccgctgccgaggccgccagcgaggccatgtccatgatcctgcgcctgcagcgggacaagtcagaggccatgatggaggcgcgccagttccggcggttcgccgaggagcggttcgcgcacgacgcctccgaggtcgccgccctccacgacgccatcgcgcggcgtgatgcctccatccagtcgctctcggagcagctccgggtgtgccgctcccgcctcatccagctcgggttcctctccccgtcgttcctcccctcatctcccacagccgccgcgggggacaacctcttcgctgacgactacccttccatccaatgcctcgattatcctgcgccctccgacgtcggtactccacgcacccaccacatgctctatacgatgcccggccgagatgcccataagggggtcatctgctcttcacca

SEQ ID NO: 75279 - DNA, 462 bp, Triticum aestivum
  unsure (1)..(462): unsure at all n locations
  Clone ID: PAT_TA_75279
tcctcagccgcctcttcgccggccggccatggcaaatgcctccctccagtccttcctcccccagcaccaccattctttccccatgcagcacgacccacgacgagctcccctcccgcgctcctcaagctcaccgccaacaccaccaccaacgcccgcaacagcatttcattcaagctcttcgcctgcagctcctcctcagtgaccacaaccgccaactcgcctgctccaactccggtcgccgccgccgcggcgactacctcgcctcccaccccctccctagagctcctgggccagcagctggcgaagggggactactggcaggctgacgagaccacccgggccctcctcatcgtcctcgcgggcgaggccgcgcgccgccnagggtacgtcttcttctcggaggtccagttcatctccctcgaggacctccgcgccgtggacgcgctctggctggagcacagc

SEQ ID NO: 75280 - DNA, 468 bp, Triticum aestivum
  unsure (1)..(468): unsure at all n locations
  Clone ID: PAT_TA_75280
caggacgcccgcgggcgggccgcgcgcaagtcaaggcacttcaagctggctgcgtggagcgtcgtggcgatcgcccttatcgccgcgatggtgccgttcggccgccgttgctcatcttcctgcatcagaccaagaagtcccgggaggttcgtctcggtggccgtgccacgccgacaggagcgccggacatcaaggataaagccgagcaaggcaagttgagtggcagcggcagcggcagcagcagcgggagccggaacgcgcaggcgcagctgcagttcttccgcgcggacaaggcggccggcttcgacctcgacgacctgttccgttcgacggcngagatgctcggcaagggacggctggggatcacctaccgcgtgacgctcgagggcggcgcggccgtcgtcgtcgtgaagcggctgcgcaacatggggcacgtgccgcgcaaggacttcgcgcacaccatgcagc

SEQ ID NO: 75281 - DNA, 157 bp, Triticum aestivum
  Clone ID: PAT_TA_75281
gcacgaggtcttcttcttcctcctccgccattaattgatcaagaaaagcttcagctatcagcaatggagcccatccctctcctcacgcccgtacaagatgggccagttcgacctcgctcacagggtggtgctagcgccgctgacaaggcagcgctcc

SEQ ID NO: 75282 - DNA, 502 bp, Triticum aestivum
  unsure (1)..(502): unsure at all n locations
  Clone ID: PAT_TA_75282
tcttgttgaacttgctttctcttccattctactcactgacattctacttcgaaactccatcgatctttaccagacaccagtgcttcaaactacccctcattctcagacacaatggtcaaagcagttgtcctaggcgccgccggtggcattggccagcnncattgtcgttgctcttgaagatctctcccctcgttgacgagctctctctctttgatgtggtcaacactcctggtgtcgccgccgatctgtcacacatttcctcgcccgcagccgttgatggcaccgtcgccgccnagggagacttcaaaggcgaacaaccagagacggaagaggccaagaagcaagcattgaccggtgcagacattgtcattattccagctggtgttcctcgcaagcctggtatgacccgtgatgaccttttcaagatcaacgcaggcattgtccaggatctcgtggttgctattgcaaagtatgctccaaaggccagcattgctatcatctc

SEQ ID NO: 75283 - DNA, 99 bp, Triticum aestivum
  Clone ID: PAT_TA_75283
ctcttgttgaactatgctttctcttccattctactcactgacattctacttcgaaactccatcgatcttctaccagacaccagtgcttcaaactacccc

SEQ ID NO: 75284 - DNA, 519 bp, Triticum aestivum
  Clone ID: PAT_TA_75284
cgaccttcatatatacgaaggtgcaacagccacagtgctagcagctagcaatggcgtctagagcagcagcggccgccgtggtcgtcctggccttggtgtgtgccgcgcagccgtccctctcggcggccactgccgccgggggtctgtcccctgacttccacgcgacgacgtgcccgtccctgcagcaaatcgtggcgttccacgtgggggaggccttcaagaacgactccggcgtggcgccggccctcatccgcatcctcttccacgactgcttcccgcagggctgcgacgcgtcggtgctcatcgagggccccggcaccgagcaggacgagatccccaacaagacgctccgcagagtggcgcttgacctcatcgaccgcatccgtatgcgcgtgcacagcgcctgtagccgcacggtctcgtgcgccgacatcaccgtgctcgccacccgcgagtcgctcgtcctggccggcgggccccgcttcgacgtcgccctcggccggcgcgactccttcttcc

SEQ ID NO: 75285 - DNA, 351 bp, Triticum aestivum
  Clone ID: PAT_TA_75285
caacggccccgcctccggctcgccgccggtaacatgcgtcctctgcgacggcgtcatgtcgtgggcctacgaggccgccaaggagatcggcgtgccgtgcgccgcgctctggacggccagcgcatgcgggttcatggcgtacaaccactacaagcagctccgtcgaggacgggcttgtgccgctcaaggacgaggcgcagctcacggatcggtacctggacacggtcgtcgaccgcgtcccaggcatgtgcgacggcttccagctgcgcgacttcccgagcttcatccgcacgacggaccgcgacgacctcatgctcaacttcctcatccgtgagtcggcgcgtctgacgc

SEQ ID NO: 75286 - DNA, 442 bp, Triticum aestivum
  unsure (1)..(442): unsure at all n locations
  Clone ID: PAT_TA_75286
gaaccacgttgcatacacggtcgggtccgacaagcacccagcgatcacgacctgggtggatgacgtgacctcagcctacttctacctctgtgtcgcacacaccggcagcctcaccacggtgcacgacgagtccttgtccatcgactgggtcgcgtaccaaaaggcgcccacaggcatgctgggtggagacttgaagtggcccgctgcgtggcccgccggagtccactgcgaggacattccgctcttcccggcctttgacgagtctgtcaccccagccattcacgcgacagtcaaccatcgaggctcccgaaccgacngcaatgagcccaccttggtctgggttgagaacgtgcgggccaacaagttccgcgcctgtgtccacaaagtcaccgtcggcccgctaaccgactcgacctcggacgccgtccacgtctcgtggctc

SEQ ID NO: 75287 - DNA, 445 bp, Triticum aestivum
  Clone ID: PAT_TA_75287
cttcgccggcggcaggttcgtcgcgcagcggaagctcggctggggcaacttctccaccgtctggctcgcctacgacaccctcctcagcagattcgtggcgctcaagatccagaagagcgcgagggactacgcgcacgcggcgctccacgagatcgagctgctgtccgcggcggccaagggcgaccccacgagctccaagtgcgtcatccagctgctggaccatttcaagcacgccggccccaacggcaagcacatttgcctggtcaccgagttcctcggcgacagcctgctgcggctcatccggtacaaccagaacaagggcatcgggctgagcagggtgcgggagatttgccggtcggtgctgaccggcctcgattacatgcaccgagagctcggcattatccacaccgatttgaagccggagaatgtgctcctagtgtctacg

SEQ ID NO: 75288 - DNA, 350 bp, Triticum aestivum
  unsure (1)..(350): unsure at all n locations
  Clone ID: PAT_TA_75288
tgtgcctgcatcgccacctacattgattcattcacacttctccatactatgctttcttccgccattcaatattgccggtccatattncgggtatggcgcgactgagtctcatgtcgagaatgaaactgttgccccgaacgccacaacatttgtggattcaaacactcacgcggccagcacgaccatgtctacccaccccgatgcaatccctttgaacgctgaccacgatactgcacctcccagcgcaaaacgtgccaagttgtggtcggaagttgcggcttcgtcactgccgcacaccatggcatcaccgtcgccgccaccaccaccatcgtcgttgtcagtgttcccca

SEQ ID NO: 75289 - DNA, 548 bp, Triticum aestivum
  Clone ID: PAT_TA_75289
caaccactcgaccgcagcgccggcttcgtccccaaacacatcgccgccgaccgcctagtcgtcgccgagcacccttctctaccaaggaaacccttcgtcgcttcgttcccatcccccgcgcacccagcgcctgcttcctccagaggaaagccgccgaccgccctccatccccaccacaacaacgacctcctccacaggtttcctccgccgagcaggcctcctcctcctcaagctttctcccccgagcaggccctcctcctccacgagcatccttccctgagcactaagttgggtcgcctcctgtttccctcacccgagcagcgggccttcctgtacggcccctctctcgagaagctccacctcctctacatcctcccccaggtgcagcgccgcctccttgctcacggagagcacttggccgggtagatttcaatctttgcaaacttctgttccttttttcttctgagcagtaactagaacgacttcagaaagtgtttgagtttatattacactacagctcttaagattaagactagctttgtcatccg

SEQ ID NO: 75290 - DNA, 447 bp, Triticum aestivum
  unsure (1)..(447): unsure at all n locations
  Clone ID: PAT_TA_75290
gctttccaggaaggcgcgctcggctgcgtgaaagacttcctggagtcctgccgcggcgaccgccgggccctcgcgccggcgttcgggctcctccgcaacatggccaccttccgctacatcgccgagatagccgtgtccgccggcttcgtgagccacgtcctgtgccgcgctgggcagcgacagggcgagcacccggacagaggccgccatggcgcttgcggagctgtgcagcgtgagcagcagcagcaaggcgaggaatgaggccgggggcgcgatgccnaggctgatctggatnctngaggccaaggccgtgggcgagagggacgccgcggcgagggcgctngccacactcgtcgtcgcggcaagcagccaccggaaggcgttcaagaaggacgagatgggtatcgtgaacgcggtccagctgctggacccggccgtccggggcgc

SEQ ID NO: 75291 - DNA, 449 bp, Triticum aestivum
  unsure (1)..(449): unsure at all n locations
  Clone ID: PAT_TA_75291
gcacgaggctcccgcgtgccaagccaccgaccaacatggcagcgtctctcncagccgcggctacgctgatgccggccaagatcggcggccgggcctcctccgcgcggccgtcgtcgcacgtcgcccgggcgttcggcgtcgacgctagcgccaggatcacctgctccctgcagtccgacatcagggaggtcgcaagcaagtgcgccgacgccgccnagatggccggcttcgccctcgccacctctgccctcctcgtctccggcgcgagcgcggagggggcgcccaagaggctgaccttcgacgagatccagagcaagacctacatggaggtaaagggtaccggcaccgcgaaccagtgcccgaccatcgacggcggcgtcgactccttccccttcaaggccggcaagtacgagatgaagaagttctgcctggagcccacctccttcacc

SEQ ID NO: 75292 - DNA, 273 bp, Triticum aestivum
  Clone ID: PAT_TA_75292
gaatggccatattgagtatgctgggtgtggatcgggatgcggtggaaacatggttattgaaagttcccacgagaggaacaccaagtcaggtggttgtggttcaggttgtggtggtggaggttgtggcggcatggccattgaaggctccaaggctggcattgccaagtctagcggctgcggttcaggttgtggtgccagttgcggcggtatggtcgctgaaggctccaaaactggccttgccatagtcaggcggctgtggctctggctgtggtg

SEQ ID NO: 75293 - DNA, 257 bp, Triticum aestivum
  Clone ID: PAT_TA_75293
gaaccaaactcactccacactccagttctctggaacgtacgaagcgaaccagcaacagcgagcgatgcaggccatctaacaccgctcgagccctcgcggccgcggctggcgaagcagggcgccgactcggtgcagatagccatcgtctgcaccgccattaccaacctcgtcgagtgatgtctgcactgcattgttttcccgtcgagagaaatgggtcatgttctgcattgttggttgctcgaccgtgatgtcgtgta

SEQ ID NO: 75294 - DNA, 557 bp, Triticum aestivum
  unsure (1)..(557): unsure at all n locations
  Clone ID: PAT_TA_75294
gttttgaaatattgcagtaaaaacagttgcaggataaaattgcatcccgtatgaacaatcatagattgacccagatcactcaaataaaaaaaagatagatttgacgccgctgccgtggtcgtcttcgatgccgtcgccgtcctcctcttcgtcatgcatggtgaggtcgatgtacggtggtggctttcataggtgggcaggctgcccctgcagcggctgcaaggccggaggcgcctgcaacacctcttccagtggcgggaacggcgcccacccacacgggcggcacggacgtgttccggcgtgcacggcaccatgtccgtccacgtccaggactggcccaccaatgccacgaagggtgctcatcgtcggcccctccttgacctcctccatgacctcctccttgacctacaactccggggggattgcgacgtcncatgcggcggagagggccagcatctcgtcaaggccctcccattgggcacggttatatttcagttttagaaatatgtattgatggaatatagcagcgtttctttttacttaatttcgttttgctg

SEQ ID NO: 75295 - DNA, 468 bp, Triticum aestivum
  unsure (1)..(468): unsure at all n locations
  Clone ID: PAT_TA_75295
tgattgaatcaggtcaaaaggacaaagcacattgtgtccagaaaaagaagaagcaaaaacaaactcagtttacggctagctaacggaaaatgagcagcctggaagaagcactgctgcagaagccgcccccgtcggtagttgtgtgccaccacgccgccgcggcctgccaccatgaggggtgccccgggtgcgccatggaccggaggaaggagagcctccgcgggaggatcccttacaaggagcttttcttcgtcgctgccaccactctcgctagatctctaccaatcacgtgcctcttccccttcatgtatttcatggttagagacttcaacattgctnaaagagaggaagatattggatcctatgctggttttcttgctgcttcatacattattggaagagccattacctcgatattttggggtattgccgcagatcgtctcggacgaaagcctgtaattgtatttt

SEQ ID NO: 75296 - DNA, 191 bp, Triticum aestivum
  Clone ID: PAT_TA_75296
aactgtgctgcagtggcgccgcactcaccaagtcaacatcgatccccatcgccccgcatcatcgccgcccggtgccgtcgccttggatcccccacccgcaccatcgccgcccggccggtgccgtcgcccccagccccttcgtccagtaccgcgccgccccctctctctctcgtacgctacctcctctcccc

SEQ ID NO: 75297 - DNA, 494 bp, Triticum aestivum
  unsure (1)..(494): unsure at all n locations
  Clone ID: PAT_TA_75297
tgaatattctatgatgcccacgacgactctgatctagtgccgctcatggctcgacacgatgtataaaatcagggtatctccanggatgatactttgaccctgcgatgcaccatcactgtgctcaaagatatacagatacccaggatcccagccgaaggaatcatcgcactgccatccaccaacttgcaccaacacctcggcgcgctcctccagagcgagaccggagccgatgtcaccttcatcgtctgcggcgagtcgttcgccgcgcacaaggacatactcgccgcgcgctcgccggttttcaaggcccagttcttcggggacatgaaggagaagtgctcggtgcgcttggaggtcgaggacatggaggcggcagctttcagggccatgctgcgcttcatctacacggacacggcgcctgagcttgatcaaccgctcgaggaggggacggccatggctcagcatcttcttgcggcctccgacaggtacgaact

SEQ ID NO: 75298 - DNA, 548 bp, Triticum aestivum
  unsure (1)..(548): unsure at all n locations
  Clone ID: PAT_TA_75298
gccggcaaaggcatccccgtggtgccctgcggcctcgtggcctggagcctcttcaacgacacctacagcttcgcccgccgcccccgtcgcgcgggcggcatcggcggcggcgaggcgctgagggtgatcaagagcgggatctcgtggcggagcgagcgggagcggctgttcggcaagcacgtgtaccccaagaacttccagaacggcagcctcgtcggcggcgggcggctcgacccgagaaagcccctnagcgagcaggaggagctgattgtgtggatgcggacggcggcgatnccgcggttcaggaagctgtacgggagggtggaggcggacctggacgccngcgagacggtngcggttgcggtgcggaacagctacaacacgtacagcttcgaggggggcaaggcggttgtgctgtccaccgccgggccgcttggcgggcgcaacgcgttcctcggccgcgcctacctcgtcaccggcatggcctgcctcgtcctcgcgctgctgctcacgctcgtctgcctcttcttccccgtgacagaggagca

SEQ ID NO: 75299 - DNA, 296 bp, Triticum aestivum
  Clone ID: PAT_TA_75299
tcacgacgtcaccgccgtgaaaggcacagttgacaccaatccaatcgtgttgcaaattcccttgccagggcgtcagtcgagggcacacacactccgcaagtgccactctgaactgaatttcctctgctgaaccggcaagcagtgacagcgctagcgactgaggggaggaggggctgctgacagcgggatcgagcgatggcagctgtccggcggcaggcggcggcaaagcggggcggaggtggcgcggccggaaagagcgcatggctagcggctgacgggagcaagaggtgggggga

SEQ ID NO: 75300 - DNA, 552 bp, Triticum aestivum
  Clone ID: PAT_TA_75300
acggcagcctccaccacctcatcggcaccaaactgccgacgcaccgcgcattcctgcgcctggcacgtcggcatggcccactcatgctgctgaggctcggccaagtgccgagagtcatcgtgtccacccccgaggcggggatggaggggttctgaaggtgaacgacctcaccttcgcgtcccgcccgagtggccccacgcctggacatcgtcagctgcgggggcaaaggcctcatcttcgcgccctacggcgaccattggcggcagatgcgcaaagtctgcatcatggagctactcagcacgaggcaggtgcggcgtatcgactccatcaagcaagtcgaggtcacacacctcgtccagtcggtggctgcctcgtcgtctgccatcatcgacatcggcaaggagctggccaggctgaccaacaacatcatctcgagggcagcgttaggcggccagtgtcggctgcacgaggcttacctacgagagctggacgtgctggcatcgctcgtgggagggttcagcctggtggaactcttcccatcgtcgcggctgg

SEQ ID NO: 75301 - DNA, 351 bp, Triticum aestivum
  unsure (1)..(351): unsure at all n locations
  Clone ID: PAT_TA_75301
aggcggaggaggacaaggagaagaaggaggaggagctggtcaccggcatggagaaggtctccgtggaagagcccgaggtcaagaaggaggagcacgtggatngcgagaagaaggagaccctcttctccaagctgcaccgatccagctccagctccagctcgtctagtgacgagcaagaggaggaggtgatcgacgaccaccgcaaggtgatcaagaggaagaagaagaagggtctcaaggagaagctccaggagaagctgcccggccacaaggacaccgagggtgagcacgtgacgggcctacccgcaccggctgaccccgcgtccgtgcagacccaccatgacaccgacg

SEQ ID NO: 75302 - DNA, 291 bp, Triticum aestivum
  unsure (1)..(291): unsure at all n locations
  Clone ID: PAT_TA_75302
tgtggtgttgccagctttggtggatacctgcttgacaggaatgtcattactatgtcattggcccctaaagatgagcatgaagctcagatacagtttgcattagagcgtggaattccagcatttctaggagtaatcggaactcaaaagctccctttccctgatnatgcatttgatgtggtccattgtgcaaggtgcagggtccattggtatgcgaatggtggaaaaccactactggagcttaacagagtgctaaggcctggaggatttttcgtttggtctgctacacctgtc

SEQ ID NO: 75303 - DNA, 322 bp, Triticum aestivum
  Clone ID: PAT_TA_75303
tgcagtgcttctcctccccttccggttcgggttctggttcggttcgggttcggttcgagagagaggccgagtagctagcctagtctagggtttcggtagagaggaagggagatccatggctggagacggagtaccgctgcttcgtgggcggcctcgcctgggccaccgacgacaacaacctccagcaggccttcagccagtacggcgagatcctcgacgccaagatcatcaaggaccgcgagacggtggaggtcccgtgggttcggcttcgtcacgttcggcagcgacgagtcgatgcgccaggccatcgaggagatgaacg

SEQ ID NO: 75304 - DNA, 179 bp, Triticum aestivum
  Clone ID: PAT_TA_75304
gcgcccaaggccgccgcctccaacagcccctggtacggccccgaccgcgtgctactacctacggcccgctctactagcgagcccccgagctacctcagcggccagttcccgggcgactactggtgggacaccgcgggcctctccgccgacccggagaccttcgccgagaaccgcgagct

SEQ ID NO: 75305 - DNA, 439 bp, Triticum aestivum
  Clone ID: PAT_TA_75305
cgatccacttcaagttccccaaatccccaaccccgcagcgcgcgcaggccgaagcccggttcgcagtcacgagaagcaggagagatcgatggcgcgtaccaagcagaacgcgcccggaagtctaccggcggcaaggcgcctcgcaagcagctggccaccaaggcggcgaggaagtcggcgccgaccaccggcggcgtgaagaagccccaccgctacaggcccggcacggtggcgctgcgtgagatccgcaagtaccagaagagcacggagctgctcatccgcaagctgccgttccagcgcctggtgcgggagatcgcgcaggacttcaagacggacctccggttccagagccacgccgtgctggcgctccaggaggctgccgaggcgtacctcgtcgggctcttcgaggacaccaacctctgcgccatccacgccaagc

SEQ ID NO: 75306 - DNA, 467 bp, Triticum aestivum
  Clone ID: PAT_TA_75306
ctcacggcaagctcgtgcatgatctcaaggtccaggcaggttgcggggagatctcctccttccagttcgatgtgcgcgcacatgtggagggccgtgacgcgagcgcggcttccggttggccgccgacgcgacgactacgttccgcatggcggtgaactgccgtcaccgcctgcgcccgaagatctccccggtctacttcggcaacgccatccagagcgtggcgacaacggcgacggtgtccgagctggcttcccacgacctcgggtgggcggcggccaagctgcacacgaccgtagtggcgcacgaggacggcgccatccggcaggcctgcggcggactgggaggcggcgccccggtgcttcccgctggggaaccccgaccgcgcggcgctcaccatgggcagctcgccgcggttcccgatgtacgacggctacgacttcggctggggcagagcgctcgccgtgcgg

SEQ ID NO: 75307 - DNA, 544 bp, Triticum aestivum
  unsure (1)..(544): unsure at all n locations
  Clone ID: PAT_TA_75307
actagtggatccccgggctgcaggtcactcatggatcatgtaggcgcagcctccaacaaggcttccacggcggcggtgccagaccgagcgctcctcacggacatcgaggcggccatcgcgcggtgcacggacggtggagggggcgggaacgcttcggaacaaccgccacgtccacgagatcctcttcctctgtctccaacngccccgggcgcgatcaccttccttctcccgccgcatcacggcgcgcctagaggcggcgcggaccccggccaccgcgctccggtctctgctcctcgtccaccgcctcctccgcgcgggcgaccgctacttcgagcaggacttccgaggcctctgggcctcccgcgacctccgcgtcgacgcgccacgttgcggctgctcctgttctacctcctcggcgtgcctcaggcgccggccgccaactatgtcacggccagcacggtaaccgccaccggcgcgtgctctttcctccacggctacacggcctacctcgaggagcgcatgcagtgggtgatcaaccagtccg

SEQ ID NO: 75308 - DNA, 231 bp, Triticum aestivum
  Clone ID: PAT_TA_75308
cacacaagtgctagctagctaatcgatcagccggcggccatggcggaggagaagcaccaccaccacctgttccaccacaatggagggcgaggacttcccgcccgccccttaacggcggcttcaacgcgtacgggtactcgaccgagacggtagtgaccgccaccggcaacgagggggagtacgagcggatcaccaaggcaggagaagcaccacaagcacaaggagcacctc

SEQ ID NO: 75309 - DNA, 605 bp, Triticum aestivum
  Clone ID: PAT_TA_75309
cccctctccgcctcgcagctcccccagatccaaaacccaagcgcgtgcccgcccccggaatccaaaccctagcagcgccgcccgctccctgcctgcgatgaggggcctccgggcggacgccggccggcggcggcggtggctcatcctcgtcggcctccaccgcaggtgattgcgattccttccgctgcggcgctgcccagtgatgttctggtgggctgtagtttgctgagtttgatccgcctgcctgggctcgcaactcagcggccttaccgtcgaatccgtgccgcagacggcgcttctccgcgtgcttccgctgaatttcgcgtccctcgcgcgcggcctgggcagattctctcgttttcgcgtggcaccaatggagatttatgtgtttttctttgttgcttcctctgcagagagctcgcgcttcgactcggggcagtactccttcttcggcaaggcgccgctagaggggctggagctcggcggcagcatggcggatgacgtcggcctggacagcggctattgcggcggcttcggtgggcacgatgattgggcataccagctgtctcctgtgggggaagacgtgcggctctcaccgactttgt

SEQ ID NO: 75310 - DNA, 366 bp, Triticum aestivum
  Clone ID: PAT_TA_75310
acggtggcgatgaggagaggtacgatggctttgaaggagctggtggaccggctaacttcggtggtggcgaggctggtcagtgacaagcgcaccaaggagctcgtcgccgtcaagtacatcgagaggggcaagaagattgatgagaattttgcgagggagatccatcagtcaccggtcgctccggcaccctaacatcatacgattcaaggaggtttgtgtaaccccgacgcaccttgccattgtcatggaatatgctgctcgcggagaactcttcgaaagaatatgcaccgcgtggcgattcagtgaagatgaggcaaggtacttcttccagcaactactttcaggggtcagctactgccattccat

SEQ ID NO: 75311 - DNA, 101 bp, Triticum aestivum
  Clone ID: PAT_TA_75311
agctcactccgaccatgagcgcctcctagcactcacggccttcgacgacaccaaggccggcgtcaaagtgccttgtcgatgctggggtcaccgccgtccca

SEQ ID NO: 75312 - DNA, 454 bp, Triticum aestivum
  Clone ID: PAT_TA_75312
ccgccgccgcccaccccggcggccgaggaacctgccaagaccgacgagccggccaagagcgatgtggcggccgagggcgaggcgcctaaggccgagagcagcgagcccaaggccgaggagcctgcccaggaggagccccagggggaaggccccggcccaggacgatcccaaggccgaggagcctgcccaggaggagcccaagacggaggcaccggcggcggtggctgtcgcggaggagcccaaggccgaggcaccggcggcggtggccgccgcggacgagccccaggcccaggtggcggccgaggaggcccagccggaggagaaaaccgtcgtggtcgccgaggaggaaggcgaccaaaaccgtggaagccatcgaggagaccgccgtccccgccgcgtccgagcccgaggcggcgcccgccgccgagcccatggaggagcttatctggggcgt

SEQ ID NO: 75313 - DNA, 216 bp, Triticum aestivum
  Clone ID: PAT_TA_75313
tcatgaacgccatacatgcccacggtactgagagccccgagggtggtggccatcctggccgtcgtcctggcggcggcgctcgccacagccgtgaacgcccagcagtgcggctcgcaggctggcggcgccacgtgcgcaaactgtctctactgcagccaattcgggtactgtggtaagcggcgacgcctactgcggcgccggctgccagagccagtg

SEQ ID NO: 75314 - DNA, 484 bp, Triticum aestivum
  Clone ID: PAT_TA_75314
cctcgactcgtgggtcacgaaaagagtagaacacttggagaaatgcttcagacgagacagatggagagattgcctccactgcacctggcagtggtgtctctgctgggcttcttctgcctcatccatgcttcaagggctgcgatctcattcccacctgcggcccctagggtgcagctgcagaagatcgacgcaatcccatcttccggtggagcagattgccaggccgccgtcatagtgtgagagcccgaccacggcggtctcagcgggaggatggagatcgagatggagctcgaggactacccgggctccggagccgacgaccaccactcgccgtggtggcggcaggagaggaggaactgagaacatggagcaaagctgcatgtgtgttcctagtgctgcacggttccacatgtttctcagactgtaatatctctacttcattggtgtaacataccaaaacgaagcttgttacttgcaagggctt

SEQ ID NO: 75315 - DNA, 445 bp, Triticum aestivum
  Clone ID: PAT_TA_75315
ctgcaggtgaggcgcaggcgagcctgctgtcgcggacgccgagcaaggcgcgcgtgtccatcaacctgcaggacaacgagatctccctggaccggagcggcaagctcggcagcccgagggcccggaagccgcagagccggctaacgcaggttgtcgttggcgggctggacgcgagccggcggctgggacgcgtggaggaggtgctgcgggagacgggggcggacatcatcgggctgcagaacgtgcgcgccgaggaggagcgcgggatgcggccgctgtcggagctggcgggcgcgctgggcatgcggtacgtgttcgccgagagctgggcgcccgagtacggcaacgccgtgctctcccgctggcccatcaagcgctggaaggcgctccgcgtcgccgaccagtccgacttcaggaacgtgctgagggccacgatcgaggtgcc

SEQ ID NO: 75316 - DNA, 400 bp, Triticum aestivum
  Clone ID: PAT_TA_75316
acccctctctcgactctctctttccccagctctgctcacggcaaagcacagccacaagttcgcaagccagccacacggccagcagcagagagacgagagaaaatgggcaacgctctgccgtgcttggtcgaccaggccgtgaaggctctgccggccgccgcgaagcccaggcggaggactgtactcgctcaagcttctcatgagggtcctccacaggatgaagaggacgccgcgcggcaacgagattggcggctagtcctctccggaatctgattctgaagtaggtggagctggcgtgaagagtgtcaaggccagccacggccaggcctccccgagacgagcggcggccggtggtggtggcggccagaggaagggcgtcgtgagggtcaaggtgctcctc

SEQ ID NO: 75317 - DNA, 259 bp, Triticum aestivum
  unsure (1)..(259): unsure at all n locations
  Clone ID: PAT_TA_75317
tcggagagcagctgcgaggcggtcaggcaggcgtgcaccgtgctcgtcaagcgcctcaagcccatcaaagagggcctcgaggcgaaatccggtgcgccggtgccatggagcaccctgatcgcccaagcgaatatngcgagcgtgaacctgtcggcgcacgccttctggacgccagacccagcctttgtaaaatacatcaactatggagccgccgtccgcgaggtggaaatcgacgtgctgactgggggcacgacgatcc

SEQ ID NO: 75318 - DNA, 526 bp, Triticum aestivum
  Clone ID: PAT_TA_75318
gcagcggcagccgcacatcagcagcttgctctgttccatccggcagcaatggcggccaccaccaccatggcgctctcctcccccgcgatcaagctcgccggaaccctcctacgccctcggcggcggcggccgcatcaccatgcgcaaggccgcgcccaaggcctccgcctccaacagcccgtggtacggccccgaccgcgtgctctacctcggcccgctctccggcgagcccccgagctacctcagcggcgagttcccgggcgactacgggtgggacaccgcgggcctctccgccgacccggagaccttcgccaagaaccgcgagctcgaggtaatccactgccgctgggccatgctcggcgcgctcggctgcgtcttccccgagctgctcgctcgcaacggcgtcaagttcggcgaggcagtctggttcaaggcgggctcccagatcttcagcgagggcggcctcgactacctcggcaaccctagcttggtccacgctcaaagcatccttgccatctgggcttgc

SEQ ID NO: 75319 - DNA, 329 bp, Triticum aestivum
  Clone ID: PAT_TA_75319
ccgtcctcgaggctcgtgcggtggttgagcagcgaggagcgccgcataaagagcagcctcgacctcatgcagcgcatcatcaccgacatcctcgtcgagcgcaatgctgtgcgagctgccggtaacggcgacgaggggctgctagacgtgctgctcacatgccaggaggaggactcgctggaatcccctctacacgcgacagagataaaccaccgtcttgtttgacatttttggaggcgctactgataccacttcaaccacttttgagtgggctatgtcggaactcgtcaatcatccagtagccatggctaaggcacaattagaggccc

SEQ ID NO: 75320 - DNA, 450 bp, Triticum aestivum
  Clone ID: PAT_TA_75320
accataaggccgtgtcggcgctcgtcggcatagacgcgctgtccgtggacattgccgcccgcaagatgacggtatcggcatggtggacccggtgacgtggtgagcaagctgcgcaaggcgtggtcggcgtccatcgactcggtcggcccggccaaggagcccgagaaggagggcgagaagaaggacggggacggcaagaaagacggcgccgacgcctagaaggaaggcgagggggagaagaaggacggcgacggctaggacggggccaagaaggacgacggcgaggcgaagccgccgcagccgacggaggagcagctcatggccgagctcatgaaccagtacagatcggcctattcggcttaccacaacccctacattaacagccactacgtggtgcagagcatggaggagaaccccaactcctgcgccatctgctaagaacgcgaccgc

SEQ ID NO: 75321 - DNA, 487 bp, Triticum aestivum
  Clone ID: PAT_TA_75321
gaagtggaagaaggatagcaactatacacctactgtgaccagctcttccttgccttggtactaccgcgcaggcagtttctaataagcgtaagagggaggcatgatgggcaatatagtgcagaggatgtcactttataataagttggatttgtggtttactatgatgtgctcatcaatgactccaccaacgctggttttgaggatgatgcttccaagaatgaccagacccgtgagcatgacgtccttgcattcattcttggagcgaagaagattatctggtgtttaataagttctggatgctccgtggagacatggctgtcggactgtggagttacctgtgaaagttacaccagcaacaaccaaacacatacctcactgtcaacaccatcatggagcataagccatcgccgccccgcccgagcaacgatgtgtaggctggcgaggccatcatcctcgacacatgaggggcacgggcagcagagacgac

SEQ ID NO: 75322 - DNA, 514 bp, Triticum aestivum
  Clone ID: PAT_TA_75322
ccaagttcaacaacgaaatcgcttgcccacaaggacaatggagatctgaacctgcacacaacaccaagccaggtttgggatgcgttggtgcaccagattgcattgctgctccatggaacagagataaccatctcggtaatggaagagacggatacaccaacacctacaactggaccatcccatcttgcgttgtttctgagaactgcgtccttcgtctccgttataacatctccaccactgattatgatggatggaacacctttgcatccagaaacggagcatctttgtctcctgtcaagcaagatccgtacgtcaacccatttaacttgaccagagatggagaattcggaaacttgacccttgctattgatacctcccaattcggaagaacctttcaagatcgttcccacatctttgcaatcagaaagagaccttctggaattgattctgatgcacgtatcttcaacttgaacgtcagaggacagagaggaaacatcgtccaagcttaccctgc

SEQ ID NO: 75323 - DNA, 104 bp, Triticum aestivum
  Clone ID: PAT_TA_75323
ctgcaggtgcgctgaaaacataggtgtgccccgtgcttctgggatgttcaggcacgcgctgcatgctagttgcatttctcagcgagtgacaagcatctgcagcc

SEQ ID NO: 75324 - DNA, 517 bp, Triticum aestivum
  unsure (1)..(517): unsure at all n locations
  Clone ID: PAT_TA_75324
ctcatcatcatccccgataccaaagctcatcttcttctccttgaaatctttttgggttcacagatttggaggatgtcttgcaactgtggatccgggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaatnacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaata

SEQ ID NO: 75325 - DNA, 380 bp, Triticum aestivum
  Clone ID: PAT_TA_75325
cgccgctggcgccgtgtgggcgtgtggcggtggcccgctccagcgagcgccggccaacggcggatcgatgggtcgatattatatctagctgattcagacagattacattcatctcaggcatgcatccgcggttggcgacctcgcgtgccgccattgccggaggctggctggctggctggataggcgtccgccgcgccggtgttacatctcagggaagacgcttgccaagattcctgcggttccagactgattggtgagattacagttataagggcggcctgcaatacaaacagccttactaatgccatggaataagctacacaatactcagaaaaaatggcaacagaaccaacttgtcgctctcttacggtctatagcac

SEQ ID NO: 75326 - DNA, 492 bp, Triticum aestivum
  Clone ID: PAT_TA_75326
cctcttgcagcctaaccccacctctcgagtctcgacaccctcgaatcagcgtccatggcacccaaggcggagaagaagccggtggccacggagaaagggctccagcggggaagaagcccaaggcagagaagcggccgccggcgtccaaggagggcggcgagaagaagggcaagaagaagtccaagaagagcgtggagacgtacaagatctacatcttcaaggtgctcaagcaggtgcacccggacatcggcatctcctccaaggccatgtccatcatgaactccttcatcaacgacatcttcgagaagctcgccggcgagtccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctcagcctaggcttcatcggacgaatggatggtcg

SEQ ID NO: 75327 - DNA, 568 bp, Triticum aestivum
  Clone ID: PAT_TA_75327
gctgcaggatgagaattcttaattcaagagttatagcggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcgaaaactttccaaggcccgactcatggtatccaagttgaaagagatcagttgaacaagtatggtcgtcctttattgggatgtactat

SEQ ID NO: 75328 - DNA, 100 bp, Triticum aestivum
  Clone ID: PAT_TA_75328
gccggcagtggcacgggctgcggtcgcaggacgcgcgacctgttcgtgcggcccttccgcaggaaggggtacatcccgatcaccacctacctgcgcacct

SEQ ID NO: 75329 - DNA, 164 bp, Triticum aestivum
  Clone ID: PAT_TA_75329
gcagcaaccaaggtgaaaaaatggcgccgtgtgaatcgtgttcgggccggccatgtcgacgaacgtggcccgggtgctggtgtgcctggaggaggtcggcgccgagtacgaggtggtcgacatcgatttcaaggccatggatcacgagagccccgagcatctcg

SEQ ID NO: 75330 - DNA, 539 bp, Triticum aestivum
  Clone ID: PAT_TA_75330
ggcgtgtctcctcgccggtctccaccgggtgccgctgcaggcgcaagcccgagctcgtcgtggtccaggcgcccgacaccccgccgtgccgcctcgacaagttcgtcggctacgacaatgacggcgactcggccgactcgggcgaggcgctcaagaagccgacggtcgccgtgcttggcgacggcgggctcggcggcaagctgatcacctccgccacggacatcatcatcgacctgcggaccaagaagaggcccgacaaggtgctgctcccgccgatcgtgaccaggccgaagccggcgcggaggacgcccgaggagctcctcgatctcgaggacaagcacatcgacaccctcgcgcgcgcggcccaacgagccaccacgcctttctcggacgaacaaagcaaggtcgccaaaccgaggcggtccgtgtcatcgtcggcgcgccggctcaggacgcgcgggaacacgccccgcgtggcgtcgtgcaaaaagtccaagcctcccgcgccggcgcccgcgccatcgccagcgcgggagaag

SEQ ID NO: 75331 - DNA, 282 bp, Triticum aestivum
  Clone ID: PAT_TA_75331
cctgataagcaccacttcgagtcaaggccgactccgtgcgcctccaagacctaccctcagcatgccggcgccatccgcaatggtggacacatcgtctcaatgcccgtccctgcaatgttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataa

SEQ ID NO: 75332 - DNA, 554 bp, Triticum aestivum
  Clone ID: PAT_TA_75332
gcggccggcgcgaggagggcaaaggaagagaagaggagatcaccgagcccagcgcgcgcacaggacagcaggcgccgcgatctcgcacaggagcgggagaatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaatcactgaccagcttggcctgcattctctgcgccagcgac

SEQ ID NO: 75333 - DNA, 507 bp, Triticum aestivum
  Clone ID: PAT_TA_75333
gcttcctcataagttgtcttctaaagttgaacatacgccaatcgactgtactcctgaagcggaaactgaacttgattcgaccagcacaaagaaaaaggcaaagcgaaagaagaaaaaagttgtcccgaccagcgacagcagcacccacagcgcaaacaccacagttgagagcgccgcggagagtgttgtcgacccggacgatgacatgcctgtactagaaccatgcattgatgaggaatcgctctcagaaacggacgatgcggctgtgtttctgttgccctcggccaccgagccgtttcggtttcctggaagccgggctttccctcaaggcttgccgtctggtaacagcgacaccacggccgcgcagcgcaatgctctcacgcacgctgcgttgctaaaagcggacgcactgagccagcaggcgcctgcgaagccgtatacgtacagcatcccccgcgcggcctaccgcaccgcagagtgtgctctcggtccctctgctatggagaa

SEQ ID NO: 75334 - DNA, 430 bp, Triticum aestivum
  Clone ID: PAT_TA_75334
ctcatctgcttcctccgttctcgccctcccacacgcgcacccactccttcctgctgtccaatggcgctcggcgcgagctctaggtggaggagtaacaatggcggccggccggcgcgcggggaccggaggagaggccggcccccgccgcagaggtaggcccggcgggtgcggccgggcgttgggctcccactgcgtgccggcggcaggctccctccggttgctccgcgaggaggaagacggcgtgagctagcgcgcggcgggcgcatgcaggtagtgcgagcgagcttgcggggaattgaggcgtcatggtccgagatatatgtatatctctatctctttctagcttgtattatctgaaattattagtggctgattcttagtagcagtagtactctagtatagtgctccattttcttgctgtcccgagaga

SEQ ID NO: 75335 - DNA, 464 bp, Triticum aestivum
  unsure (1)..(464): unsure at all n locations
  Clone ID: PAT_TA_75335
tggccaacgtgtcaccaagctggaccccgaggacgaggagcaggagtcgttccccctcaccgaccacaagtacaactgcgccttcccgtccaccaacccggaggggaccaagctcgtgttccgctccagcagggacagggtccatggagggaagagggaggacaagaacctcttcatcatagacgccgagaaggtgggagcacgccggcgtggaccagctcaccgatnggccatggacagacacccactgcagctggtcacccagggaaggctgcgactggatcgtcttctcctcgagccgcggtaagccgggcggcgcgcccgtttcggaccacggcttggactcgggctacttctctgtctacctggtgaacgccaaggacatgggcgtggtgccggtgccggtgccggtgcgggtgatccacagcgcgcccaccatcgcaggacacgtgaaccaccccgtg

SEQ ID NO: 75336 - DNA, 509 bp, Triticum aestivum
  Clone ID: PAT_TA_75336
tgcaggctcaaatctcgtattctttgcggctccatgcaagctcgtgagcaggcatggatttgatggatccatgggtgggtcggcggcaactgcaggctgggagcgattgcgttctctgcggctccatggtggcttcagattcgattgttcccctgtcgtccttcttgggtggatttgacggcaactgcgggttggggacggatttggtggcaactgcgggctgggggtcatgctcttcttctttgcctggatcacgcccgcgggctcgcgccgctcaacatagctaggtgctgccagctcccaacaggtaccacatgactaacctgtagctgacccacgtacccattcctgcacccaacgacagcttagagttccccctctaccacgacgggctggaagaagatcgctcaatggcatgcccgtgcttttcatccccctacaatagcagaagctacaagcaagtgaaggcatgctttgtcatgtaactcgagcattgctacttgcacagg

SEQ ID NO: 75337 - DNA, 614 bp, Triticum aestivum
  unsure (1)..(614): unsure at all n locations
  Clone ID: PAT_TA_75337
gtctctattgattgttgtaggagatccagaaagcggagcattggggcactctgatttttaagaagctccatgcacgtattaaggccagtaaattccatttggttcctcatctgcttctctatggtctgttgtccttattcgatctgttattcaggtatgtgttgttaacgctcnctaatnttttgggagaatcagaaaaaaataagttttgcaagttacgtcatatttccatgttttagtatgagatttagatatattgtttctccggttccatattcattatatgtttttctcctataattggcctgcttgtttacacaagtctgaattcctaaaggttcaagagtatttcaatgttgctaaagaaagatacaaggatcagtgccgtaacattgttgaaagacaatcagacacagtatgcttttaacttgccatttccttactgactaaacctgagtacatgactatnttcagttttctaattcattggagctgtgctaatctcctcactccttgccctgatgtaggacaccatgcagcagcactgcaccctgcagtgcatgctctgctcaccatgacctgcctcctcatcatcagacatactcatgtgtact

SEQ ID NO: 75338 - DNA, 199 bp, Triticum aestivum
  Clone ID: PAT_TA_75338
gcacgggcacgcccgccctacgcgatcgcgacctcgattcgggaccccctccggcaggcgcggcggcgcgccattctccggccgcgacgacaagactatgctctacagtgtatgggatagctaattcaaggatgtctgactctatggcttacgacaaggagcttatgttgaaaggctgaggcaagaggtcaaattggga

SEQ ID NO: 75339 - DNA, 576 bp, Triticum aestivum
  Clone ID: PAT_TA_75339
tcctcttcttcttccttctccacaccgccccacacaccagcgccgttgcccgtcgtcgtagaccagcgccgccaccaccacgcgttgctgcaccgctgctacaaactgtcgtcgcctagtgtcgctgcaccgctgctgcaaatcgctgtcaccgctcacctcgtgctgccgtaggctaggctgggcggaagctgctgtcatggccggcgggagctgcgtgcaacaggtgaagtagagcgggctcgccggcgttgcaatgaagcagcacggggccgccggagctgcagtgaagcgccgccggagttgattgaaatgccgccggacttgcaacgaagctcgccggactttcaatgaagcgccgtggggctgttgaagcttagtcggcgctacaatggagcacgaccggcgctccagtgaaacaccgcggggatcgccggatttgcaatgaagcgacgcggccggcgctgcagtggagcgctgcggggatcgccggagttgcaatgaagcgccttggtcggcgctgcagtggagcgccgcggagatgccggagttggaatgaagcgccacggccggcgc

SEQ ID NO: 75340 - DNA, 129 bp, Triticum aestivum
  Clone ID: PAT_TA_75340
ggaagcaaactttggagcacaaggaagcgtcgaaatcaggttcctcgaagaagcttcgccctggtcattaccacccgaggctgattcctgacctcccgagatgagatctccctgcaaatcctcgcgagg

SEQ ID NO: 75341 - DNA, 124 bp, Triticum aestivum
  Clone ID: PAT_TA_75341
tgccgctcgccgcttctcccggggacagccccagccctagcggagcggagccgcagcccagcccggcgcgcgtccgttgcgccgctctcggtccttctcacctgccagatccagacccggtgct

SEQ ID NO: 75342 - DNA, 628 bp, Triticum aestivum
  Clone ID: PAT_TA_75342
gcaggtctgattgctgtctccaatataaacgaaaagaagctggtagcgccaggaagcattgccaggtccattttgtcagagcaaaagctgcgagcagtcctcgaaaacgctcgtcagatagttaagattgcagatgaatttggatccttcagtcagtactgctggggttttctgaaccacaaaccggtagtaagcaaaatccgatatccaaggcaagtccctgtcaagagtcccaaggcagacatgatgagcaaggacatggtgcgaaggggactccgaggcgtgggcccaacggtcatatattccttcatgcaggcagcagggctaaccaatgatcacctggtcagttgcttccgtttcaaagaatgcaagccgtctccaagccttgccatgagcgacgccgacagggcgaagacagaggcagaacaaaaattggaggagccgagaacaaaagcccacggggaggagatgaccgtaaactcggacccgtcgatagcgatcgacacgctcaccatttcgtagcgtttcaaggagcagcggcgtggtgagccggctattgtggtcgtgttacctctgtaaattttgtgctaggttgccccttcaaatgagtctagggattgtgtataga

SEQ ID NO: 75343 - DNA, 636 bp, Triticum aestivum
  Clone ID: PAT_TA_75343
ctcgccaactactccctcgacaccaccgcctctccagtgtccttctttgagctacttggggtgctggagaacctgaagggggtaacatcacctcaggtggcctctcagtgcgtgctccaggcatatgcaagtggaaatgttcagcttgtcaacgggacagacgcaggcaaactctcgcagttccgcgcgcattttcgtgagcacggatcaagataaaggttgcaacttcgcagcctacgtgccctccgaagaggacacgccgttgcagagggccgagtggatcaaatacctgggaacgttcaccaactccgaagacagggccaatgcagtatatgatgcaattaagacaaactatctgtgcctaagcaaagcagcagctgccctaagcacccgattcaagccagtagtggcatgggtcgaattcacagagggagtgtggacatttgtcagagaaagctacaagttacagtatgtcaaagatgcaggagcagagatcgttgatgcaactattaccgatcagcgattcaacggttccgatccagaggacatggacagcttacatgccatcctttgtacggtggatgtggtcatagatcagacatacgcctcggatcctgcagagtacaagctgtccac

SEQ ID NO: 75344 - DNA, 506 bp, Triticum aestivum
  Clone ID: PAT_TA_75344
ctgcaggctctatctcatacggacatagagtcaaattcccaaaggtcaaatgccacgagaatggaagaggccaagcaaaaaactttaccttcagtgatggaaattttaatgtttccattccttctgatggaagagttccatactatttcttgacccaaaaggatcaaaactccacctatttcttcagattcgagaagatcttcgaaatatttgaagataagaagggaaactaccacaaggtgccattcagctccatcaaattgaataccttgaagtggaaagtgtcagtgaccaatgattcgttcacctttacaggaataaagcaacatggcttccaaagacacagattcgaatcagtcagtttggtgaataccttcagcagtggaaaggatagcaatggaatctgcagtggatcagtcttgcaaaaatgtaatgctaattgtttggcattctgcagaaacgtcagcgaatgtgctttgggttgcgactttggcaaggacagaaac

SEQ ID NO: 75345 - DNA, 115 bp, Triticum aestivum
  Clone ID: PAT_TA_75345
ccgggctgcaggaacgtgcaaggccagcaaccactttattgtctgcactgtatatagaagaggaattaagccccaagagttggaggcgatgtcgatggttggaagtccaagtcgc

SEQ ID NO: 75346 - DNA, 414 bp, Triticum aestivum
  Clone ID: PAT_TA_75346
tgaggattatcaatgagcccactgctgcagctctgtcgtatggaatgaacaacaaggagggcctgattgctgtatttgacttgggtggtggcacatttgatgtatcaatccttgagatttctaatggcgttcttgaggtcaaggcgaccaatggagatactttccttggttggtgaggactttgatgctacattgctcaactacctcgttagtgaatataagaactctgacaacattgatctgagcaaggacaagttggccctgcaaaggctcagggaagctgctgagaaggcgaaggttgagctttcctcgactccacagactgaaattaatctccccttcatcagcagcagatgcctctggtgcgaagcatttcaacattggccttgaccagatcagagtttgagtctcttg

SEQ ID NO: 75347 - DNA, 419 bp, Triticum aestivum
  Clone ID: PAT_TA_75347
agctcatcttcttctccttgaaatctttttgggttcatcagatttggaggatgtcttgcaactgtggatccggttgcagctgcggctcagactgcaagtgcgggaaggtgtaccctagatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtctgagagtatacgtgaataacgagcgtctgatctgatggagtcgagcaagggtgcgtgtgcatgtgcgtgtggtttacttcgctcgctctccgcctatgct

SEQ ID NO: 75348 - DNA, 447 bp, Triticum aestivum
  Clone ID: PAT_TA_75348
aacatcttgcctcatctcagtggtctgctcatgccatgcttgagctaccacaaaaccctacttgttgtccttgatagtgcagtttggccacctctagcatcgaagataaagattggcaagggcacagagctcctgaagaaggtggctgcgacgtgcaagaacaagaccagcgtggtggcagccaggctcctcgtcctcgtgtccctccgccgccggatggccaccgtcggcgccttctcccacaggatccatgcgcttgtggctgccgctgaccgggagaatggtgccagggtggactgcaacaaggctctcatggtgcgcaaggtccggaagacgcctacgctccatggtggtgaggttgttgttaatatctctcatcaactggcactgtttgatcaagggaatgatggtgatggtggctgcactgactggacgctacaccccatc

SEQ ID NO: 75349 - DNA, 373 bp, Triticum aestivum
  Clone ID: PAT_TA_75349
tattctggagcgcctctctgttgactatggaaagaagtccaagcttgggttcacagtgtacccatacaccccaggtctccacctctgttgttgagccatacaacagtgtcctgtccacccactccctccttgagcacactgatgtgtctatccttcttgcaccatgaggccatctatgacatctgccgccgctcccttgacattgagccgcccaacatacaccaacctcaacaggcttgtttctcaggtcatttcatcgctgacagcttccctgaggtttgatggtgctctgaatgttgatgtcaatgaattccagaccaacttggtgccctacccgaggatccacttcatgctttcctcctatgcccccagt

SEQ ID NO: 75350 - DNA, 529 bp, Triticum aestivum
  Clone ID: PAT_TA_75350
agatcggcaaggtgtcttggagggttgtgtcttgtgtggacagtgggtctgggggccatgaccttcacgtttggcatcattcaagtcgtgcggtcagaatccaagacagagtatctcaggtcagcggatgagcagatgcgccgccacactcaagagctccacaagatgttccttgagcatctggagagtacagtccagcgtgtcgtcgagcttgccttggcgaaggaggctcttctccgcaaagccaaggaggaggaggaggaggagtgaaagaagcctccaggcggtggcagcggtgggggtggcgccgatcgcaagtagacggtggcggcagttatcttagtttaggaaattggacagtcatggcagtgattcaagatgcagcccattgtagtggttccccccatctttcgcatgagaaaagttcaactgctcctaatgatggcaagtaccattgtagctgttttctaaaatcttttgcatgagaacaccaaagtcaatgtaaggtgccactgtttggttaatcact

SEQ ID NO: 75351 - DNA, 221 bp, Triticum aestivum
  Clone ID: PAT_TA_75351
ccgcaccgcacccgcacccgcacagcccatcggcgacctcgccggagaagagagaagaaggtagagagataggaggcggcggcggcggcggccggcgtacagctagggcacctcgaacccgcacatacgcgacccaggcggagataggcggaggcgcgcctgccgatacccctaaccgcgaccagtgcgcgcacctacctacatacccgctacaacaagta

SEQ ID NO: 75352 - DNA, 342 bp, Triticum aestivum
  Clone ID: PAT_TA_75352
agttctttcgtgacattttcgagtatgggccgacgacgcaagattatgaatccagagcaaaatgcgtaccgactacggcaagctacatgtacctactccaagactcgcagcaggacgagatccacggcctgctcgagttctcgccatgccgcgacattcgcaccgctgtactcgttcctcgccgagcaccgcgccaccggcctgctggacgagccggacattgagatcgccacggcgtgccatctcatccgaccgcctggacggccggcggcgccgagagccgcgaagacgttcgcatggaggtcagtcgcaaggagcgcgtcaatcgataacctggcgcgc

SEQ ID NO: 75353 - DNA, 417 bp, Triticum aestivum
  Clone ID: PAT_TA_75353
gaaatccgtgaattaaaacaagaatatggctcgttttatgggtttcacggatctcctattgggaactggcattcaattttaagaaacggcctcactaacaaagcttacgctcaagcatttggtcctggtatttatttggcaagagatgctgctacttctgttggttatctgtacagaggtggtatgggcagcggcacttctaattggcctggttcggacataggaactactgatctcaaatgtatggcaatgtgcgagattattgattggtcttccaaagagaaaagtcaacattgtagaggtgaagttcacaaaataggttgtcatcacaataaaagttctccttacattcgtgtggaaaacgaccacttgttgattacaagatttttctttgtgtggaacaaaactaccaatcct

SEQ ID NO: 75354 - DNA, 386 bp, Triticum aestivum
  Clone ID: PAT_TA_75354
cctctctcgtctcgcgtttccgtcccgcgtacctcttccactcgtcacaatggccgatactgtcactcttgttagcaacgacaaggagggcgatgccgtctcgctcaccgtgtcgcgcaaggcgatcgagctctcggtcaccgtcaagaacttgctccaagagatgcccgacgacgacgacgctgtcggccccattcctctgcccaacgtctctggccctgttctccaaaaggtcatcgagtacgtcacacattaccacgagaaccccgaccccgaggccgagaagaagaccgacgccgagaagcgctcggccgagattcccgagtgggacaagaacttctgcgctggcctcaacatggagggtctcttcaacctgattctcgccg

SEQ ID NO: 75355 - DNA, 99 bp, Triticum aestivum
  Clone ID: PAT_TA_75355
ggcggcgcgtcactccaatcaccggttcataaaatggcgaccgtatcggattctctggtctgggagctcgtcaggaagaacaactgcttcctgatcaag

SEQ ID NO: 75356 - DNA, 202 bp, Triticum aestivum
  Clone ID: PAT_TA_75356
aactagtggatccccgggcctgcaggtgaagcagtggcttgttcctctactggaagggaaaattcgttcgggatttgcaatgacagaaccacaagttgcatcttcagatgcaacaaacatagaatgtgcagtatccatgcaggcagatttctatgtgatacatggcaggaaactggctggaccagtggggctatggacccga

SEQ ID NO: 75357 - DNA, 301 bp, Triticum aestivum
  Clone ID: PAT_TA_75357
cacgccgggaatgacggctgtgaggggtgcgctgagtgtttacacctgctcgtcaccgctctgcggttgctgtgccgggggactcaagaattttgaggagctcaagctggtccgaaattctagctctgctgtgtatgggaggtataagatcatggatgaccagacggagatactagatgagtgtggcccggatgtgtttcatcatgaagcagagtggggatgctgtgcttgagtgcgatttgccaacaaattctgggcaagtagacgaacgtatggagctgaatgttgtggagaaggagct

SEQ ID NO: 75358 - DNA, 457 bp, Triticum aestivum
  Clone ID: PAT_TA_75358
gatcgatgccggcggcaaccacctcggaaccgagggcttctcgatctcggtcgacggagcctcgattgccccgtctcgcattcgccagacctacctcggctcggacggatggctgcgttggtacccgctttcggccgacgacaagttccgcctgccgctgtgggagcgccaccaaggtgttgccctgatcgagattgtgctcaacgactacaagttcgaggtgctcgcggtcgaggagggcaaggacaaggagggcgtctggcacaagcagccgtcgcgcttcctggactttatggccggcatgctcaccgagcgccgcccgcacggtctcttcggccagtcggcccacctgcgcgccaaccagcgctcggttgccgactttgccattgagggtcaggatgccgactacgaggtctccggcctgttcggtgacgactttgccttcaacaagttcacc

SEQ ID NO: 75359 - DNA, 622 bp, Triticum aestivum
  unsure (1)..(622): unsure at all n locations
  Clone ID: PAT_TA_75359
ctgcaggatcggacttcggcatcgcgagaatgttcggcggcgaccagacgacggcgtacaccctcaaggtcatcgggacatacggttacatgtccccggaatacgccatggacggcgtgttctccatcaaatccgacatctacagcttcggcgtcatggtgctggagatcgtcaccggcaagaaaatccgaggcttttacgacaccgagctcgatctaaacctctgcggttatgcgtggatgttgtggaaggaaggcaggagcacggagctcctggacgatgcgatgggcggcagctgcgatcacagccaggtgcggaggtgcatacaggttgctctcatgtgcgtcgacgtgcagcctaggaacaggccgatgatgtcgtcggtagtcatgatgctngccggcgagaacgccacgttgccggagccaaatgagcccggcgtaaacctggggaggaacaggacagatacagggttttctgaaactcaaagtgagttcactgtgactacgacagatacagctcacagcanaagttagtggaaatctatgatgctcaccatggtagtttagcttgggatggaatactatgcacagattacaacaaaagcttcttttttttgtct

SEQ ID NO: 75360 - DNA, 639 bp, Triticum aestivum
  Clone ID: PAT_TA_75360
catgtgggctctcatcgcccgccattttcctggccgcactgacaacgccgtcaagaatcactggcacgtcgtcagggcccgccgcagccgtgagcgctgcaggctcctcgccaaggccgcctcgtccaccttcccgtcctactacagcggcggcgcccagctcgacttcgccggcgcgtcggccggctccttctgctttggcttctccaagcctagtggtggcggtttcttcggctcaccgccggctgcggcggcagtggcgccttcttctactccagtactgttcaatggctacggcgcttcaggaaaccagagcttgctgtcaaggtacagtagctacctggacggcggcaagcaaccggcggcgccgtcttctcactccatcgccttctcctccccaccttcaagagaagcactagcgtttgatgggcgtggcggccctaaccatcagcacaggaaggattaccatgtcgacggcaataaaccactgaaaacgaaggatgcgccaccgttcatcgacttcctcggcgtcagcgtgtcctcgtgaaccgtggcaatggaacgatcgatcgcaggaagcagccggctgcagcctccatcaacttgtcgatcgatctgtgttgttagagcattgcatcg

SEQ ID NO: 75361 - DNA, 456 bp, Triticum aestivum
  Clone ID: PAT_TA_75361
gcgggggcagcggcgcgcgcctcaagcacgtcgcggtggggtggctcgtggggatggtcgtcgtgatcgccgcgttcacggccctgtttggcggctggcacgcgtaccgccggtggtacgccgtcggcggcgccggggagtacgagtccggggcgtggccgtggcggctgacggcgttccagcggctggggttcacgtgcgccgacgtgctcgcgtgcgtcaaggaggcgaacgtggtgggcatgggcgccaccggggtcgtgtacaaggcggagctcccgcgcgcccgcaccgtgatcgcggtcaagaagctctggcgcccagcggcgacggacggcgacgcggcccgcaacctcaccgacgacgtgctcaaggaagtgggcctcctcggccggctccggcaccggaacatcgtgcggctgctcgggtacatgcacaacgacgcggacgccatga

SEQ ID NO: 75362 - DNA, 428 bp, Triticum aestivum
  Clone ID: PAT_TA_75362
catatcaccacgaccacgtacgtagtagtgtccataagttgctccccaagatcatcaatggcgaatgcacctggtgcttcgctcggccccgtcccttttgcggacgtcgaagctgattcaggcttggtctccggcgtgccggagcagcttccagaggagcacgccgacgccgaccttgtgtccgccctgccgagcgcgcccattgccatgggcatatcgaacctccgtttctacgagggatgctggctgccggagtggtctgtcccggcggccgtcgccctacagcgccgcttcgagccccgccgggacgatgtcatcgttgccagcttccccaagtgcggcaccacgtgggtcaacgcgctgacgttcgccaccattgcgcggcgcgcctaccccgccgccggcgccgggcacccgctgctacgcct

SEQ ID NO: 75363 - DNA, 99 bp, Triticum aestivum
  Clone ID: PAT_TA_75363
gcatggatgtgctttgcagtgataagactggcacactcacccttaacaacgctcagtgttgacaagaacctggcttgaggtgtattgcgaaaggtgtcg

SEQ ID NO: 75364 - DNA, 395 bp, Triticum aestivum
  Clone ID: PAT_TA_75364
gagcttttgcctggaccgggaatggaagaagccaagaacggtgagaagggcgtcgattggcagatgagtgctgcaggacaatctaatgtggccaccagcacatctatggagaggatcttctgggcgagttatgaagacctccccagtgacctctaatcgtgcttcctctacttggccattctcgcaaaaagtggagtgatggatgtggaagtgattgttcggatgtggattggcgagggcttcatcaagccgcacaagggaaatactatggaggagttgggtcacaagtacctcaaggaactggccctgagatgccttgttggcatagaatcgaggaataacgaggatgacattagggacgtcaaggtccacaagagcctaattgctttcctgca

SEQ ID NO: 75365 - DNA, 525 bp, Triticum aestivum
  Clone ID: PAT_TA_75365
ggcacgaggagtagtctctccgactccgatccttccactgatccttatgggcttctgcgagtacaccattaaggatggcatcttcatcctcacactcggtggcagcgatgattgccataaccacctcacggggccagtccctgatggacctcgaaaaaaaactcaaggacatccggaagcacatcagatcgtcgagcaaaggcctcgtgaccaccagcacgggtgagttgttctgcggcgggccggactacggccagacttccagggcggttgccgacgagcttgcgcgccgcatggctagggtggtgcacgagatcttcaccatgccgttccccacggtggcagcggtcacgggcgatgtccggtcgtccctagccctagcgctcgtgctggcgcacgacgacacggcgaccatggagaaagccaagttcgaggttaaggaagtgcaggacggccgcgtctgcatgccgccatacgttgccgcgctcctccgggacaaggcagcgttcccgcgcatgaggtcgt

SEQ ID NO: 75366 - DNA, 462 bp, Triticum aestivum
  Clone ID: PAT_TA_75366
caagtgaatcttaagttcctccttttctttaaggctatgtcaggactaaagatcaactttgataagagggaggttgtcatcctaggattctcgacaaaagagcaataacggattgtggacaacttaaactttaaactggctatgttccccatcacttacttgcgtatgctaatggccgatacgaagattttgatgagtgcctttgatccgttggtaaggcgactagcgtcttgggccgagccatggcgcggaccactcactggacagctcacttccaatggaagtaaatcggtccttattagctctaaccttgcgagcctctccatgtatatatgtgaaacgacccgacccgaaacctccaagtctctgtgtgtccgtaccatcccaagatcatgctggtccacacggtacatcaatgtatattttaaagttcaatcacacctgctttattacattgaaatc

SEQ ID NO: 75367 - DNA, 401 bp, Triticum aestivum
  Clone ID: PAT_TA_75367
ggcgtgtggttcaaattcttcgtcagaatggaccctttgtggttctccacttgcggtatgagatggacatgcttgccttctccgggtgtacacatagttgcagcaacgaggaggccgaggagctcacaagaatgagattcgctttacccatggtggaaagagaaagtgatcgactccaaggcgaagaggaaagacgggctctgtccattaacaccagaggagattgcgatggtactaaaggcactcgacattgatcgccattatcaaatatatattgctgctagtgaaatatattgtggacaaagaagaatggctgcactgacctcagcttatcccaatgtggtaagaaaggagacgtttttgccttcaggactcaggtttttccagaaccattcttccca

SEQ ID NO: 75368 - DNA, 385 bp, Triticum aestivum
  Clone ID: PAT_TA_75368
tatggacttcaatgctaaattgtatggcttcgggctggtgactgcaactcacccatgacgtaacctcgcactcgacggatgttgtcattggaacacaagcctacatggacccagcataccagcgcacaggcaaggtacactagggaatctgatgtctacagcttcggtgtgctcttgcttgaggttgtatgtggcgtgccaccgatcctaattggcaatgacatgaacagcctcatcaagatggtccgggaatgtgatcgtagaattgcaattctcagtgcagctcaccaacaactgaggggcgagtatgatgaggaaattaaaggagcgttgttgatcgggctccgctatgtcgaatgaatacgaggtgaccgcccgactatct

SEQ ID NO: 75369 - DNA, 283 bp, Triticum aestivum
  Clone ID: PAT_TA_75369
ggctctgctccccatcccattcagatccagccatttctctcctcctgctgcgtgctcgtccgcggagagacaaggcccgaaaggagcgccgtcgtcgcaccgatatagggacgaaaattagatgtcctggctccggccaccatgagcttatctgctgtcattggggccatcggtgccatcaatgagtgtgtcactttctggcagtgggctaaatccgccatttcatccctgcactcccgatggagtggctcacaggaggaggatctccaggatcgtgcattga

SEQ ID NO: 75370 - DNA, 280 bp, Triticum aestivum
  Clone ID: PAT_TA_75370
tgcagtgaatcggcacgaggcgggagacttgcagacgctggagcagcagaaggagatcgagaagaagatcttcaatgcttcacagacttcgacttccagcagcggtgctgacgtcgtcatgcttcgagcaccacctcgggatcttccgcgtctccaacggctgtctctttgccatcactggagccctcgatcagaacgaactcatgcttgagtacgtcttggaggctttcgtgacctctgtgcaggccattcttcgtggacagaccgacaagagaaccat

SEQ ID NO: 75371 - DNA, 503 bp, Triticum aestivum
  Clone ID: PAT_TA_75371
catccccattccgtcgcctccgccgccaaaaccctagcagcctccgccgccatggacgccgccgcagagggagtggaacgaattattaaccaactacccccaattcgtggattatcttgagaatcgagcacccggaagttcctccgggttgaaagaacgaaaccggcttggattggattgtctcccgaatcatctcccttctccccacagcccttcgtccccgcagccgaactcctgactgacgaccatttctccctcacctcctccgactccgaggacgccgccgccgccaccgaccggcacgccatgcaggatggtggcggccaggaccacatcagcgacctcgctggatgacctgctctccaacatcgtctcccgcctccccaccaaggaagccgcgcggacgatggtcctgtctacccgctggcgctgcgtgtgggcggcgactccgctcctcctcgacgacgcccatctcaaggccgggctcggcaatttcaacgccg

SEQ ID NO: 75372 - DNA, 339 bp, Triticum aestivum
  Clone ID: PAT_TA_75372
ctcgccatggatgcatcgtgccgaggataaacatagtcaacgaagaagcgaagctctgatgtagggaagagacacaaaaacggctctcccatttcttggaaacaacggccaaaaaaagaccaagctcgatcggcaagcttacctcgtttccttgtattgacatttgacgagtgcttggcagaggcggagagatgcagtagcggtagcgggttctgattgatggagcacctgcgagagtccaaggaagaagtggagattgtagaggaggaggccgagaaatctcctcatgaggcgcacaagggcgttctctctgatcccaatcctgccaaagtatggacg

SEQ ID NO: 75373 - DNA, 479 bp, Triticum aestivum
  Clone ID: PAT_TA_75373
tagtgctggcgacggacgctactctgcctgcgcaagttcgagcgtccagtgcgccggcgtgcaggtcggctcgttccccgtgggctgcctctccggcaatctcagcgctaactgtgtgccctacgtgtgccccggcggctgctccggtcacggctcctgcagccagctcacgtgcacgttggcgacgcgggctaccagggccccgactgctccgtctacgttaacgacaagtgcgtcacgatcgacggcgaaatcgtgtgctacgccgcacaggccagctgcgacggcggcctccagatcgtggcgtcgggcgacgccgagcacgtctttcagttcgctgccgccgatatcggcaccccccagtgcttcgacgcctttgaagactgcagctattgcgtcacgatgacggagttcgctgcgggcctcttcgacgccgctgccaccacgtccctgtccctcgtttgctctgggttcaccct

SEQ ID NO: 75374 - DNA, 388 bp, Triticum aestivum
  Clone ID: PAT_TA_75374
cttcgactgtgaccactctcaggtcttcgtcatggaaaaggcttgcacaaacctcactgacgtcgtgcgctcggtgcggctgctcaagattaagggctatagcttgaacaggggacatcagcagcgaccattgctttaaatccagatggaatgtcgatgggtatgagtgggaaatccgtatatatccaaggtcccgggagtccaatcatgtcaacggaagatgcgtggctctgcatcttatcttcctcagtgaagcccgcatgggggctgtgagaacgactctgcgctgctgcttggtagatccgagaggaatatttaagccttctagagaagatcgtcggtctctaacattcaggaagccccaggacacctcgtacaccgtgattct

SEQ ID NO: 75375 - DNA, 541 bp, Triticum aestivum
  unsure (1)..(541): unsure at all n locations
  Clone ID: PAT_TA_75375
ccctccagaagattaaccgccatctgaaacttgccatcagtacgcagcactgcaaaagcagggcacttttgtacagatggatgatgatcaagcacgtgaactgagagctctagaacgcatactgangtgatccagtgtggagccaaccatgctatcttatgggatactgaaatacattacaaattctttttctaacgagattggtcgtggtgggtttggagttgtgtaccagggagatttggaaaactgggtagtcgctgtgaagatcttcaagacacataatgcagataggcaattcctagatgagatcaggtgtttaaaaattgcaaatcacaagaatatagtacgatttctgggctattgttcagatatacaagaggaagttacgacatccgatggagtacctgtgctggcagggcattataagaggttgctctgtctcgagtatgttcctaaaggaaatattcgacagtatcttcgacaagagaaacctcatccagaggactggccagcacgctacaaaatgattagaggaatttgt

SEQ ID NO: 75376 - DNA, 406 bp, Triticum aestivum
  Clone ID: PAT_TA_75376
gctctttagaagagtggctgacagagaatcgatatggtaggtttgctaatcttgttgagacagccattgacctcggtcaagtagacaatggcgagtacaggatatctcccctatattcttctgatttggctgtgctgaaggatgagctttctgaagtcgaaaatcacataaacaatttgcacatgcatacagccactgatctggatctttctgttgataagcaattgaagctagaataaggcccatttggacatgtgttcagaatctcaaagaaagatgaacagaaagtcaggaaaaagctcacgaccaattacattatcatagaaactcgtaaagatggtgtgaagtttacaagcgccaagcttaaaaagctaggtgaccaataccagtcactgcttggtgatta

SEQ ID NO: 75377 - DNA, 477 bp, Triticum aestivum
  unsure (1)..(477): unsure at all n locations
  Clone ID: PAT_TA_75377
tgtcgacgcattaccacttctctgcagatgttgggtcggaagcctcaccggttgggctccccgggagggtgttcattggcaagctacctgagtggtcaccggacgttcggctcttcaccacgctatgaataccccagggntaaaatatgctcagggatntggacgtccatgggacaatggggctgccggtgttcgagaaggggagttactcgtgcttgggtgtcatggaattgatcatgaccaggcaaaagctcaacttcacctcagagatcaacgacatctgcagggctctccaggcagttaacctgagaagcacagaagtttcaagcactccgcgcgccacaaagttcaacagtgcttcctacaaagatgctctaccagagatactagaagtcctaagggcagcctgcgtcacccacaatctcccattagctcagacctgggtcacatgtgctcaacaagggaaagggggaagcc

SEQ ID NO: 75378 - DNA, 520 bp, Triticum aestivum
  Clone ID: PAT_TA_75378
caagaaaaaagccggctttgacatcatggatcttgataccattcaggtagcaaagcgatgttttgttcctgctttgtttggacatgcaaccgaggatgattttatactcccggattcattcagacaaaatttgtgaagcatatgttggagacaaaaacattataaaagtttgatggggaccacaattcaccccgaccacaattttactttgactcgatcacaatattttttcataatgtgctgaacccacctgatgtccctgacgatcattatttcctgacaccacatggcagccttggtcagggtcactgggatacagaacatgatatagagtatagaattgctcaatcaccaacagccccttcaactacgacagaagatgccattgcacagttgcgttctagaaggctcatgagcagaatggaggtcccatctggaaccgccacagaaggcagggccgactgaactgaggtattggatagtggccccttctcatctagtgcatctactgcgactcctc

SEQ ID NO: 75379 - DNA, 268 bp, Triticum aestivum
  Clone ID: PAT_TA_75379
cccgttcttgctctgccggacttctcacgccccttctgcatcgagaccgacgcgtgcgacaccggcgtgggagccgtgctggtccatgatgcccatcccgtggcctatctcagcaaggctttgggggtgcgcaatcagcgcctctccatctatgataaggagtttctcgcggtcatcatggccgtcgagaagtggcgacattacctccaacgcgctccatatgtcatcatcaccgaccacaagagtctatgtagcctcggcgaccaac

SEQ ID NO: 75380 - DNA, 473 bp, Triticum aestivum
  unsure (1)..(473): unsure at all n locations
  Clone ID: PAT_TA_75380
atttgaaaggttcatccttaggcagatctactgacaaagttaaaatcgacgagaacacgacgctgaaagacttggatctcaactattcattttattctccgagccttcttggcgggatgctttgcttaagcagatcgagatcgacagcgagtttctgaagaatccagggcataatggactacagcctgcttcttggtttccattaccgggctcgtcaaagccttgtaagaggagggtcattgcctgaaagcattttgcaagagaataaactagccgttctttcggaacaagatgccatggaggatggttccgcctatnactaccgggaagggctggttttggtgcagcgaggcagcaaccaagatggtaaagtcgctgtcgggcctcacataagagggagccgcctgcgatcgtcgtccgcttgttacgaggaagtggatctcctgcttccaggcacagcaagacttcagatc

SEQ ID NO: 75381 - DNA, 232 bp, Triticum aestivum
  Clone ID: PAT_TA_75381
ccgaccccaacacacacgcactcactcgccaccgaggacactcgcagcgcggtcaccatggccggcggctacggcggcgccggtggcaacctcaagaacatggtcatcggccttcctcgtcccgctcccgtccatcctcttctacctcaccttcgtccgctcccaagacggccacagcgccggcccggtgtcctcgtggtgcgccgcgcacccgctcctcctcgccaagcgc

SEQ ID NO: 75382 - DNA, 450 bp, Triticum aestivum
  Clone ID: PAT_TA_75382
tgcaggattcggcacgaggttccattaccatacgtttcttcctcgagtcaagtggctcttgattgatcccaccaccagccgcaccaccaacgtcttctgtccgtagctccttggtgcctagctgctgtgttcacatcacatctccatcgatcaagacgaagcatgcttccaaggccaaggcggcgccgtcgcctggcaaggaggaggaagcagttgcaccgggtggtttccgcaaggggccatggacggagcacgaggacatgaagctggcgtggtctcgtgcggctcttcggcgagcgccgcctgggatttcttagcgtaggtgtcaggtttgcccggtggcgggtgacccatgccgtgccatgcatgcgccatgcatgcatgcatgtctgggaccaaagtatgatgtagccctggtcctttgtgtgctaacgctctcggtctccgccg

SEQ ID NO: 75383 - DNA, 396 bp, Triticum aestivum
  Clone ID: PAT_TA_75383
cacacacatcatctcctccgcctctcaaccaagccaagagctcagtgaagcaccaccggccatggagggcaaggaggaggacgtgcgcctgggcgcgaaccgctactcggagcgccagcccatcggcacggcggcgcagggcggcggcgcggacgagaaggactacaagtgagcccgcccccggccccgctcttcgaggcggaggagctcacctcctggtccttctaccgggccgggatcgccgagttcctggccaccttcctcttcctctacatctcggtgctcaccgtgatgggcgtggtgggcaacccttcggggtccaagtgcggcacggtcggcatccagggcatcgcctggagcttcggcggcatgatcttcgtgctcgtctactgcacc

SEQ ID NO: 75384 - DNA, 502 bp, Triticum aestivum
  Clone ID: PAT_TA_75384
cgagctcgcgcgcaccggcggcgggcttgccagcgtgccgccgtacggcgagaccttcttcggccaccccaccggccgtgcgtccgacggccgggtcgtcctcgacttcatagttgaggcgctggggatgccatcgccgaagccgtatttcgccggcaagaccgcggcggacttccggcggggcgtcaacttttcgcgtacggtgggtcgacggcgcttggcccggagttcttcctgagcagagggcttaggtcgttcgtgcccgtctcgctcgcaaaccagaccgcctggttcaagaatgttgtacagctagccggctcagaacaagagcagaggaagctgacggcgacgatgctcgtcatgatgggagaaatgggaatcaacgactacctcgtcgccatcaccggaaagctcagcgacggtgagatccggaccttcgtgccgcacatcgtccgcgccatccgtgatgtcgtgaccgatgtgatcggtgcgggagcaaaaa

SEQ ID NO: 75385 - DNA, 521 bp, Triticum aestivum
  Clone ID: PAT_TA_75385
gcgtcgtggtcgtagtcctcctcgtcgcagtgaacgtcgtagctacagggatattatttgcaagaactgcaggagacctggccacattgctagggattgcccatctgcttctaccctgcaataattgtaatcttccagggcactttgcagcagaatgcacttccaaaacagtttggctggaactgcaagaagtctgggcacattgccactgaatgcaagaacgaggccttgtgccacacttgcagcaagacggggcatatggcgcgtgactgtcccgcctcagggtcgaacgccaagctatgcaacaactgctttaagccgggacacatcgcggtcgactgcaccaacgaccgcgcctgcaacaactgccgccagccaggccacatcgcccgcgagtgcaagaatgaccccgtctgcaacctctgcaacgtgtcgggccacctggcccgtgcctgcccgaagacgacgaccctggcctcggagatccacgggggccccttccgcgacatctcgtgccgcat

SEQ ID NO: 75386 - DNA, 565 bp, Triticum aestivum
  unsure (1)..(565): unsure at all n locations
  Clone ID: PAT_TA_75386
cgcgggcatggagcagctcatcccggtcatcaacaagctgcaggatgtgttcaatgccatcggctcggaccccatcgacctgccgcagatagtggtggtcggctcgcaaagctcgggcaagagctccgtgctggagaacatcgtcggccgcgacttccttccgcngcggctcgggcattgtcacgcgtcgcccgctggtgttgcagctcattaacctgccctgggagggcggagcgccgcccgccgcgggagatgaggcgaagaacggtaagaaggacctatccgagtggggcgagttcctccacaagcccaacgagatgttctacgactttgcgcaaatccgcgaggagattgtgcgcgagacggaccgactcaccggaaagaacaagggcgtgtcgaacgtggccatccacttgaagatttactccccgcacgtcctgaacctcactctggtcgacttgcccggtatcaccaaggtgcccgtgggcgaccagccttctgacattgagtcccaaatccggagaatggctctcatgtacatcgagaagcccaacgcgatcatcct

SEQ ID NO: 75387 - DNA, 389 bp, Triticum aestivum
  Clone ID: PAT_TA_75387
gcgaggcgcgcgtacctccggagcgcgagatgcacctcggcgcgggcctgtggctccttctctcgctgtgcgcactgtgcagcgcagagggctcctggagcgtggtgacgcactcgcagatcaacgtgaaagacatcgcgttcccttcagtgattgctgttggggactttctatgcggtgctggcgacttcaagggacacctgttcctcgagtccgactcagagggagtgtattcaattgacagtaccaacaagatttcgcgtaccggcgtgctggcttgttggagcagagtcgatggaagcctgcgctttgcgaagtccctccctcagtttaaggaaatcaacgtattgcgcaattgctccactgatcagctcatcctgttgggtaag

SEQ ID NO: 75388 - DNA, 424 bp, Triticum aestivum
  Clone ID: PAT_TA_75388
gaaccaccaccttcctcatttgcgctttggcgctcaccgcagtattggctgcccccacccaccgcgtacatgacccaggagcaactggtccaggccgctactcagaacgccatcgccgaacttgacagactcagagagaagctcgagagagccgtcaaggagggcgccgatatcgaagtccagattggcttcaagagacaggtcaagcaacagaaggctgaagtcaaggacagaaaggtcagaatccaagacaaggtcaagctgtcccactgccagaagacgatcaagaagatcgagtccaagatccagaagcgaaaggctgccgacaagccaaacaatgccaagctcgctggactcaacaagagaagagagtggtggatcgtcagacaggagcagatcagacttgctgaggagaagagacttc

SEQ ID NO: 75389 - DNA, 531 bp, Triticum aestivum
  Clone ID: PAT_TA_75389
acgcggaagacgaaggcgaaggccggcggcgccgaggcctcgtcccccgccctctccatcggcaactgcaaggtggagatccacgggagcggcctaaggtgcgtgtccacggagcagaatctcaccatttcgggaaccaggggcgcgaagatcttgatcactgtcgatggagccaggagttcttcggatgggactggtgagggttctgatttcatccttctgaaccccaatgaggcggatagcctaaataaatctttgctccaggaagttctgaggctttataagaaggaacttgcagctatggactatgctgctgacgctgggagaaaatcaggatttcttgagaaatgcataatgaatgggaagtacaagacactaattctgaggcctagttcacttgatgggcctgaagaggccatccactctccctctgcggtcgcaaagaagggcgcttcttcggtgactatgcttgcggcttggtggatctggaagcagcacaatccggtcgccttctattatcatagctgctgt

SEQ ID NO: 75390 - DNA, 365 bp, Triticum aestivum
  Clone ID: PAT_TA_75390
tcggcacgagggcacctgtcgatgccgccgccgctccaagcctccgggcacacggcgacgcccccggcgcctcaaagagcagcagccgggtacaacgcagccggctcgccgtggacgaacgcgaggaataacggcggcgctgacttgggccgcatggggctgagcgccggcgacatgatgtcggacgccgcggcgtacaacgccgggtacagggccgggatggcccgcgagtggagcggggtccgcggggccgccgtgtactagctactagccagcatgcacatccatcgagttgatcacttattaattattataagctgaataataaagttgatttgatttactcctaaaaaaaaaaaaaaaaa

SEQ ID NO: 75391 - DNA, 436 bp, Triticum aestivum
  Clone ID: PAT_TA_75391
cggagttggtgttggatgggagctcactcacttgtgatcagttggtggaactgggcgtgaaccataacatccgcctttccctctccgctttggcatgggagcgtgtggccgccgggcgtcatgtggttgatgaggtcatacgcaatgaggagactgtgtatgggcatcaacacagggttcggtctctttgcgactgtgcgcattccgacggagaaagtctgcgaacttcaaaggaatttaattcgctcgcactctgccggcacaggcgcgccgctctcactggcacgcacacgccgcctgctcgcactgcgcatcaacacactggcaaagggtttctctggtattcgcacagtcacactgcagcagctcctagatgcgttcaatgcgtgctgtctgtcttatgtgccagagaaaggcacagtgggtgcgtctggtg

SEQ ID NO: 75392 - DNA, 401 bp, Triticum aestivum
  Clone ID: PAT_TA_75392
caaaactctttatactcttcattgttgtactttatttggcgattagtgtttcaggtgacactataccctcatctacaaagaagaaagataaaaagaagaagacagatgattgggtagtccaaatcaaaggaaacaatgttgatgttgatagaatcgcattcgagcatggataccagaatttggggaaggtggcaaatttgacagacttttatttgttcgagaagttgaagacaaaggatatttcccctcctttggatgataacgatctcatctcttttcatgagagacaaatcaatgagaatgagatacaagagagaattgaccgtcaccgatccattgtggccaaaacaatggcacttgagatcaggaaagatctccttcaacacattttctctggggaa

SEQ ID NO: 75393 - DNA, 524 bp, Triticum aestivum
  Clone ID: PAT_TA_75393
ctcgagttgctactcgggacatcacaattggtattagaggctcgttcgatctgtgcgagcaagggcccagacgagccacatcgtctgtatcatggaggagttgcaaaagtcactgcaagatatgttggagcgagttctatcggagaaatttgataagttcttccccaaattgaagacgtgcgccggcgccggcaccagtcttcgcgcgcgagacggccattgccgcaaggacctggacgccgtgaagcaagagcaggtgccgtcgcccacgccgcacgcacacgctccgcctccggcgaacagggcggcgaggttcgcgtatggggccctcctgctccatgggactcggcgggggctacggttgccgccacggttgtacaaggtctggtcgtccctgctccacaggcggatgtcctcggctcgcccaccagctgttcgacggggcgtttcacccaagtcgaggcagcgacccagcacgtcggcgcggactccgtgaaggagcggtggttcgagccggggctcct

SEQ ID NO: 75394 - DNA, 399 bp, Triticum aestivum
  unsure (1)..(399): unsure at all n locations
  Clone ID: PAT_TA_75394
gcgaatcttccaacgctgaggtcatgtggcagactctaatgcagcttgcccactggactcttcagttcccaaaattttcgacagacgcgtttgacagcattatattcgtcgtcaaccccgtcccgttttcagcaaaaagcttcgatcaagaatccgcagctcnnncctaatcccctccatcggcgatcaactacgcccgaaatttctcttttgtcacgccatccaattttgcgctcatcttgcaagccatcatagcgtttggccgcttgccgtcttgtcctgtcgaggtggcactggaatctctggaaatgctacagcttctcatctcaactttgccagcgctcctctcccttccagtgtcttcgccggccacactttccatgtccggatctatcccgc

SEQ ID NO: 75395 - DNA, 504 bp, Triticum aestivum
  Clone ID: PAT_TA_75395
tgcaggaattcggcacgaggcactcgccgcaaagcaacaccaagcaaagccacaatgcagattttcgtcaagaccctcaccggaaagaccatcaccctcgaagtcgaaggatccgactccattcagcaggtcaagcagaagatccaggacaaggagggtatcccccctgatcagcagcgtctcatcttcgctggaaagcagctcgaggacggtcgcacccttgctgattacaacatccagaaggagtccacccttcacctcgtcctccgtctccgtggaggtatgcagatcttcgtccagaccctcaccggagagaccatcacctcttgaggtcgagggctctgacctgcatccagcaggtcaagcagaagatccaggacaaggagggtattccccctgatcagcagcgtctcatcttcgctggaaagcagctcgaggacggtcgcactcttgccgactacaacatccagaaggagtccacccttcacctcgtcctccgtctcc

SEQ ID NO: 75396 - DNA, 529 bp, Triticum aestivum
  Clone ID: PAT_TA_75396
gcaacacgtatatactagtagtagcaaaaagaacacggacaggaacatcgatcggtcggccatggccgagtcggagcacagcatccacgtgctcctcgccgcgtacccagcccaaggccacatcaacccgctcctccagctggccaagcggctcgccggccagcccggcgtccgctgcaccctcgccgtcacccgctccagcctcggcccctccggcggagcatctcttgatgccggcgctgtccacgtcgccgccttctcggacgggtgcgaccagcggggctacgacgaggtgggcgacgtgaggctctacctagcgcggctcgactccgcgggctcgtcctcgctggacggcctcctccgctccgaggcggagcagggccggccggtgcacgcgctcgtgtacgacgcgttcctgctcttcgcgccgcgcgtggcacgccggcacggcgcctagtgcgcggcctacttcacgcaggcgtgcgcggtgaacctggtgtacgcccacgcgtgggctggcctgctgggc

SEQ ID NO: 75397 - DNA, 404 bp, Triticum aestivum
  Clone ID: PAT_TA_75397
cgagcgcttcttcatcttaagcttgccggcaggcaatcggcgacacatgaagaagcaagaggaggaggaagaggggaagctcacatcctgacggcgatggcggcgcggctctcggatccatgccaggacatgtgccataaccacaagcactatgactggtgcgtccgtcgctgccggtttgggccgcatcttaggcttgccggtggcggtggggaatcagaagaagcaagcggagcaccgagttgatgtactgacggcgacggcagcgggggcggcggctgacccacgtatatgcgaggatttctgccgtaactggccggcgccggaacacgattggtgcctcgacttctgcctggctggagactatgtacaacgagcgcctctgcatcttaagcttgccggcg

SEQ ID NO: 75398 - DNA, 308 bp, Triticum aestivum
  Clone ID: PAT_TA_75398
tgcaggaattcggcacgaggcaccgtttccgcctccgccggcgccggcgacgatgcctcgcaaggcctcgtcctcctcagatgcgaagctcaagtggcggaagcggaagcgctcacaggacacctccccatcgaagcagtccggcggggccgaccactccgacgactccgactccgcagcggcgaacgacgaagacgacgcgctccacggctccgccaacgggggcgaaaccctaggcgcccgtggcggtgatgacgacgccgtgcccgacctccgggaggcggaggtgctctcctcagcggagcccg

SEQ ID NO: 75399 - DNA, 136 bp, Triticum aestivum
  Clone ID: PAT_TA_75399
gcaggttgtagagatgtcaaggcgtgctgatattagaaagcaggttccgtgttggcagcaacttcaatctaggaagatgctaggtctaatctagaagccagttttgccaacgaagcagaaattgtgtttacaaccg

SEQ ID NO: 75400 - DNA, 426 bp, Triticum aestivum
  Clone ID: PAT_TA_75400
cggcacgagggtggcaagggagccacgccgatgcggcgatcacaggcaacaagaacgaaggcatcgagaaggccaaatctctgattctgctgctcgccactctcgccgccaccatcacttaccaagcgggcatggacccgcccggcggcgtgtggtcggacggcgacccggaggctgtgccaccaggcttcaaggccggcgacccgatcctccagttcaagcacgctgctcggtacaaggccttcttctactgcaactccaccgcgttcgtggcgtccttggtcgtcatcctcatggtccagaacgagagcctgatgagcgggcacgcgctggacgtggccatgatactggacctgtttggcctcatcggcgcctacgccgcctggagctgccgggaggtgagcacctccatctacgtcgtggcct

SEQ ID NO: 75401 - DNA, 418 bp, Triticum aestivum
  Clone ID: PAT_TA_75401
acggcttccaggtcaccttcgtcaacaccgaggtggaccacgcgctcgtgctcgccgccatggcgccgggcggcggcgccgcgctgcgcggcatccacctcgcctccatcccggacgggctggccggcgacgaggaccgcaaggacctcaacaagctcatcgacgcctactcgcgccacatgccggggtacctggagaggctcgtcggggagattgaggcggcgggaaggcccaggttgaagtggctcgtcggccacgtcaacatgggctggtccttcgaggtcgctaagaggctcggcatccgggtcgcctccttctggccggcctccgcggcgtgcctcgccatcatgctcaagatcccccagctcatagaggacggcgtgctcgacgaatagggatggccggagcggcaggagac

SEQ ID NO: 75402 - DNA, 521 bp, Triticum aestivum
  Clone ID: PAT_TA_75402
caggaattcggcacgaggtgcttgttgcccaggtccacattggtcacccagaacatcgttccccagataaccgctacatctggaagcgccgcgccgactgtgtccacctcatcaacctcggcaagacctgcgagaagctcgtcttcgctgcccgcgtcattgccgccattgagaaccccgctgacgttgtcgtgtgctcggcccgcccctacggccagcgcgccaccctcaagttcgctcactacaccggcgccaccgcccttgctggccgctacacccctggtaccttcaccaatcagatccaggagaagttcgttgagccccgtctcctgatcatcaccgatccccgcaccgactcgggccccctcaaggattcgtcttacgtgaacatccccaccatcgcgttctgctatacctactccccggctcgctttgtcgattttgccatccccgcccactacaaggcccagaactcgatcggcctgctcttctggctccttgcccgcgaggttctctacctc

SEQ ID NO: 75403 - DNA, 579 bp, Triticum aestivum
  Clone ID: PAT_TA_75403
ctgcaggattcggcacgaggctttcaaaaaataaatacaaatggcaagcaagaaatgcgcatcatgcactaaaactgtctatcctgttgagcaagtcagcgctgcaggagtcttcttccacaagaactgcttcagatgccaacatcaaggatgcggtaccccacttaacttgaagaacttcaaggctcatcaaaacaaggtctactgcgcagtccattatcctgaagatcatcaaaaaattagagcaacccaagttactgactccgttcacgtcaagcacgcaaccagtgcaccaagaaaagtttctgagggtctctctaatgttcacaagggagatgaacgtttccgtaaggagggaggtgacttcaaggtcgaatactgacaagataccgcatacacttcaactggaaatgaaagcgagggaaccacccacgttgagtgaggatctgagggagagggagaataccaacaaggaggatcacagggagaatatgcagagggagaatacgcagaacgagagtatgcagagtgagaatatgcagaacgagaaggagagtactaaacatcctgattcatctt

SEQ ID NO: 75404 - DNA, 558 bp, Triticum aestivum
  Clone ID: PAT_TA_75404
caactttacctagcacagcccaggaggagctagcggtagccgagctagctaagctacggtgcgcgcacgcgctcgacctcgccatgctggagaatcagagccaggcggaggttctgtggccgaggctggtggccaacaagctcttcaggaagccctccgggagccacgccttcgtcgccgacttccccgcggccgccggcgccgcggaggaggagttcgacgcgtgcggcagccccgacgccgacgcgcagcgctgcgtgaagcgcccgcggccgcagcagcggaacaagacgctcaagtacaggctgttcgccagcacgtggaacgtcggcggcgtggcgccaccggacgacctcgacctgtccgactggctcgacaccaggaacggcacctacgacgtctacgtcctcggatttcaggaggtggtgccgctaagagcgcggaacgtgctgggcgcggacaagaaccgcatcggcatgcggtggaacgagctcgtgcgggccgcgctgaaccggtcgtcgccgtcgccgtcgcctggcgccaccgggggaggggaga

SEQ ID NO: 75405 - DNA, 462 bp, Triticum aestivum
  Clone ID: PAT_TA_75405
caaaacatcatcaaaatcatcaaaaaacatcatcgaatcaatcaaatcaaaccgacttgatcgattctttgagaaaaacactgaaaggtcataaaaactggaatcttgaaagagagaaggaaagagaacaagtcaattctgcaatctcaaaatcacatcatcatcatcaaaaaaccaaaaaactgtgaatgagtgtgattgtgagtgagagagagaggaagagaggatttctttttgcttttggctttattgatcaaagaatggagggtgaaaattgagagaaaaagagaaaggagggctttttgggcttggcattctctggatcatcaaaatcattcattcattcatccaaaagggatttcagttttattgtattccttttttgttttcatttgagagagagcgggaagaggaaaggacagggggaaagcaaaaagggagaagaaggacagatgggggaaa

SEQ ID NO: 75406 - DNA, 443 bp, Triticum aestivum
  Clone ID: PAT_TA_75406
tggcaatagaagtcatcagtggagcaggatacacaaatgtggtggattggtggagtgtaggttgtatctcttatgaaatgattgttggaattcctcctttctgtggagacactccagaggatgtctttatgaacatcatgaactatgaagagtcccttcagtttccagacaacaaaccagaggacgaagaggaaccagcaatcaacattagtgaacttgctaaggagttcatttgttctctcgtcactgctcctgagagaagacttggtaaaaatggcacagatgagatcaggcaacacgcttggctgagcatcatcgactggaacaacttcaccagccaaatgaagcctcctttcgtgcccaatttggagtccaaaaacgacacttcttatttccctcagtcccaagatgtcaacaacaacgagatccatcaacagaacaac

SEQ ID NO: 75407 - DNA, 406 bp, Triticum aestivum
  Clone ID: PAT_TA_75407
tctctccatcccaatcccgacctaccgcccgctcccgttaagccatggcacgccacggtcaccggcgccaaggggaagaagggcgccgccgggcgcaaagccggcgggcccaggaagaagtcggtgacccggtccgtgaaggccgggctccagttccccgtcgtcgcatcgggcggtacctcaagaagggccgctacgcccagtcgcgtcggcaccgggcgcccccgtctacctcgccgccgtcctcgagtacctcgccggcgagctgctggagctcgccggcaacgccgcctaggacaactagaagagccgcatcatcccgcgccacctgctgctcgccgtccggaacgacgaggagctcggcaagctgcttgccggtgtcaccatcgcgcacggcggcatcttc

SEQ ID NO: 75408 - DNA, 126 bp, Triticum aestivum
  Clone ID: PAT_TA_75408
ctacctcgtgccgccatcacccacacaaacacacggccgaagcaacccaagcgagtcctcgtgttcccgtgcacacacgcctaagctcgaaccatgtcgtcgcagcggatggggcgtcaccagcgc

SEQ ID NO: 75409 - DNA, 248 bp, Triticum aestivum
  Clone ID: PAT_TA_75409
ggggctgatcgaggactttgtcgatgagtttgccccgctgcgccgtcgccgcctgccctcgctgcccaacatgcccggcggcagcgacgccgtgcgcctgctccactcggcctttccgcccatgatggtgacgccgccgcagcacgccgacctgcgtcgcaacgtgcaggcccatcgccacgccgctcatccccgccagcatgaatacacgcacctcttgtccgatcaaaaaaaaaaaaaaaaaacaa

SEQ ID NO: 75410 - DNA, 225 bp, Triticum aestivum
  Clone ID: PAT_TA_75410
cggtgcctgccggcgacaagaaggacaagaagttcgagccccccgccgcaccgtcgcgcgtggggcgcaagcagcggaaacagaagggccccgaaggcggcggcgcggctgccccccgtggcgccgctctccaagtgccgcctccgccttctcaagctggaccgtgtcaaggactaccttctcatggaggaggagttcgtcgcgagccaggagcggctgagcccc

SEQ ID NO: 75411 - DNA, 105 bp, Triticum aestivum
  Clone ID: PAT_TA_75411
cgaaagttcttggtaattctcagtatatcctcctgccatttcaaccatataagctgatatatgcatacatgcttgcggaggtagggaaggtctctgattcactaa

SEQ ID NO: 75412 - DNA, 427 bp, Triticum aestivum
  Clone ID: PAT_TA_75412
atggcaacatcacaagtgacgcaggcgaaacaacacgcggttgttgtcctgccagtcgccgacgccactgagggaggacttgtggattctgctgggcggcgccaggaatcgcagaacactaggctggaaatcgacattggcgagaacaggacaatggtcattgagatcacccttacagggaaactagctctgcagtgccctgcgggtaccacgcccccggcggcgtgacgcagcagcagaacaggcagttcacaaccaggagtacatggaccagatacgcggatggctgatgactgtgggcaccctgtacatcgcgcatgtcgtttcatgcgtgcgttgcagccgccaagctggatgcccaaggattggtacatggtgctcaggaagaataattctatccgtattccctggtcccatctttctcctg

SEQ ID NO: 75413 - DNA, 591 bp, Triticum aestivum
  unsure (1)..(591): unsure at all n locations
  Clone ID: PAT_TA_75413
ctccagtgggccgccgcaccgcacaactcccttcctctgtagctttttaaaccagtttcctttttcctccgcatattttcttccttcccctgccgctatcggcgatcccgtccggccgctgcagtcgtggcggaggcgcgcgtcggggccctcgggatgttcaacctgcccaaggatggacgcgccgcgcggcgccgcgctcgggaagcggaaggagcgggagtactcgtcttcgtcggagcagcggcagccgctgttcccgccgccgccgccgcccgggagacaggagctgctgcgcaacaagccgcaccaactgtcgcggttcgccaacaagtcccccatgccgacgccgcctccccagggcgggagcagcaagctgctcgccgggtacctngcgcacgagttcctcaagttcggcacgctcctcggggaagcgcccccccgcgccgggccggaaggagaccgccacgcccccgcccgcaccaacacccgaccccgcgaggaggtacgccgaggcgtcgatgctgctcatggcgggcggcacccgcatccccgggttttcaacccgacgcagctcggctgctggctccg

SEQ ID NO: 75414 - DNA, 554 bp, Triticum aestivum
  Clone ID: PAT_TA_75414
gcaggctcctctcctccgataatacaataccatggaccccgccgtgatggcttcgtcgagctaccaccgtcgcacccttccaggggctcaagtccacagcccggtctgcccgtcagccgccgctccagcggcagcctcggccgcgtcagcaatggcggaaggatcaggtgcatgcaggtgtggccgattgagggtatcaggaagttcgagaccctgtcttacttgccacccctctccacagaggccctcctaaagcaggtagactacctgatccgctccaagtgggtgccctgcctcgagttcagtaaggttggattcgtcttccgtgagcacaacagctctcccgggtactacaacggtcgatactggacaatgtggaagctgcctatgttcgggtgcaccgacgcctacgcaggtgctcaacgaggtggaggaggtcaagaaggagtaccctgatgcctatgtccgtgtcatcggcttcgacaacctgcgccaggtgcagtgcgtcagcttcatcgccttcaggccaccaggttgcgaggagtccggcaagg

SEQ ID NO: 75415 - DNA, 523 bp, Triticum aestivum
  Clone ID: PAT_TA_75415
gcggctcgaacgtctcgtctggcctcttctccacccaagaggaagcctcccagatgatgatggacaacctcgacctcgccaaccccgtggcttgttcctgaaggcccaggccttctcgacctcgtcctcttcgtcttcctcttcggccttgccccacgtctcgctgtacctacttcttccagggagaaaacagcaacggcgaggtcggagaggaagaggacggtcctttcccgccaccaccccccgtgggcttcgactccgactctttctttcttgccactccattcccctgaagggccagaaactcgcaacacgcgtgactcgtcttccatccttttcccaagacgagttgcaagcgtgagtgaaacttctgatcctctcttttgtacttctctttcttctttcctctcttcattctttttctttttctcttttccaatcacacaaacaaaaaccacctttgttcccttctcctctttcccctctgttgttctctgtaaaccctttatcatcttcctccttc

SEQ ID NO: 75416 - DNA, 534 bp, Triticum aestivum
  Clone ID: PAT_TA_75416
gctgcaggctcaacgcccacgtggcaagctcgctggtgctcatgtatgcagccaggtgcgacggcgtgactgcgcgtgcgctactggatgtgcagctcgccagaggtggcggcacgcccgttgtgtggaatgcgctcatgtccggtcacaagagaagcaggcagttcaggctgtcatgctgctctttccaggatatggtgagggctggcattgtgcccacgccggtcacctacatcacggtgctgtcagcatgtggcaaaggcaacgacgtcctgctcggaatgcagctgcacaagcgcatcattgagagcggggtgttgcctgacctcaaggtggagaatgcgctcgttgatatgtatgccgagtgtggcgagatggaagctgcttgggatttgtttgagggcatgcaggtgaggaatattgtgtcctggacgtcggtaatctctgggtttgtaagactaggtcaagttgatcgagccaaagtactgtttgatcgtatgcctgagagggacaccgtctcatggactgcaatga

SEQ ID NO: 75417 - DNA, 490 bp, Triticum aestivum
  unsure (1)..(490): unsure at all n locations
  Clone ID: PAT_TA_75417
ccgtgccaggctgtcgtacaagatggagttctcggtcggggatgcggccgacgggtgcatgggctccctggccgtcgatgcctacngcgggaagcgggagggtgacggtcccgtatgaatccaagggcacgggcgggttcacgcgcggcgtgctcgagttcacggcgacggaggaccggacgcgggtggtgttcgtcagcgcgagctacaacatgaagtccgacggcacggtctgcgggcctgtcgtcgacgacgcctcgctcgtctgcgcgcagagccatgctcgccggctgcttctgtgattgtgctgtgccgcagtgtatgatggtgaggtagtttgtgacgcgaatattttggcctccttccgtcatggagtaactacagaggggtctaaaactccgagtgctcggcagttgtaaaccagggttctgtaatgtatcatggatnatttacattagggaatactatcattttaagtattctttacacg

SEQ ID NO: 75418 - DNA, 544 bp, Triticum aestivum
  Clone ID: PAT_TA_75418
ccgaaacacaaaatagatcgaaaatgttgatccccaagaaggaccgtaatgctatcttgacctatctcttcaaggagggtgtttgcgttgcacgcaaggaccccttttgggcgttcatgccgagatcaacgtccccaacttgtatgttatgaagttgatgcagtccttgacctccaagggtctcgtcactgccaccttcaactggagccaccactactggttcttgaccaacactggtatcgagcacctccgtgagtatcttggtctccctgaggagattgtccccgctactcttaagcgcaagctccaggcccgtcgtgagggcggtgaggatcgtcctcgtggcccacgttttggtggcaaggacgccgctcctggtgagggtgagttcaagcctaccttcgagggtcgcggacgtggccgtggtggtgcccgtggcggacgtggacgcggtggatactaccgtggtgagcagcgtgagcagactcagactcctgcccagtaaatcgaagcttcttccctcctcattctttccaagaaaagt

SEQ ID NO: 75419 - DNA, 534 bp, Triticum aestivum
  Clone ID: PAT_TA_75419
ggatcccccgggctgcaggcgtcacgccttgcgtgccatcgacggcgccctctcgtgctgccgtaggcgccgctgcatccacaagcgccatccgcgtctcgctcgcctcctttctcagtgcacccacgccctcctctataccgctccggacgctgccgctgatggatgccctcgtacacgctgcagatcgtctcgtgcgagcgtgcgcgggcggtcagagtatgatcggcgaggtgcggtctgcactggccgacacgcgcgaaaccgtcgacaaactccgcgatcaactcggtccctccctcgacgtactcgtcgcttgccagttgtgccgcgcgcgtgtgccgatctcgcggtgctccaccatccgctgccttaagatcggcgaggacgagtatcagtactgccgcctgcctctgcaccagccgaccaatgtaccggtgccctgcgcggtgttttggttctgtgatgcgtgctttgactcgttctggaccaacattgacacgctcgggccgcgtcttttcaagggcttcatcc

SEQ ID NO: 75420 - DNA, 608 bp, Triticum aestivum
  Clone ID: PAT_TA_75420
ggcccccgccgtgatggctcgtcggctaccaccgtcgcacccttccaggggctcaagtccacggccggtctgcccgtcagccgccgctccagcggcagcctcggcagcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtctttcgtgagcacaacagctcccccgggtactacgacggccgatactggacaatgtggaagctgcctatgttcgggtgcaccgacgccacgcaggtgctcaacgaggtggaggaggtcaagaaggagtaccctgacgcctatgtccgcgtcatcggcttcgacaacctgcgccaggtgcagtgcgtcagcttcatcgcattcaggccaccgggttgcgaggagtctggcaaggcctaaactacgagttgaagcagtggcctatgtatgattgtcttttgtgaacttcacttttgtccaggactctgctttccgaccagagcata

SEQ ID NO: 75421 - DNA, 574 bp, Triticum aestivum
  Clone ID: PAT_TA_75421
cacacggcgggggcaaacgctgcacgtggggccacccaggtccgaccttggagctggcggcccaccctgtgaccgccttgcaagaggcaagaaaggcatgtgcgtccatcacaacccgctcctggacgatgaccgtatccacggtggtcgaacgctggccgctttcagcattacaagcagcgctgcttcccttgatcgtcggagccaccctgcaacctcggaaaccagcaggcgcagcatctccatgcttccagtggaggctcctggccgtgcgcctcttcccgagggccgggtgcacggcggcaacatcgtgtcaatgtttgctaatggtctgagcttcggggaggactccagcaacaacgctgaggccagtacctcggcgcctcgcagctccaaacctgccaaggaattcagcgcctctggtcgcagcagctggctctagcgcccaaggctttcctcccgcccgacctccgtttcgacgcggttcgtttcgtctggcaagtatctcctgctcctgtcctatgctgtgaagaaggccgcggtatgattgtgtgaagtctttgttgtcttactt

SEQ ID NO: 75422 - DNA, 576 bp, Triticum aestivum
  Clone ID: PAT_TA_75422
gacttggtgtcggggaccccaacgcgccccggttcgtgctgtgggaggggaagctgaggccggtgccgtccaagccaggcgacctgcctttcttcagcctcatgagcattcccgggaagctcagggccggccttggcgccctcggcattcgcccacctcctccagggcgcgaggagtcggtggaggagtttgtgcgccgcaacctcggcgccgaggtctttgagcgcctcatcgagcctttctgctcaggtgtatatgctggtgatccttcgaagctcagtatgaaggctgcatttgggaaggtctggaggttggaggagattggaggtagtattattggtggaaccatcaaggcaattcaggataaagggaagaaccccaaaccgccaagggatccccgacttccggcaccaaagggacagacggtggcatctttcaggaagggtctagccatgctcccgaatgctatcgcatctaggttgggtagtacagtcaagctgtcatggaagcttacgagcattacaaaggcggacaaccaaggatatgtattacgttatgaaacaccagagggacttg

SEQ ID NO: 75423 - DNA, 486 bp, Triticum aestivum
  Clone ID: PAT_TA_75423
gcatatgcgactcctatatgcacccagttgagaatggagaagccaatggccagcggcgaactaaatcagtggatgaccattcatttcttgcctggaacatgggagcttgattacagacttgacaagttcatagagctatggggattcttgctgccattatattgccagtcatgcaagtccacgaggagcggaaaaatctgtgtgtcgagcgtacctgatgatctagggagctttacggttgtccaggaagactatgggacttcagcttccaatcaaggcactcttcaaggagggaggggtttcatcaccggtgctgttgtcgtcgtcgtgcagggctccatcaaccacaagtactaccttaacttcgatcaagactatgttggcaccgaccacttcctcggcgcctctttggatagagtcaccatcgaccacggctactacaacctcctcgttcaagtcaacctcgacgtcaactaccatcatgac

SEQ ID NO: 75424 - DNA, 278 bp, Triticum aestivum
  Clone ID: PAT_TA_75424
gtgcagcagcgtacgaccacctactgcctctgccccgtcagcccgtggcctcgtgcctgtacgcacgacgtgcggccgtggttcgatcgcacgaaccgtatcagctgcgatgccctgcgcaagtgtgcatcgcctcggccattggcgggattcggggaaacgtggtctctccgctgcccttcgcgcaccctatcctcgccccgcccgctcgccaatcgcgcgcccccgctgtcgccacacgtacgcccgggaacatccccacccccgtgccgtgcgat

SEQ ID NO: 75425 - DNA, 545 bp, Triticum aestivum
  Clone ID: PAT_TA_75425
cccacgcactgcctcgcgagaagctcctcatcctcttcgatgtcgacggcacgctcacggatccgcgcctccccgcatccgagcagatgctccacttcctgaaggagctgcgcaagcgcgccaccatcggcttcgtcggtggctccgatcttgtgaagcagcaggagcagctgggccgcaacactcttcacgacttcgactatgccttcccggagaacggactcatggcctatcacaatggcagcgtcatccacaagcagtcgctgaaggacttccttggtgaggcgaagctcaaggagttcatcaacttctgcctacactacatcgctgacctcgacatccccatcaagcgcggcaccttcattgagttccgcaatggcatgctgaatgtgtctcccatcggccgcaactgctctcaggaggagagaatcgcattcaacgaatacgaccttcagcacggcatccgcaagaagtttgtggaggcgctccaggccaagttcgcgtctttcggtctcaagtactcgatcggcggccagatctccttc

SEQ ID NO: 75426 - DNA, 172 bp, Triticum aestivum
  Clone ID: PAT_TA_75426
cgtggtggctctactggctacgacaacgccgtggcgctacccgccggaggcagaggagacgaggaggagttggccaaggagaacgtgaagaacgcgtcctcctccacaggcaacctcacgctcagcgtgaccaagagcaagccggagaccggcgaggtgactcggcgtcttc

SEQ ID NO: 75427 - DNA, 627 bp, Triticum aestivum
  unsure (1)..(627): unsure at all n locations
  Clone ID: PAT_TA_75427
caggcagccccagccaccagcgaaatggccgcgtcggcgctgcaccagacgaccagcttcctcggcaccgccccgcggcgcgatgacctcgtccgcagcgtcggcgacttcggcggccgcatcaccatgcgccggaccctccagaacgcccccccaaagcttctggtacggccctgaccgtcccaagtacctgggcccgttctccgagcagaccccgtcgtacctgaccggcgagttccccggcgactacggctgggacaccgccgggctgtctgccgaccccgagacgttcgccaaaaaccgggagctggaggtgatccactcgcggtgggcgatgctcggcgccctggggtgcgtgttcccggagattctgtccaagaacggcatcaagttcggcgaggccgtgtggttcaaggccggcgcccagatcttctccgagggcggcctcgactaccttggcaaccccaacctggtgcacgcgcagagcattctcgccatctgggcggttcaggtggtgctcatgggcttcatcgagggttaccgcgttggtngcggccccctcggcgagggcctcgacatcatctacccgggcggcgccttcgacccgcttggcctcgccgacgaccc

SEQ ID NO: 75428 - DNA, 564 bp, Triticum aestivum
  Clone ID: PAT_TA_75428
tccgtcatctgttgagcagcaaagcgaacaaccatgaggaaggagatcatcattcggatgtatgtgaactcggagaaataccaaaccaaagccatgaaagcggcagctacggctagcggtacgtatataggaccatatgctggttcatcattctttctttttagatttgtgattcttccataacgatagatcgaagcttaattcattccttgcccgcgaagcttttccgttaattaattcaagccagcgttggcacgagatgattaactgggttgggacttgggaggagtatgcaggggtggagtcggtgacgcttgccggcggcgacaagaatctgctgctggtgatcggcgacgacgtggactcgaacaagctgaccaagagcctcaagaagaaggtgggcgccgcttagatcgtggagctgaggacgctcgacacgttcggcgcgtcgtcgctcccgctcccgccggggacaaaggggccggtggcgccgtacaacggctcgcagcactaccagtacggcgcggcgcctggcccgtacgcttaccaccaccacccgtcgcc

SEQ ID NO: 75429 - DNA, 508 bp, Triticum aestivum
  Clone ID: PAT_TA_75429
tgagctcgcaggcagccccagccaccagcgaaatggccgcgtcggcgctgcaccagacgaccagcttcctcggcaccgccccgcggcgtgatgacctcgtccgcagcgtccgccaactccggcggccgcatcaccatgcgccggaccgtcaagagcgcgccccagagcatctggtacggccctgacctgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactaccttggcaaccccaacctggtgcacgcgcagagcatcctcgccatc

SEQ ID NO: 75430 - DNA, 301 bp, Triticum aestivum
  Clone ID: PAT_TA_75430
cgcacgcccactcgactgctccgccgccggagctccgccctccctcccgccggcgccgccccccttgcagttcctccaccgcgcgtgcccgccccgtccttcgtctcttccgcgtggcccgacccgccctgccttctcctcgccgcgccgccgtccgctcgaccccatctcgccccgtccgcgaaggagacgaccagcagcagcggccccaatcgacggagggacggagggagggaggatcctctcagagaaagatggggcatctttaccgtagaagagaaaatatggagcattttatcag

SEQ ID NO: 75431 - DNA, 268 bp, Triticum aestivum
  Clone ID: PAT_TA_75431
acacgggagaggttcattgcgccagtggcaagcagttgatagtccatcctcagatttttgtctcccttgcacgcaatatggacgaagaaaatcctgttgagctgctacaacgttatcgccgtgatcgccatgtgttgctcaattacatcctttctggtaacttgatcaagaaagttgtaatgccgcctggtgctatctctctggatgacgtggatattgatcaagtcagtgttgattatgtcctcaattgcgctaagaaaggggatcc

SEQ ID NO: 75432 - DNA, 433 bp, Triticum aestivum
  Clone ID: PAT_TA_75432
cttaaaaaccgacaatgggtattgctcgtgacactctccacaagcaccgttctacgggagccaagcgtaaggtccctcgttccaagagaaagtacgaactctcgtcctcaaaccttccaaaaccctttattggagcccgtaaggtgaccaccgtgcgcgttcgcggaggagccaccaagttccggttgcgttgcgttggaccatggaaacttcgcctgggcctctgagcacgccactcgcaagtcccgcatgttggtcgtctcatacaacgccgtctctaacgagttggtgcgtaccaacaccttggtgaagggcgccatcgtccagattgatgccacccccttcaagcagtggtacgagaagcactatggagtgaccctcggaaaggccaaggagggagaggccgccgcctccactgacgccgccgcccccc

SEQ ID NO: 75433 - DNA, 574 bp, Triticum aestivum
  unsure (1)..(574): unsure at all n locations
  Clone ID: PAT_TA_75433
ggctcagtatcccgagtctcgattagtagcgctgaatacgatcaaggagtatgccgacgcccttagacgcgggtcaggagacggaggcgtcgctgcaatcgttgatgaagatgccatatgttgaaaatcttcctgtcataccactgcgatttcagaatagtggggcaggagttcaccaaggaagggatggggnctttgcattccagagagactcccccctcgccgcggatttatcgacggccatccttcaactttcagagagtggccagctccagaggatccacgacgagtggttcaccaggccgagctgctccactgatgacactgaggtgggagcaaccagccttggcctccgaagcttctggggccttttcctcgtgtgtgccctgatatgcctcttggctctgctggtgttcttcatacgggtctgctggcaatatagccgctactctagctctgaagctgccggtgagcccggtgcagccgatgctgtcggccccaccgccgctgccgccaatgctgtcgaaaggcagcggagaccgtcacgctttggcagcttcagagagctggtaga

SEQ ID NO: 75434 - DNA, 467 bp, Triticum aestivum
  Clone ID: PAT_TA_75434
gcaggcggacgcgtacaaggagacgcacaacctggtggtgtcgccgcgggacacgtacgtcggcggcctggtgtccaacctgcaggtcgcggagctgatcgcgtgcgtggccaagaacaggagggcgggctacttgcaaggtggtggagctcgtggccgagaccaccgcgccgctgctgcccacggaggacctcctcgccagagtcccctccgaccccggcagggcaccgcccccggcgaaggagtcgcctcccgcagcagcggcggcaccagcaccagttgcagcacctccagcaccggcaccggcaccggcaccagcagcacctccaacaccggcaccggcaccagcaccagctgcagcccctccagcaccggcgccggcacctgcaccagctgcagcagcaaaaacagagcggccgctctcgccatacgcggcgtacgaagggttgaagccaccatcttcccca

SEQ ID NO: 75435 - DNA, 292 bp, Triticum aestivum
  unsure (1)..(292): unsure at all n locations
  Clone ID: PAT_TA_75435
gacgaggccaagtatgtcaacgggcacaacctcgtcgtcgacggcgggtgcacggtgtggaaggggcccaacaagccggcaccggcgcagtaagacacgtgctttactccgtactacaagtgtgccgtagcagtgagtcgacggtgctgagcccgggcgtactaagtcattgttgtcatgactaattgagatttgattacgttgattaatgagtntatccacatccaccagtccagtgtgccggcagttaggctttgccaaacgaagcaacagttgctcgcatcactcgcat

SEQ ID NO: 75436 - DNA, 540 bp, Triticum aestivum
  Clone ID: PAT_TA_75436
tctccagctcctcctcccggggactaaggccgcagcaccgccgacgaccgcctcgcctctcgacaacgacggccgcactgccgcggcacaacgacaaccatcctcccagagtcgccgtcgtcgtcccacggccgctaggaggctgctgctgcagcagcagccaagcagcgccacggccaccaactccttcgacgtccatggcgcccgtcacacggccgcggcggctaacgcgaagccgagcgtggagttcaacgccggcgcgaagccgctgccgcctgtggggagatcaaatgcaaatcccaggaataattagttggttgatcatcagctagctagcaggcgagcagcctcttggttccctctcttaattacctagcactcacaggagtagtagttggagacaattttttgtctatagactattttttgtgtatagatactaactagatatgagttctgcagttaatgaaactgctttgatggatttccttgtctccaattttgttgatttaacctcccttgaattaccactcttattct

SEQ ID NO: 75437 - DNA, 523 bp, Triticum aestivum
  Clone ID: PAT_TA_75437
gctgcatggcatggcattgcttgcttgccctcttcctcctctcctccaccgcgtacgggcagctctcgccgtcgttctacgacaagagctgcccgacgctgcagcgcaccgtgcgcgccacggtgacaaaggcactccgcgccgagcgccgaatgggtgcctccctcctcaggctccacttccacgactgttttgttcaggtgttgcgacggatccattctcttggatgacgtggctggtagctttgtgggcgagaagaccgcttttcccaacgtgaactcggtgcggggctacgaggtgatcgaccagatcaagaaggacgtggagctggtctgccccggcgtcgtctcctgcgccgacatcgccgccctcgcagcacgggacggcacttctctgctaggcgggcccagctgggctgtaccgctcggccggcaggactcgacgactgccaacatgatggaggccaacagcgacctcccagcacccagcttaaacctggacgggctcatcgccgcgtttgcca

SEQ ID NO: 75438 - DNA, 516 bp, Triticum aestivum
  Clone ID: PAT_TA_75438
gcagcttgctctgttccatccggcagcaatggcggccaccaccaccatggcgctctcctcccccgcgatcaagctcgccggagcctcctacgccctcggcggcggcggccgcatcaccatgcgcaaggccgcgcccaaggcctccgcctccaacagcccgtggtacggccccgaccgcgtgctctacctcggcccgctctccggcgagcccccgagctacctcagcggcgagttcccgggcgactacgggtgggacaccgcgggcctctccgccgacccggagaccttcgccaagaaccgcgagctcgacgtaatccactgccgctcggccatgctcggcgcgctcggctgcgtcttccccgagctgctcgctcgcaacggcgtcaagttcggcgaggcagtctggttcaaggcgggctcccagatcttcagcgagggcggcctcgactacctcggcaaccctagcttggtccacgctcaaagcatccttgccatctgggcttgccaggtcgtgct

SEQ ID NO: 75439 - DNA, 384 bp, Triticum aestivum
  Clone ID: PAT_TA_75439
gcgactggcgggagcgactgagcagcatacgctcttttgcgcctttgcacgcgctttgccgcgctaacatgcaggcctctccgctgcaaaagcgcaagcaactcgatgccgacatcgcttctcccgaagccagccagggaaacgaggaccgaggcacacatgccactcgacagactggcgccggagatactgatgcgcgttctacgcgtcctgcgcttacaggatgtgctccgcgtgagcgagacgtgtaccacgctgcgtgacgtggcacgcgacccacacctgcgcttatcggtgcaattgagcgtcacgaaggccctacgcactcagcttgacggagccatgcgcttaggcgtgcgcctcgtgtccctcacagccgccggt

SEQ ID NO: 75440 - DNA, 607 bp, Triticum aestivum
  Clone ID: PAT_TA_75440
cctccagataatacattaccatggcccccgccgtgatggcttcctcggctaccaccgtcgcacccttccaggggctcaagtccacagccggtctccccgtcggccgccgctccagcggcagcctcggcagcgtcagcaatggcggaaggatcaggtgcatgcaggtgtggccaattgagggcatcaagaagttcgagaccctgtcttacttgccacccttatccacggaggccctcctgaagcaggtcgactacctgatccgctcaaagtgggtgccctgcctcgagttcagcaaggttggcttcgtcttccgtgagcacaacagctcccccgggtactatgacggccgatactggacaatgtggaagctgcctatgttcgggtgcactgacgccacacaggtgctcaacgaggtggaggaggtcaagaaggagtaccctgacgcctatgtccgtgtcatcggcttcgacaacctgcgccaggtgcagtgcgtcagcttcatcgcctttaggccaccgggttgcgaggagtccggcaacgcctaaactacgagttgaaacaatggcctatctcgtatgaaggtcttttgtgaacttcacttttgtcc

SEQ ID NO: 75441 - DNA, 467 bp, Triticum aestivum
  Clone ID: PAT_TA_75441
agagagagggagagagctccaaagacaagcatggtgacgcctcctacgggtcctccgctacggataacccacccctcccacccaggacacgtgctcacgctgtacgcgaccggcggcgccctgttccagtgcgacggctgccggcactacggcgaggacgaccgcaggtaccggtgcgacccgtgcgacttcgaccttcacgtctgctgcgtccccttcaaggtggaggacctgacgctcacgcatcctttcttcaagggctgcaccttcgacttccgctacagccctcccggcggcgccctggccggccgcggcagcttctgcggcgcttgtggagaccaggtgctcggcttcatgttccacgacggacaccgccagatcggcctccacccgcagtgcgccaacctggcagagcgcgtggtccagcacgacggtgcgttcgacctcctcaaggagtcgcccgccca

SEQ ID NO: 75442 - DNA, 99 bp, Triticum aestivum
  Clone ID: PAT_TA_75442
gggcacttatgtcaactgcagcacagcttgtgaatgcaactaccttgactattccaacaaaggctgattcatgcttcaaaatcgaaccaagtgctctag

SEQ ID NO: 75443 - DNA, 410 bp, Triticum aestivum
  Clone ID: PAT_TA_75443
agggacgcggcggcgcatggcagacacgagtccaggcacggccataggcacgtggcttgagttcgtcggccacgcagactacctgccgctgctcgcggcccgcggcatcaccacggtttggcgcactccaacgatgctcctccgaggccgcgctgaaggaactgggcctccctctcgggtccgcgaaagaagattgccgccgagttgcacaagcttcgcatgaaggagctcctcgcagaagcgaagcgagaggagctgtactttgagcagcagttcccggaaggaagcgaggcccgcaagatgtttggtcacggcactgccttctaggccggtgctgctgcggcatgtggcgcagcgttgtacatatactcgatgtacatattctgatggtctaaaaaaaaaaaaaaaaa

SEQ ID NO: 75444 - DNA, 559 bp, Triticum aestivum
  unsure (1)..(559): unsure at all n locations
  Clone ID: PAT_TA_75444
tttgccgcagcaaatccaaactagtaaagctaattagtagttgataggctacaccgatgagcttttgccatttcgcattcaggagcaatggcttcgtcgtcctcacaatggacagcgccgacgagcaaaactatctgactgaggaagccatcacggaccttgagaagaagctcgagcaaatccgggacaacccggaggtgaaaggacttgtgaccacctgcaagagcggcatattctgctccggcctggactacgatcacgacgcanagtccgaggagcaggcggagaacctggcgacaggcgttgccaaggtaatccgactgctgttcttgctccaggtgccaaccgtggcggccgtgcgcggccacgtgacgtcgctgggcctcgcgctggcgctcgcgcacgaccacgtcttcgtatgggaccaagccgtggtgagactcccggaggcgcaactcgggcgccggctgccggactacgtgccgacgctcctgcgcgacaagctgtcgtatgcgcggctgcggaagctgctcatgctcaagtcgcagccgtgcaccgg

SEQ ID NO: 75445 - DNA, 536 bp, Triticum aestivum
  Clone ID: PAT_TA_75445
cgacggccctaccggcgctgcccgggatgacaggtgaggcagcaagtcgacagggcgaaccggcgtggcccgtccattggactcgtcatgtcgtacgtcgccgaggacaccgcgctccaggcctccggctacttccggccctggcgtgtccagcccttcgttgacctctacggacggaggtttcacatcgggagtattcgaggtgcgaatgttatatacgcattgacaggacaacgcaggttgaatgcagctgtaactgtacaaactctcctcgatgtctttactgtgtctggtattgtccattatggcacagcaggaagctctaatgattcaatgtcatttggcgatgtcagtgtcccaaagttagttgcttatacaggtgcttggacatggaagaagttcaagtcattaaaagaatcatcaacagaactaaactttggacaatttaacatcccggatggaggagagaacctgctagggtctctgaaatactgaaatgaggagctatattcagttggtaagcctatggaagaagt

SEQ ID NO: 75446 - DNA, 464 bp, Triticum aestivum
  Clone ID: PAT_TA_75446
gcgccgccgccaggtaagaggcgagatggtgtccggctccggcgtgtgcgccaagcgcgtggtggtggacgcccgccaccacatgctcggccgcctggcctcgatcgtcgccaaggagctgctcaacgggcagcgcgtggtggtggtccgattccaagaaatcctgcttttccggcggcctcgtccgccagaagatgaagtacctccgcttcctccgcaagaggatgaacaccaagccctcccacggccccatccacttccgcgccccggccaagatcctctggcgcaccatccgcggtatgattccgcacaagaccgcgaggggcgaggccgcgctcgccaggctcaaggcgtacgatggcgtgccgccgccgtacgacaggaccaagcgcatggtcatccccgacgcgctcaaggttctgaggctgcagcctgggcacaggtactgcctcctcggccagctc

SEQ ID NO: 75447 - DNA, 502 bp, Triticum aestivum
  unsure (1)..(502): unsure at all n locations
  Clone ID: PAT_TA_75447
tctccacctcagcacctgcagtcgagcctgctctacgcgggcggcgtcgccgccccgccgccgaccacgtcgctcctcgcgcaccaagaacgatcagcaccgacctgacgatcggcacctcgcccgcccccgaaaaacaacggcttcacgacgcgcactccgacnaagaaggccggcgacgtcgtcnagccggcgccgaccctgctgctcttcgggcaggcgatactgaccgaggagcagatgaaatccagcagcgccggcggcgaggcagccacctcgccggtagccggcgggtgcggctcgcccaactgggacgcggagaaggcgcccaacctctcggaagggtccggctcgggctcgggcgtgatccagggcagcccaagcaacaacaacacgtcctcctggaggctgcagtggttcggggacagcagcagccaggcggcgcccgagctgctggggctggaggccgggcagtgcaaggtgttcgtggagtcggacgccg

SEQ ID NO: 75448 - DNA, 241 bp, Triticum aestivum
  Clone ID: PAT_TA_75448
gtgtgcgtcactgccagaagccgatcactggcgatatccttaactacggcggcagccttaccacacgaatcatctgctctgcactaagtgcaacactgcgctcggcgccggtgtggcgatcaagaacctcggcggcaagcctcactgtggcgcttgctggaccgccgtcatgtacggcagcgctgctgccggtgcgcccgcgaaggcgcccgcccccgcccccgctcctgctccccacatt

SEQ ID NO: 75449 - DNA, 591 bp, Triticum aestivum
  Clone ID: PAT_TA_75449
cgtagcagccaccagcagcagcagctcctgctgtgcctgctccttcacttgtgcctcgggatccagctctcctactccatcgccaccaccagcaaccaaactacgtgccggccggaccagtcctcggcactgctccgactgcggcgttccttctccgccaccaccgactccacatgcaccctcgcgtcgtggcgggctggcacggactgctgccactgggagggcgtcacctgtgctgccgccgatggccgcgtcaccaccctcgacctcgccgaatgcgggctgcagagcgctggcctccacccggcgctttttgagctcacctccctgagctacctggacctctcctccaacagcttcggccccgcttggattccctgtaaagttttacaagtgtatattgattacccctgtaaattactggagatcagtaaaatacaaccggatatacaaggggagtctacagcgcgcttggttcgtcttgtttctcacttggttcagggagtgttcccatgcgttgtgtcgttggcggcgggaacacaatgaactgcaaggccggcgaccgacggtgccagctagacgcccccacca

SEQ ID NO: 75450 - DNA, 487 bp, Triticum aestivum
  Clone ID: PAT_TA_75450
ccgagcagtgcggcttcgttcttcgaatgggttgatgccactgcgtgtgtttgatggccttcgcgcgtcgcaggacgagctgagcgcgacagccttcctcgagctcgttgaccccggggttgcctgcgccgacccctcgggctgcgattgctcattcgagtgctcggactaccaggagcaaggccaaggcccggcatgctggcccggcggagcgaacaatactacaaacccgcggcgcagcccaagaaggtgacgttcccggtggggcgcttgcctcgccaggccaagtgctacatcaagtgcgactacgagcaggcctacgagttccagatcggttcgcttgtgccctcgggcgattcggagtcctcgtcgttcatccgcgcccgcacacgccacgcgcgcccatgctgcgtgccagcagcttcttggatacaggcagcacagtggacccacagtcggacgcggtgccagtcaacaacatcggctc

SEQ ID NO: 75451 - DNA, 507 bp, Triticum aestivum
  Clone ID: PAT_TA_75451
cacccccgagagcagcgacaccgtcctgtcggcctctcgcgacaagagcatcctgacctgggatctcaaagccgcgtcctccgacgcacactcgtacggccagcccaagcgcgcgttgcgcgggcactcgcactatgtccaggacgtagtgatctcttcggacggccagttcgccctctctggctcctgggacggtaccctgcgtctgtgggacattgctaccggtcttaccaccaagtctttcgtgggccactccaaggacgtcctgtctgtcgccttctcttcggacaatcgtcagatcgtctccggttctcgcgatcgcaccatcaagctttggaacaccctcggcgagtgcaagtacaccatcgacgaccagcgccacactgagtgggtctcttgcgtgcgcttctcgcccaacactcagaaccccctgatcgtctcgggcggctgggacaagatggtcaaggtgtggagcctcaacaactgcaagcttcgtaccaatctcgt

SEQ ID NO: 75452 - DNA, 366 bp, Triticum aestivum
  Clone ID: PAT_TA_75452
ccgtgatggcttcttccgccaccaccgtcgcgcccttccaggcgctcaagtcgaccgccggcctccccgtcagctgccgctccggcagcaccggcctcagcagccttcggcaatggcggaaggatcagatgcatgcacgtgtggccaattgagggcatcaagaagttcgagaccctgtcttacttgccacccctctccacggagagccctcttgaagcaggtctactacttgatccgctccaagtgggtgccctgcctcgagttcagcaaggttggcttcgtcttccgtgagcacaacagctcccccgggtactacaacggtcgatactggacaatgtggaagctgcctatgttcgggtgcaccga

SEQ ID NO: 75453 - DNA, 443 bp, Triticum aestivum
  Clone ID: PAT_TA_75453
tcgtgcagtttgtcaactccgccacgtcccgcaccttcggttactccaaatcggagctgcagggccaaaacatcaagatgctgatgccctcctccatcgccgatcgccacgacgcctaccttttccaagtatctccgcaccggagttggcaatatcatcggcaagggccgcgttgtagaggggcgccgtaaggacggcaagcatgattacgctcgatctcgccgtctctcacgcgcagtcgaaagcgcgacgtgttcaccggcaccttctccgaggtgcagcgccccgtcacgggcagcacctctgtgactgctagcccctcgcccaacgccggcctgacggcgggcttcgcgctgctcgagaacctgctgttctcggcaatcgtggcggaccacaagggccagatcatgttcgccaacacccatgccgcgcgcctcttcggc

SEQ ID NO: 75454 - DNA, 556 bp, Triticum aestivum
  Clone ID: PAT_TA_75454
cacgtactccaccatggccccatacgtgatggcgtcttccgccaccaccgtcgcgcccttccaggggcttaagtcgaccgccggccttcccatcagccgccgctccggcagcgccggcctcagcagcgtcagcaatggcggaagggatcaaatgcatgcaggtgtggccgattgagggcatcaagaagttcgagaccctgtcttacttgccacccctacctccacggaggccctccttaagcaggtcgactacctgatccgctccaagtgggtgccctgcctcgagtttagcaaggttggcttcgtcttccgtgagcacaacagctcccccgggtactacgacggtcgatactggacaatgtggaagctgcctatgttcgggtgcactgacgccacgcaggtgctcaatgaggtggaggaggtcaagaaggagtaccctgacgcctatatccgcgtcattggcttcgacaacatgcgccaggtgcagtgcgtcagcttcattgccttcaggccaccaggctgcgaggaatccggcaaggcctaaagtgcaagtccg

SEQ ID NO: 75455 - DNA, 101 bp, Triticum aestivum
  Clone ID: PAT_TA_75455
aggaagtctgcgccgagaagatgctgttgagaactttctgacggatgagagttctagatgacgataatcataatacttgaaattcaactgccaaatggagg

SEQ ID NO: 75456 - DNA, 317 bp, Triticum aestivum
  Clone ID: PAT_TA_75456
gactgcgctgccaggacatcgtcgtcgtcgaggtccccaagctcgcgcaaggcggcctgcgcatgaaggccatcacggagtggggccagccgcgctccaagatcacccacctcgtcttctgcaccacctcccgcgtcgacctgcccggtcgccgatctaccagctcaccaagattctcggcctccgcccctccgtcaagcgcctcatgatgtaccagccgggctgcttcgccggcggcaccgtgctccgcctcgccgaggacctcgccgagaacaaccgcggcgcgcgcgtgctcgtcgtctgctccgagatcaccg

SEQ ID NO: 75457 - DNA, 524 bp, Triticum aestivum
  Clone ID: PAT_TA_75457
ccgggctgcaggagaatcttaatgcaagagttatagggagggacttatgtcaccacaaacagaaactaaagcaggtgcttggattaaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatatgaagagggtaccgttactaacatgtttacttccattgtaggtcacgtatttggtttcaaagccctacgtgctctacgttcggaggatctacgaattccccctacttattcaaaaactttccaaggcccgcctcatggtatccaagttgaaaga

SEQ ID NO: 75458 - DNA, 298 bp, Triticum aestivum
  Clone ID: PAT_TA_75458
gaagcttgtctctgccaccaaggagggtctgaagctcgatgagagcgaggacgagaagaagaagcaggaggagctcaagggagaagttcgaggggctgtgcaaggtcatcaaggaggtgctgggcgacaaggtggagaaggtcatcgtctctgaccgtgttgtggactccccttgctgtctggtgactggcgagtatgggtggaccgcctacatggagaggatcatgaaggcccaggccttgagggactcgagcatggctggctacatgtcaagcaagaagaccatggagatcaaccc

SEQ ID NO: 75459 - DNA, 105 bp, Triticum aestivum
  Clone ID: PAT_TA_75459
gcaggaaaagatttttgctaccagccacctaagctccaatggagggtgagaagaactcgtccggggacctgatgtccagcagcaagctggtcgcggaggccgcca

SEQ ID NO: 75460 - DNA, 387 bp, Triticum aestivum
  Clone ID: PAT_TA_75460
ttcccctctgcggctgataaccgcgtgtgaggccggcctggaacggcccacccaaattaggcccaaatcaaagcctgcggcgggcactgtctcggggtggtgggagtttagtcccacctcgccaacggagaggagctcgcaccggtttataaacccacctgagctaatcatctcaagttcatatctgaagcaggcagctcattgcctaaccagtctctctctgccccgttgggcctaccagcaacttatatacattcaccgtgggcctgcatcctggcccaatgggttactagtcgtatgcaggccgtggggttccatataaatgctgttggtaagctggcattttctattatttatttaatttttttgcatatgtcacatgtctaa

SEQ ID NO: 75461 - DNA, 107 bp, Triticum aestivum
  Clone ID: PAT_TA_75461
atcacggttggagtaggcaagggaggctgtggcgtgaacgtgaagcctggtcggcggcgccacggtcggagtagggaagggaggcgtcggcgtgaacgtagaagcct

SEQ ID NO: 75462 - DNA, 321 bp, Triticum aestivum
  Clone ID: PAT_TA_75462
gcggcattcctctgccgccttgcgggcacagtccgggaggggggagcgggggaggaagctcacatgatgggaggaggaaggtgatcggggcgagcattctcgtctggagtggcgctctcggtgctcattctcctcctgctcttggtcacgctctgcaagctctggaagagccagaagacggaggagatcagaaccgggtacatcgagagcctcccgacgtccggcgccacgagctggaagctctccggtgtggaggagccactgagcatcaacgtggccaccttcgagaagccgctgaggaagctcaccttcgcgcacctc

SEQ ID NO: 75463 - DNA, 103 bp, Triticum aestivum
  Clone ID: PAT_TA_75463
gcggataggcaagagcacggtacagggataggaaagaagtactataacaataagaggacaaagcaatcaagtagggagaaacctgctagagctagatagaccc

SEQ ID NO: 75464 - DNA, 110 bp, Triticum aestivum
  Clone ID: PAT_TA_75464
agagaataaggctgaagtcaaacagctatactagccaatacttagcttgatattgtaacagcagcaacagtccagtattaaggagatacggtgaagatagcaagagccaa

SEQ ID NO: 75465 - DNA, 387 bp, Triticum aestivum
  Clone ID: PAT_TA_75465
ggatcccccgggctgcaggctgttgtggagctggcgaacgaggaggatgcacggatgttgcttcatagggctgtggagtgctgcccacttcatgtcgatgctgtggcttgccctagcaaggctcgaaacatatgaccaggcaaagaaggtgcttaacaaggccagggagaagctcaacaaggaacctgccatttggattacagctgcaaagctggaggaggctaatgggaacacccaatccgtaagcaaggtgattgagagaggtataagatctttgcagagagaagggttggatattgatagggaggcgtggctaaaggaagccgaagctgcagagcgtgctggatctgtgcttacttgccaggctattgtgaagagcactattgg

SEQ ID NO: 75466 - DNA, 378 bp, Triticum aestivum
  Clone ID: PAT_TA_75466
tgacgacggcaccatcataagcacggcgcggctcaaccggacggtgcacgtcgacgcagcgaagcggctcatgacggtggagagcggcatgctcctccgggacctggtcgaggccgctgccgtcgcggggctgtccctgccgcactctccgtactggcacggcctgaccatcgggggcctcttgagcacgggagcgcacgggagctcgctgtgggggaagggaggcgccgcgcacgagtacgtggtcgggctgaggatcgtaactccggcgccggcgagccaggggttcgccgtggtgagggagctcggggctggccacccggaccttgacgcggcgaaggtctcccttggggttctcggcgtcatctctcatgtgac

SEQ ID NO: 75467 - DNA, 317 bp, Triticum aestivum
  Clone ID: PAT_TA_75467
ccggagaccacggcgggaggagatgctccaggagcacaagcggtcgtgctcggggcggctccagcgatgcacggggagctgcgcgagtgcagagtgaaggcgattgcccgggaggcgcggtggttgttgccgcccgccggcagcgggcgccgtagcaccgggccggggccgagcggcgtggccgtagaacgctgctggtgtcggcgccgtaggaagcgcagctgcgggtccccgttgtttaggcgccatgagccgcggggggcactgcctcgcttctggccagtgaatcagcttgcggccattcatggttcgaagcg

SEQ ID NO: 75468 - DNA, 310 bp, Triticum aestivum
  Clone ID: PAT_TA_75468
ccccgggctgcaggccgctcgaggaaaagaaacaggcgctggagaggagaagcgacgcgactcaggagacggcggcgcaggcgactgacttctcccaacgaaggtcgatccacaccaagtcttcttcttacccgccatggataacgcccccctgtccgttgttccccgtcatggcgaccgaggctccgaggaggtcccaccctgcggcggtcgcggctacctcttgcctaccatggcgagcgttccctcccttcaagcgcctgaatccccatggcagccgccccctccccttggtcagaaccctaatccc

SEQ ID NO: 75469 - DNA, 503 bp, Triticum aestivum
  Clone ID: PAT_TA_75469
tcgtcaagaccgagatcgaccaggttaaggctaccatcactgccttcggaactggtgcctccaagattggtggtgtctgggccaagatcaatgccctcgtcaacgcctctaccatcactggtaccaccaccccagctgccgccctcgaggcctccaccgagtcaggtgctaccggtactcaatggaaggctttctccgtctacactcctgccactttcggtactgacttcgacaacttcaaggctcaagccccaacctgcttcgactactacgtctccgccatcaagaagatcgcttgtaacggatgcaaggatgccgctgccgttcctgctcaatgggcttctacgacttctggtgccatcatgctcaaccaagcctccatcaacgcctgggctgctgcttgcaacaaggtctggtacttcatgtggaagaccggttggtttgtccaatctgttgccatcctcaacggagagaagggaaccttcacttacactgctcctgcc

SEQ ID NO: 75470 - DNA, 415 bp, Triticum aestivum
  Clone ID: PAT_TA_75470
tggatcccccgggctgcaggccagtacgctcctgtcattgccgcccagattctgcagggtctgcccccgaacactggtctgcactgacgttggtctgtgcggcagcaacaacgatgaagcccgccgcggcgcccgcctgggtttccatgctgaacacgaacgtgatgaccatgcttcgcactgttcacaccgcggctgcctccaagatcgcctccaagacggcctccaagtcccagggcatcggctgcaccatttgcacgctgatcattgcctttgccgaggaggagttgggctccaacaagacgattacgtcggtagagaactttttgaacagcactgtgtgcggcctgttgccctcgttcctccagggtgagtgccagaacttggtcgaccagtacgcgcccgtcattgccgc

SEQ ID NO: 75471 - DNA, 141 bp, Triticum aestivum
  Clone ID: PAT_TA_75471
atatgagtatgcagcataccgaatgttgttcggagtcccgggtgagatcccggacgtcacgaggagtttcggaatggtccggaggtaaagaataatatataggaagtggtatttcggccatcgggaaagtttcggggtcac

SEQ ID NO: 75472 - DNA, 551 bp, Triticum aestivum
  Clone ID: PAT_TA_75472
caagcgctcgtctacgagtacctcgagaacggctcgctggagaagtacctctaccgcgcacggggaaggcgccggcgaggacgggagaaaggagaggctcgagtggcggacgctgcacagcatcgcccatcggcacggccaaggggataagatacctccacgagcagtgtcagcacaggatcgtgcactacgacatcaagccggccaacatcctcctcaccgccgacttcacgcccaaggtggcggacttcgggctggccaggctgggcgagcgcgagaacccgcacatgtcgtcgctaacgggcggcgggcgcgggacgccaggatacgctgcgccggagctgtggatagcgctgcccacgacggagaagtgcgacgtgtacagcttcggcatggtgctgttcgagatcctggggcggcgcctgaactacgacgcccagctagagcacgagagccgcgagtggttccccaagtgggtgtgggacaagtacgagcagggggacctggagtccatcgtgtccgcggccgccggcgtcggggaggcggaccgg

SEQ ID NO: 75473 - DNA, 471 bp, Triticum aestivum
  Clone ID: PAT_TA_75473
cgcagacagacagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgcctacggcaggaaggtgggcaagaagggcgtgtaccagttcgttgacaagtacggcgccaacgtcgacggctacagcccaatctacacgccagaggaatggtctgaatctggtgaccgctacgccggcggaacgaccgggcttcttatctgggccgtcaccctcgccggcctcctcggcggcggcgtcctcctcgtctacaacaccagcgctctcgccggctaagagagcatctacgtgtaacacagggccgggtctctgcttgcatgcacgtctc

SEQ ID NO: 75474 - DNA, 483 bp, Triticum aestivum
  Clone ID: PAT_TA_75474
ccgggctgcaggccacagccgaatccccttcacacctcccgctgtggcgccgcgagatttcccgattcgccgctatccgaacggcccggagcggcggatcaaatcctgcgatatcagattctcgtcgcaaatctctcttctgcccatggcggagcttttggcttcttgggccgccgaggagcggtggcatgtacccggccttcctggccatgtacgccgtcatctactgtgctcgggcaactggtcttgttccggcgctgggagtggaggcaccggctggacggcgctcgctgcctcatctcactcgcgcacggctccggtgccgcgctggcggcggtcgcagccatcgccgcgcagccggcggggaaccggggtttcgctgctcctaattcccgcatgcaggaccacgtcctcgactacagtgtcgcctacttcaccatggacctgctccactatctcgccttcctccccggggacgtcctc

SEQ ID NO: 75475 - DNA, 447 bp, Triticum aestivum
  Clone ID: PAT_TA_75475
gtggatcccccgggctgcaggcttctgttggattcttccgttagagcggcggcctctccgtgagataacgaccggggcctgtcacggagaagcttcccgtgagagcagcgatgccgctgctcccgacgaagctggcgatgggagggagaggacggcggcggcgacgaggccgccttccacgagttcaacggcgcctccttcgccggcgcggtgttcaacctgtccaccaccatcgtcggcgccggcatcatggcgctgccggcgaccatgaaggtgctcggcctcgtccctgggctggtcatgatcgtgctcgccgccttcctcaccgacgcctccgtcgagctgctcatgcggttcagccgcgtcgtcggcgcgccgtcctacggcgccgtcatgggggacgccttcgggtggtggggaaggaggctgctccaggtctgcgtcgtg

SEQ ID NO: 75476 - DNA, 337 bp, Triticum aestivum
  Clone ID: PAT_TA_75476
ccctgttattgtgagaattcttaattcaagagttatagcggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctgggtgttccgcccagaagaagcagggcgctgcagttagcctgccgaatcttcctactggtacatggaccactgtttggactgatggacttaccagtcttgatcgttacaaaggacgatgctatcacatcgagcctgttgctggggaagac

SEQ ID NO: 75477 - DNA, 148 bp, Triticum aestivum
  Clone ID: PAT_TA_75477
acttcgagaggggactgagccaaagatgacaatcaccatcttcatcaagatcatggggctcgcatacctcgagcctgtgcttgaccagaacctctactacatgggcgcgaagctgacctcgtgcggggttcggggtcggcgctgatca

SEQ ID NO: 75478 - DNA, 559 bp, Triticum aestivum
  Clone ID: PAT_TA_75478
ggcccccataatatctctctctcctccctctcccatcccctctctccccaccactcgtcgccgccgtcgccgccgtccaatctccggcgagatcccctcccccgccggcagccatggcctccaccttcagcggcgacgagaccgcccccttcttcggcttcctcggcgccgccgccgccctcgtcttctcctgcatgggggcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccctacttcctcttcgacggctacgcgcacctctcctccggcctcgcctgcggcctcgcgggcctcgccgccggcatggccatcggcatcgtcggcgacgcccgcgtcagggccaacgcgcagcagcccaagctgttcgtcggcatgatcctcatcctcatctttgccgaagcccttgccctgtacggcct

SEQ ID NO: 75479 - DNA, 479 bp, Triticum aestivum
  Clone ID: PAT_TA_75479
gccgagttgaaccacttcctcgctgtccagctcggagaggatggatactctggagttgagatccgcaccacccccgataagaccgaaatcgtcatccgtgccacccgcaccaagagcgtcgtcggagagggagcccttcgcatccgcgagctcaccgccatcatccagaagcgcttcggcctgaagcccaactccatcgagcttctcgtctctgccgtcaagcgccgtggactctgcgccatcgcccaggctgagtctctcaagtacaagctccttgctggtctccccgtccgtcgtgcctgctacggagtcatccgcttcgtcatggagagtggagcccagggtcttgaggtcgttgtctctggaaagctccgaggccagcgtgccaaggccatgaagttccgtgatggttacatggtccagtccggtcactctgtcgtcgattacgttgacactgctgtccgtcacgtcatgctccg

SEQ ID NO: 75480 - DNA, 554 bp, Triticum aestivum
  unsure (1)..(554): unsure at all n locations
  Clone ID: PAT_TA_75480
gcgcctagagagtatacctgtcgtatggtcatcggtctctctggagattttgtgcttggagaagatggataacctgaaaacattatgtaataaccttgcatgtcaaagccagtaggatgcattcacccctatgcaaatttttccctatggttgaagaagatgagattaatcgagttaggaagcctggagatatgggcagaacatagtgtgggagagcgtagtgataacctgctaacattcccggtgcttgaagagctagagatcaaaaattgccccaagcttgcaagcattccagtgatccccgttgttggcaacttgagaatagtaggggttcacagtactgcagtcggttcagtttgtatgagcatccgtttaggctcctggaccatttctcgcctgcttaactctttggtctccggaagacatacccatgttgcctctgaacacccagcaaggccaaagtcaaagacctcttgaaaaacttaagcgtctgactctngaagggcccaacagcttggtcagaagctccggattgtccagtttacaccttataa

SEQ ID NO: 75481 - DNA, 514 bp, Triticum aestivum
  Clone ID: PAT_TA_75481
tgagaattcttaattcaagagttatagggagggacttatgtcaccacaaacagaaactaaagcaggtgttggatttaaagctggtgttaaagattataaattgacttactacaccccagagtatgaaactaaggatactgattttctgggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtgacgtatttggtttcaaagccctacgtgctctacgtatggaggatctacgaattccccctacttattcaaaaactttccaaggcccgactcatggtatccaagttgaaag

SEQ ID NO: 75482 - DNA, 544 bp, Triticum aestivum
  Clone ID: PAT_TA_75482
tgagaatcttaattcaagagttatagggagggacttatgtcaccacaaacagaaactaaagcaggtgttggatttaaagctggtgttaaagattatacaattgacttactacaccccagagtattaaacctaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctattatgtagcttatccattaaacctatttgaagagggttccgttactaacatgtttacttccattgtaagtgacgtatttggtttcaaagccctacgtgctctacgtatggaggatctacgaattccccctacttattcaaaaactttccaaggcccgaactcatggtatccaagttgaaagagatcagttgaacaagtatggtcgtccttt

SEQ ID NO: 75483 - DNA, 559 bp, Triticum aestivum
  Clone ID: PAT_TA_75483
agtaaggactacccacactcatcgaaatggctgacgacgacgttcaagctctggttatcgacaacggctccggcatgtgcaaggccggcttcgccggtgacgacgctccccgcgccgtcttcccctcgattgtcggtcgcccgcgccacactggcgtgatggtcggcatgggccagaaggacagctacgttcggtgatgaggcgcaatccaagcgcggtatcctgacgctcaagtacccgatcgagcacggaatcgtcaccaactgggacgacatggagaagatctggcaccacaccttctacaacgagctccgcgttgcccccgaggagcacccggtcctgctcactgaggccccgctcaacccgaaggccaaccgcgagaagatgacccagatcatgttcgagaccttcaacaccccggccatgtacgtcgccgtccaggccgtgctttcgctctacgcctcgggccgcaccaccggaatcgtcctcgactctggtgatggtgtctcgcacactgtcccgatctacgagggttatgcccttccccacgccatcctcc

SEQ ID NO: 75484 - DNA, 470 bp, Triticum aestivum
  unsure (1)..(470): unsure at all n locations
  Clone ID: PAT_TA_75484
tgcaggcagtgcccgctagccatcatggtcacacgattcaagaagaacaggaagaagcgaggacacgtcagcgccggacacggtcgtgtcggncagcacaggaagcatcctggaggtcgcggtaacgctggtggtcaacaccaccaccgcatcaacatgngacaagtaccatcctggctactttggtaaggttggtatgcgcacgttcaacttcaacaagaacgctgccttctgccctgtcgtcaacgtcgaccacctgtggaccctcgtccccgagtcgcagcgcctcgaggctgctggccgcaccgacggaagcgtcccgatcatcgatgtcaccaaggctggtttcttcaaggttcttggtaagggtcgtctgcccaagcagggagccatcgtccgcgccaagttcttcagcaagcgcgctgaggacaagatcaaggccgcaggtggcgtttgcgagcttgttgcgt

SEQ ID NO: 75485 - DNA, 571 bp, Triticum aestivum
  Clone ID: PAT_TA_75485
tggatcccccgggctgcaggcggccgccgagggctccggtggagttgtgtcgatcactgctggagccggtgcagtcggaggcaacattctgttgcaggccggtgccggaggcgccgctgccgtgccgcccaactcttgtggccaggtgatttgtcagtcgggagcgtcgctgttcctcgtcgaccgcgcgccggtcatcatcgagaacggcaacctcgtgctcacgcgcggcggaaccgaccgcgtgacgctgtcggcggacccgtcggccatcctcaccgtcaacggaaacgtcatcctcaagtcgcgcatcaccggaaccgtcagtggtgacgccaacactgccatcacgctcgtcggcccgctcgacctcggagacacgcgccgcgtcgacctctacctggctgatcttcagagctcgctcaacagcgtcatccgtgcgctgtcgccgtgcggccacggtctgttcaacatctacgaccccgtcaccaagaccgccgtcaccaactcggccgccgccatctgcacgcgcgccaccaacaagcgacgaagcctcgccaccgtctcgccc

SEQ ID NO: 75486 - DNA, 537 bp, Triticum aestivum
  Clone ID: PAT_TA_75486
tgcaggtttgccgaggtaacaactgtactatcaggatctaactatcctactgccaacattttttatccatatatcatgaatgttaagattgctatcgtagagcatgccatgggttcgaatgcaaacttgaaaaagaatgggaggagcatgcttgataagtttgataaatattgggatagcaatagtgaaggtgagggaaactgaaaacagtgggaaaaacaaaaaaaaggagaagaacaatgtcatggtcattgccaccattcttgatcctaggtttaagatgaaacttgttgattactgttttaagaaaatgtatggtaaagagaagggcagtagtgaggccaaggaaatcaaatctgaattctttgatctctatgctacttatgagatggaaaatcgcaagaatgaggctggcaacaataatgaacagagttcagtatgtagtaggcaaacaagtacatccatgtcctcattgtcaagtgggtttcagtccttcctagaggagacaaattcagagccatctaaatctgaattgac

SEQ ID NO: 75487 - DNA, 539 bp, Triticum aestivum
  Clone ID: PAT_TA_75487
ctacgggccctaccgcgccgactccgacggcggcctcgccctcgagcccgccgccttccagggccgctaccctgcccaggtcaaatttgtgattgatggtgatttcatgcctatcccagagagtagcataagaaatggccatagagagaattattcccgtgggaaattttggcctgaacttacctttacgcaagttgagaaactgagagcattgttccgtccagttacttcactgccagtgccagaggcaccacccctgcattatgttgacaacaggcatcccgctcaatctgctgcttttctgcctccttcagcttcatacccgacacagccaacttcttatgtgcatcacccaagcacttttgctcctactccagctgctcatctggtgccaaatcaaccttacccacgcccagattctcaccttcctgtgactgctcaatacacaacacctgcttactatgcgaccccgactgcgtatccgtatcaagcaggttatcaagcatatggtccacctcctgccacctaccactacgccc

SEQ ID NO: 75488 - DNA, 546 bp, Triticum aestivum
  unsure (1)..(546): unsure at all n locations
  Clone ID: PAT_TA_75488
ggaaaaaagacctatctcttttgcaatgtcaattcatgtttgtattgttggaccttcacaagttggaaaaagctgcatgatgatggtgttgaaaaatggagttttcccatacatgtataatcatggtaatatcagatatgatgaaagtgacgacaaatatttgcatcctagtccagattccacagaatccttcgggataacagaacagattgaaggacaaagaatcaatttcttttatgatgataccattggcaatagacatgaatattatcgtgaagacaggttgaaaaaaatacaaacaagcagatgtattttacttggtgatggatgctgattggaattggaaacagcaaattgaagaaattagaaacgaaatcatccctgaaatccttaagatcaatgaggaaccaaagtttgtattaattctcaacaaaattgacgaaatctcagatgaaaatgtaatggaggatgaaagggaagaagtgttgaatgcagccnaagagctttcagaagaattgggtgcttttcatttctttcagtgtatgt

SEQ ID NO: 75489 - DNA, 129 bp, Triticum aestivum
  Clone ID: PAT_TA_75489
ctcgagccgtctacgatttcctctcgccttcctcccccgccgagccctctaaaccctaggcgccgccgtccaggaagcccatttaccagccatagtttggacgcatgccaaggaagaccagcaacaaca

SEQ ID NO: 75490 - DNA, 169 bp, Triticum aestivum
  Clone ID: PAT_TA_75490
caaaccatccaaatcacacggccacgaccgaccgattgcccagccaccggcgactcctgcgatgcggctgcctacgggtgtagcggcatgcggcgcggacctgaacctgttccgcctcccacctctacccgtgcggggacctacttcgaggcgggtaacaagggcacgc

SEQ ID NO: 75491 - DNA, 134 bp, Triticum aestivum
  Clone ID: PAT_TA_75491
taggcaaaaaatttgcaacacatagaacagacatgaaagaaaatctaaaggaaatatcagtgtcatatgggttagaaggcaaaacatactcaaacaaagttctcccaaacttaaagaagatctttgcagcatat

SEQ ID NO: 75492 - DNA, 516 bp, Triticum aestivum
  unsure (1)..(516): unsure at all n locations
  Clone ID: PAT_TA_75492
tcaccaccaccgccacagtctagagcgcctagcatttcaccacgtactacgaatctagctagctcctcgatcgctcctctcatggcgtccagctcgagcgcgttgaggatgcccgcggcggtgtgcgccgtgctcgtcctgctgctgctgtccgccgtctcgcgctgcgaggccgacctcctgcaggtnacggtggccggcggccggagaatgctggccggtgggagcaatgccgccgccgccttctcgcggccgacggagacgactgccgggagtagctcgtggcggacagcagatgggagggcgacggcggcgatgccgtactctgagtcgaagaggtccagccccggcggcccggaccctcagcaccactaatgatcaagtaaactcgccttgtaaagtaacttgtgtcggctaaggatgcgccgtaagttggaatctatgagtccctcgacttcgacttctagagagtcatatactatcttactcttttcattaataaatgactcaactttg

SEQ ID NO: 75493 - DNA, 502 bp, Triticum aestivum
  Clone ID: PAT_TA_75493
ccgggctgcaggtcattactccatatgctgcaagagcagtggcggcggctgtcctcccgcttctccttcttgtagtcgccaccagcgcctacggcggcgcccatggtcggcggccgataagccggaggagcttccccaatggcttcctctttgggacggccacctcgtcctatcagtatgagggtggtgcaatggaggggggcaggggaccaagcatctgggacaacttcactcaccagcacccagatgaaatcgccgatagaagcaatggggatgtggcagtggactcctaccatctttattaggaagatgtgcgcctcgtgaaggatatgggaatggacgcatactggttctccatctcatggactagaattcttccagatcgaactctgaaaggtggagtcgaccgagaaggcatcacgtattacaatcacttgatcgatgagctgctgtccaaaggggtgcaaccatttgtgacccttttccactgggactctccaca

SEQ ID NO: 75494 - DNA, 525 bp, Triticum aestivum
  unsure (1)..(525): unsure at all n locations
  Clone ID: PAT_TA_75494
ccaataccaaagctgcggcggcgcgcgcataggaggcgaatcagcagcggaaccaagccgccgacgccaccatgggtatctcgcgtgactccatgcacaagcgccgggccaccggttggaagcccaagggcttggaggaagaagcgaaagtatgagctcggccgccagccagccaacanctaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagagga

SEQ ID NO: 75495 - DNA, 549 bp, Triticum aestivum
  Clone ID: PAT_TA_75495
cagaaaactcgtcgcttccttgtcacctctgcctcgcccgcgcattgccaggtcgcccgtccgccagagcgtgcccttcctcgacctcggcggtgaccatcgacactgccgcacaatgataggagctcccatccccgaacgccttcgcgcctccatcctgaactcctcctgcacccgcacatgttgccatggccgcccggggccttcttctgccaagattcagctccgtcctccgcgcccgacgaagcctacactgccacgcgcctgcatccgcgacgaagacgacgtcgatggctcctgcctcccctgccgtgtcgcccgccggatccgccgtctgcccgctcctcgccggagtgccttgcgagcgcctcaacctctcctgggacaccgatccgcgcctccctccatcccctgcatcgcctcgtcgcttgactagaagctccgttcgccaagcgtcgcgcccctgcttcgtttcgctacgggaggagctgcatcgccctctgctgcagattccttggacgagcgccctcgcctgggcatgtttgtccc

SEQ ID NO: 75496 - DNA, 511 bp, Triticum aestivum
  unsure (1)..(511): unsure at all n locations
  Clone ID: PAT_TA_75496
atgtgcttgatttgttttttggattcatcaaatcttctttactggatagcagcaagtcatgtgagagcaaagctctcttcgcattaagcacaattttgaaggaacaccatgaatattcgttagcccagttggatgaaataatgatgcttcttcatggaataaagccagattctaacaatgcacgttttagaaggtcaattagtatgctacaagtatctgttggttcacatgattaaggttcatgaagagagcacaagccagaaggcattcttgattctnaatgagttaatacttgcattgaagtctaagaaggaaagtagaagactagcatacgatgtactcctggctattagtactagcttgaggagttctgaattgaataacggagattcagatcttcaacggctattcacaatggtgatgggatatctttctagtccgtctcctcacatagtgagcggagcaatagctgcgttatcattgcttatatacactgatgctgacttctgcg

SEQ ID NO: 75497 - DNA, 466 bp, Triticum aestivum
  unsure (1)..(466): unsure at all n locations
  Clone ID: PAT_TA_75497
ctctcgctggccgttcatcagtcattcagttgaacagattcgactgtgcgatccgcagtggtgccgtgcgtgcgacgataagctccacgggcaacgtcgccggcggcggcnagaaggtgtcgtggccggaggtggtggggctgccggccgggtgaggccaaggccgtcatcctcaaggacaagcccgacgccgacgtgatcttcgtgcctttcggggcgggggtgcagcaggacctcagcctaaaccgcgtccgtgtcttcgtcggcaccatcgccagcgtggtgaccgtcgtcctcgccccaaaggttggctagctaagcgacctagccngggagctatggttagctcatgaaataaattcataaactgatatcatcttgcaaattgatttcatttatgtgtgttgtcgtattctttaatgttcagtttttgagcttcggttgtaagacatgtaatggtgaaaca

SEQ ID NO: 75498 - DNA, 484 bp, Triticum aestivum
  unsure (1)..(484): unsure at all n locations
  Clone ID: PAT_TA_75498
tgagctcatggaacttggccgtttcaagcaagctgaagcggattgcgaccaagccttgctgttggataaaaagaatgttaaagcatacctacgacgaggtacccgcaaagaaagtgttttgaattaccaagaagctctgcaagatttcaggcatgctttagctttggagccgcagaacagaacagcccttgcagcagagaaaaggctacagaaacacctcaggtnattcgggtggcggagctngaaaactgcaaccttcaaattttgtgatcaaactagtctgtaaaggaaagagcccttctgctccgtgaggagaattggtcgcaagacactnaacacttggcttctgtagtgccaccgggtgtcgttgttctcgtttcataaattgaaatttttggcatgagttcgtgaagatnttggcatcttctgagtgcatctgaaacaactggcaagaaacattccaactgtgtttggttgaggcaaa

SEQ ID NO: 75499 - DNA, 340 bp, Triticum aestivum
  Clone ID: PAT_TA_75499
aaattatttaaaaaaatgctatgttagaaaggtgatgttctgttaacatgtaaaatttgaagttcaaactcatattatatgggaggtaaggaaaatatatatacataaatattgatggtgtagttttgtcagtattcaatgctgaaagtaatttattttcatacctcctaaatgaatttgatttgagcttgaataagtttgagacatagtgtttacatggttttccccgatttctaccgtaacttggtttccactggatattttgtcttaataagaaacataaaaggaatgccaagtggcaaactactcattgcctagaaaagagcaaagagcacaaata

SEQ ID NO: 75500 - DNA, 435 bp, Triticum aestivum
  Clone ID: PAT_TA_75500
tgcaggtcgtctcttcggcggagcttgagctgagctggatcgtcgtcgacccccagagcagccgggcggtaaacgtgtcgagccggcgggcagtggccgtggacaggcactggtacaccggcgagacactggtgcggtacgcggtggtgctcggcgggagcaagttcgaggccacggtcacctgctcggaggaggccggatgccttaacgttagagacgtcagcctgaccgtcgaggacgccgacggcgcggcggtaagcggcgaaggcagcctgcggcttctcgcggccgcgatggagggaccgaggagcaaagcaggggagagggaaagagacgaggccaggaggatgtacgaggagttcgtgaggagcaagagggggaggaaggagtccaaggcgaggcgggaggtgctggtggacctgtgctgctccgccg

SEQ ID NO: 75501 - DNA, 299 bp, Triticum aestivum
  Clone ID: PAT_TA_75501
gtccggtcgtcggcggagctgctgctgccggagtccgtcaaggggctcaaggctctgctctccatcgccgcccaccggaggctctggttcccggaacgccttcacagggacttcctcgaggtgatgttcaccaaccgcaaggaaagggcggagctgctggaaggtctggtggtcagcaacaaagacgccaccgtccccgttttgccgcagaagatactcctgctctggggacacaacgacgacatcttcaacatagagctcgccgagacgatcaaagagcagctcggggagaagacgat

SEQ ID NO: 75502 - DNA, 232 bp, Triticum aestivum
  Clone ID: PAT_TA_75502
tggatcccccgggctgcaggcaggcacgacgccaagctggaggcgctgccgtcgcctagaactcatgaacacgcacatgcaccattccctgctgccagcctccgttgctaggaccccaaccttaagatttgtctacatctgctgggaacccaaggatatgttggtgtccatgtggcactttggcaataccattacacccatgtgagttctccgacatgttcgagagtgtatg

SEQ ID NO: 75503 - DNA, 322 bp, Triticum aestivum
  unsure (1)..(322): unsure at all n locations
  Clone ID: PAT_TA_75503
gagggatcagtcaggaaggacagagcgagaacacaaaacgagactcggcggcggtggccaggtagaagaagaagcatggtgttcggccggggcaagccgtcctcgttcctacaccgctctccacnggcggccgccacctcgtcggctgccgcggcggcgttgctccgacctccgggcggcgtaccacgagtgcttcaaccggtggtacgccgacaagttcgccaagggccagtggaacaaggacgactgcgccgccgactggcacaagtaccgcgcctgcctcgaggaacatctcgaagaacagcatctcaggcaaatccta

SEQ ID NO: 75504 - DNA, 228 bp, Triticum aestivum
  Clone ID: PAT_TA_75504
gcggcgttagtatacagagcgagtggtctgtagtgagatggacatggagatcccggtgatcgacctccagggctcaccggcgacgccccccagcggtcgcaagccattgcgcgggtccacgaaggcctgccaggactggggcttcttctgggtggacagccacggcgtcgacgccgccctcatggaggaggtgaagcgcttcgtgtacgcccactacgacgagcatct

SEQ ID NO: 75505 - DNA, 492 bp, Triticum aestivum
  unsure (1)..(492): unsure at all n locations
  Clone ID: PAT_TA_75505
ttccaccatggctgtctggcaaaacaagaagttgatgaagggtaagaagggcggtaagaagaagattatcgaccccttcacccgcaaggagtggtacgaaatcaagggcccccaagcccttcagcgtccgccaagtcggaaagaccctggtcaccaagaccaccggcaccaagatcgccagcgactcgctcaagggacgtgtcctcgaggccaacgccgccgatctcttcgaggatgaggacaaggcctacttgaagttccgtcttcgagttgacgacgtccagggcaagaactgcttgaccaacttccacggtctcagcctcaccaccgacaaggtcaagggacttgtccgcaagtggcagtcgctgatcgagggcagcatcgacgtcnagaccaacgacggctacctcctgcgcgtcttcgtcattggcttcaccaagcgacgacagaaccagctcaagcagaccagctacgcacaaaccgcccaaatcc

SEQ ID NO: 75506 - DNA, 508 bp, Triticum aestivum
  unsure (1)..(508): unsure at all n locations
  Clone ID: PAT_TA_75506
ctctcagccctgatttaagagacactgtttggaaaattgctgtctccactggaggagaaaaggaatacaaccaactctttgaaatctttgagaaagccacccacaatgcgcacacgggctcagggcattgatgattttgggaactactaaaaacgaagatctcttgaagagaactcttaaattgactttggacaccaagtacgttcgttcccaagacagctacgcagtcctctttggagttgcttccaatcctctcggaacccaacttgcttgggagtggttcacccaaaactgggacgcantcttcaagcagtttggtgaaggaaacttccttctctcccgcatgatctcttatgcaacccnagttcttcactcanaaagcaaaggctaaagaagtcaagaagttcttccacagcaagactgtcccttctgctgtcagaaccatccgacagtccatcgaggtcatccgcaccaactctgcttggttagagagagacagaaaggctgt

SEQ ID NO: 75507 - DNA, 400 bp, Triticum aestivum
  Clone ID: PAT_TA_75507
ccggcggcggcgcgttgcacaggagaatggagcaggcggcggcggtgcccgaatgaggagaagcacggcgacctagcccgagctcgcaaccatggctaggggtttgaagaagcatctgaagaaggttcaatgccccgtctcattggatgcttgacaagcttggtggagcttttgcccccaagccatcatccggtcctcacaaggccaggcagtgcctgcctctgatcctcatcctgaggaacagactgaaatatgctctcacctaccgtgaagtgcaatctatccttatgcagcgtcctattatggttgatggaaaggtccgcactgacgagacctaccctgctggtttcatggacatcatttccattcccaagactggtgagaactactggcttctgta

SEQ ID NO: 75508 - DNA, 478 bp, Triticum aestivum
  unsure (1)..(478): unsure at all n locations
  Clone ID: PAT_TA_75508
ctgcaggaggagctcagccaattttaaagagcagcaatgtaattggaaaaggtggctttggtgaagtttataagggggttcttgataatgtacttgtcgcggtaaagaaaccaattggtccgtattgtgcaggagaacaagcaatttgcaaatgaagtcatcatccanatctcaagntacatccacaagaacatcgttaggctcattggttgttgcctagaagtggatagccccctgctagtgtatgagttcatttccaaaggaagcatgcatgacattcttcacgagtttagggagcctctcaacttggatgtgcgtctaagcattgtcttagaatcagcacatggtctagcttataatgcattcacaagcccataccaaaatcctgcacggtgatattaaaccagcaaacatactcttggataacaactttgtaccaaagatctcagacttcggcatatcgaggttgattgcagta

SEQ ID NO: 75509 - DNA, 329 bp, Triticum aestivum
  unsure (1)..(329): unsure at all n locations
  Clone ID: PAT_TA_75509
cctggcaaaggtttctgagaaaaagaagttgttggaaatcatcatttacagcatcatgagtcttttcatcgccttctttacttccatcaacattacctttgcagtctatgggtactcatggaatctaaatcaagtgataggtgacacatacagctngggtctgatcacactgttgattcttacgtgcatcttttactttagttcgggaatctatctgatttacagattgagttctatctcaaagggaatgaaaaaggatagatttcaagggaaaaaaaagtaccaactattggccatttccattgtcatcacattcttcaatgtcctta

SEQ ID NO: 75510 - DNA, 241 bp, Triticum aestivum
  Clone ID: PAT_TA_75510
actagtggatccccgggctgcaggcgcccctcgtctgccggtcgggggatcagcaccagcgccgatcgaggggtaggaggaggagtgaggacgaggacgaggaggaggcgggtgcgcgcgacatggctgcgccggccggcaagggcccgggccgactacgactacctcatcaagctcctcctcgtcggggacagcggtgttggcaagagttgcctccttctgcggtcctctgatggctcct

SEQ ID NO: 75511 - DNA, 427 bp, Triticum aestivum
  Clone ID: PAT_TA_75511
agctcacagcaactgagctcggggcggtgactcaccaggtcgagcagctgcagcttgggcgtgatggcgccgccgcgcagctgctcttccgcgagactcctccccactcatggaggcgcccccacgacacggcggccctccgcccctcccaagacatgtgcgccatcggtccccgtccggcacagcgcaaggcaggcggccaacccttcctccactcctatcgcgcagcgggccaccctccggctggttcaggagctcggggtcgtggggccaaaggagcgaatgacggtaaagacggcggaggcgctactgtgtcgctttgatgagccactgactgaagacgacattgcctgcatctccaaactcacgcgcctcgacatccaggcgctgcgcaccatggccggcctggccggtccggatggagccg

SEQ ID NO: 75512 - DNA, 250 bp, Triticum aestivum
  unsure (1)..(250): unsure at all n locations
  Clone ID: PAT_TA_75512
acgccgtcacctacaccgaagcacgcccgccgcaagaccgtcaccgccatggacgtcgtctacgcgctcaagcgccagggccgcaccctctacggcttcggcggctaggtccagtcgaatccacctcgcgccgcctgattcctactagtatatagctngctatggttgttcagtgttcattctcgctgctgttgttcagtgttccagtgtttggatgtagtatgatagaatggaaatcgcagcattttac

SEQ ID NO: 75513 - DNA, 451 bp, Triticum aestivum
  Clone ID: PAT_TA_75513
ggcttcgcgtcgccgcgcccgtcccgtcccgcctgcgcccgcgcgtgtgctcgctcgccgcctccgatccaccggcccaccaccgcgccggcggcatggcggatcagctcaccgacgaccagatcgccgagttcaaggaggccttcagcctcttcgacaaggacggagatagttgcatcaccaccaaggagctgggaacagtcatgcgttcgctggggcagaacccaacggaggctgagctccaggacatgatcaatgaagtcgacgctgatggcaacggcaccattgacttcccagagttcctcaacctgatggcccgcaagatgaaggacactgactcagaggaggagctcaaggaggccttcagggtgtttgacaaggaccaaaacggcttcatctctgctgctgagctccgccacgtcatgacgaacctcggcgagaagctcaccga

SEQ ID NO: 75514 - DNA, 589 bp, Triticum aestivum
  unsure (1)..(589): unsure at all n locations
  Clone ID: PAT_TA_75514
cagcagaccagtctccagttaagactactttctcagaaccagcaaccaatatggctaccgttgatataccccgacagcaaaaagccgccgtcaggttggtgagggcgtggatgccaaagcccctgttcaacaggttgatgtccaatctcctggacctggtcaaattctcgtcaagatcaatggactggtctatgtgcctccgataaatcgctaattcacgatgaatgggcatccttcggagttgccatgcagcccgccactaagggaattgctggccatgagggcgctggtgtcgttgtcgccgtaggtgacgatatgcaccagaaatggaaagttggggaccgtgccggaatcaaatgggtctggggtacctgtggtgaatgcgagttttgcacgaatggcagcgacgagctccactgcccgaaacagatcaactcaggtttcaccgcagcaggcaccttccaacaatatgctgtcagtgatggcagatataccacccgtatccccnagggcgtttccgatgaggaggccggtcctatcatgtgcggtggtgtgacagcatacgttgcctgcaagagaagttctgttc

SEQ ID NO: 75515 - DNA, 572 bp, Triticum aestivum
  Clone ID: PAT_TA_75515
catcgcgcaagagattgaagagataattggcttggactgcagtaatgcaattaggtgttcagcaaaggagggcataggcatcatcgaaatactagatgccatcgtgaacaaggtccccccaccaaaggatactttaaaaaatccttctcagggctcttatatttgacagctattatgatgcatacagaggtgtcattgtgtattttcgagttattgatggcagtataaggaaaggggacaagatatgttttatggccaataaaaaggagtatgttgctgatgaaattggtgtactatcccccaatcagatggaagctgatgaactgcacgctggcgaggttggctatctctctgcttccataagatcagtagcagatgctagggtgggtgatacaattacccattttgcaaaaagagcggaatctgctttaccaggatattcagaagctactccaatggttttctgcggcttgtttcctttagaggcagatcagtttgaggagttgcgggaagcattggggagacttcagctaaatgatgctgccctaaagtttgaaccggaatcttctagt

SEQ ID NO: 75516 - DNA, 507 bp, Triticum aestivum
  unsure (1)..(507): unsure at all n locations
  Clone ID: PAT_TA_75516
gtgagctcactccttgcaggccttgcgcagcttgaggagcttgacctcagctctaacaactttcacaacatctcagggctgctcgccgtgttgcatgggtgccagaacctcaccacgttgatccttcaccagaattttggtggtgaggagctacccggtgatggtattattggtgggttcaagagcctcaaggtgctggcccttggtgactgtgctctcaagggcagggttccagaatggttgtcccaatgcaagaaaatggaggtgcttgatttgtcccgcaaccaattggtcggcaccattccattgtggattggtcagcttcaccacctttgctactcggatctctcaaacaattcattggttggcgaggtacctaagagtttgacactactaaagggcttcgccaccgctnggcgttcagagggcatgactttcactaacatgccattgtatgtgaagcataacagaagcacactcggacgacgacttaacgagctcccaaat

SEQ ID NO: 75517 - DNA, 102 bp, Triticum aestivum
  Clone ID: PAT_TA_75517
tgagctcgcggcctttcacgacatggatcaacagtgcctgtcacgtccgcgcactgtgcgtctccgacccaagcggcgacttctgctcgtgcgagttctcgg

SEQ ID NO: 75518 - DNA, 546 bp, Triticum aestivum
  Clone ID: PAT_TA_75518
acgatcgcctccgtcccctccccaccaccccacgaaccctaccggcgcgcgttggatctaccggagatggcggaggtggacgcggcggccgcggctgcggccggggcgcaggcggtgcagctgatcgacggcgagggcgagttcgcgggcgagtcggcggagcggttcatgacgtacgcgggcgtcgccggctgcgggctctcctacgccgtcgtcgccatcatgggcccccagagcagcggaaagagtaccttgttgaacctactctttgggactaattttagggagatggatgcgttcaggggaaggagccaaactaccaaaggcatctggatggcacgctgtgttggtgttgagccctgtactgttgtaatggatttggaaggtactgatggaagagaaagaggagaggatgatacggcatttgagaagcaaaggttcattatttgctcttgcgatttcagacatagttctgattaacatgtggtgccatgatattggtcgggagcaagctgctaataaacctcttctaaagacagtatttca

SEQ ID NO: 75519 - DNA, 543 bp, Triticum aestivum
  unsure (1)..(543): unsure at all n locations
  Clone ID: PAT_TA_75519
agaacacgcatcgaaacaattgccatgtctaaacgcactgcggccaaggctggcttgggggataagaagtcgcaaaagaaagcaaaacggtcagatgttggcaaccaatccacccagatgcatatatgccaacagagatattagaaattattttgaccgatgcagatgcggcaactaaaggcagcttattttcgacttgctcgcgggtctataatttaaagaaaaatcagaatctggccaccgcaattttaaaaaagtacgcgcgaaaacagatcaaaactgttggcttgcactatgaatatgcgcacgaagcatccctcgctggttggattgtggatnactatcataacttcattgaagcgcacaacaaaaagcaaattgacttgcctgaaaactatgactttgcttcatgcttcaactcggacgactacgcatcgtggcccgagttcaaagagttattgcgcaagtgccacctgttcactgacgagatcaatggcgtgtttggtccccaatgttaccttcaactacgacacttttcgttga

SEQ ID NO: 75520 - DNA, 539 bp, Triticum aestivum
  unsure (1)..(539): unsure at all n locations
  Clone ID: PAT_TA_75520
cacacactcccccgcccgccgccgccgccgcacagccgcaggtagagaaggcaaggaggaagggaagatgccggcggggcacgggctgcggtcgcggacgcgcgactgttcgcgcggcccttccgcaagaaggggtacatcccgctcaccacctacctgcgccacctacaatggtctggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcacgtgcagccatccaggtgcaacgaggagttcctccagaggaagctcaacaacgacnagctgaaggcggaggccaaggcgcgtggtgaggtcatcagcaccaagaggcagccagcaggccccaagcctgggttcatggtggagggcaccaccatcgagacggtcacccccatcccgtacgacgtcgt

SEQ ID NO: 75521 - DNA, 607 bp, Triticum aestivum
  Clone ID: PAT_TA_75521
gaatagccggcgactcataggcagtggcttggttaagggaacggaacccaccggagccgtagcgaaagcgagtcttaatagggcgattgtcactgcttatggacccgaacctgggtgatctatccatgaccaggatgaagcttggatgaaactaagcagaggtccgaaccgactgatgttgaagaatcagcggatgagttgtggttaggggtgaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgagagggaaacagcccggatcaccagctaaggcccctaaatgaccgctcagtgataaaggaggtgggggtgcaaagacagcccaggaggtttgcctagaagcagccaccctttaaagagtgcgtaatagctcactgatcgagcgcccttgcgctgaagatgaacggggctaagcgatctgccgaag

SEQ ID NO: 75522 - DNA, 425 bp, Triticum aestivum
  Clone ID: PAT_TA_75522
gggctgcaggctcgcttggtggtcagtctcttgtctcgtgctcgccaactccccctcttcttgaatgtcttcttcagttgaacttgaagttcctgctgtcgaggttcccatcccttcgtcagaacctgcagccagcgaacctcaagttgacaatggagattcatcatcatcttcctcatcatcgtcttcttcctcgtcttcttcgtcgtcgtcttctgatgatgtcgagtttttgaaactcaaacgatgtgaagcttttgcagacatccctcgataccctgtcttcttgaaagggatcaagaacgggaacaagaggatcggaacgacgcagtcagatcatgttctcatcttccaagactgtgaaaacaccgagttctccatttgtaacaaccagagatactcgactctgattgctgtcgactgca

SEQ ID NO: 75523 - DNA, 518 bp, Triticum aestivum
  Clone ID: PAT_TA_75523
aggcaaggccattagcggcacgatctcacctattcaaggcctcaacagcccgaatatgctagttcaagattgcaagaagactggctatataggttttcctattcatgttcatggcggtttcaatgagcgaactgacgacttgaaggacatgtgctacccgagtgcctcaactggacatgacaatgaaaacgagatgaatggcatgattcatgatcaaagagagactgataatatcacaatgataccctctgatagtactttgagcagacaaagcactgtgaaaggtcctgaactaaaagggcctgcagaatgtcagaaagaattatggcagccagcaagccctgtggattccttgtaccaccctccggggaatggtctgtacgcacaatcagttgccctgcagcttaaacatcatccctctggagggccagcaacttgtatggttgacttaatcagtgttcctgctgcacaagcgacgagcaattcagcatctctgttgcaaccatgcaccaaccagc

SEQ ID NO: 75524 - DNA, 282 bp, Triticum aestivum
  Clone ID: PAT_TA_75524
ggatcccccgggctgcaggtcaatggttggaagccctgatcttatctccatacctggtgaaactggaaggatgtatgaagcaaatgttgatgatgtagggtatagacttgttgcaatttacacacctgtgtagagaggatggggttgagggacgacctgtttctgcttcaacagagccgattgctgttgaacccgagatttacaaggaagtaaaacagaagcttgacgacggttctgtcaagtttgaggttttgtgtgacaaggaccgaacacccaaaaagg

SEQ ID NO: 75525 - DNA, 592 bp, Triticum aestivum
  Clone ID: PAT_TA_75525
actagctatcgcctccccacctagcaattcacgtactccgccatggctcccgccgtgatggcttcctccgccaccaccgtcgcgcccttccaggggctcaagtcgaccgcgggcctccccgtcagccgccgctccggcagcgccagcctcagcagcgtcgagcaatggcggaaggataagatgcatgcaggtgtggccaattgagggcatcaagaagttcgagaccctgtcttacttgccacccctctctacggaggccctcctaaagcaggtcgactacttgatccgctccaagtgggtaccctgcctcgagttcagcaaggttggcttcgtcttccgtgagcacaacagctcccccgggtactacgacggtcgatactggacaatgtggaagctgcctatgttcggctgcaccgatgccacacaggtgctcaacgaggtcgaggaggttaagaaggagtaccctgatgcctatgtccgcgtcatcggcttcgacaacatgcgccaggtgcaatgcgtcagcttcatttgccttcaggccaccaggttgcgaggaatccggcaaggcctaaagtgcaagttgaagtaaccg

SEQ ID NO: 75526 - DNA, 110 bp, Triticum aestivum
  Clone ID: PAT_TA_75526
ggcaggcctatcccgttcaaggatagttgtcgtggacaacgtcgacctggtcgccaccatgccggctgagaggtcttcggaagaccacgacgatgtcctggtatcggcgc

SEQ ID NO: 75527 - DNA, 449 bp, Triticum aestivum
  Clone ID: PAT_TA_75527
cccgggctgcaggttcttaccttgaatgtacccaattgaacacggtatcgtcaccaactgggatgatatggaaaagatctggcatcacaccttttataatgagttgagagttgcaccagaagaacatccagttctcttgaccgaagcacctttgaacccaatggcaaacagagaaaagatgacccaaatcatgtttgagaccttcaacaccccagcaatgtatgttgcaattcaagcagtgttgtctttgtatgcttctgggacgtaccaccggaatcgtgttggactctggtgatggagtttcccacaccgtcccaatttatgaaggatatgcactccctcatgctatcatgagactcgatcttgcaggaagagatcttactgattacctcatgaagatcttgaccgagagaggttactctttcaccaccactgcagagagagaaatc

SEQ ID NO: 75528 - DNA, 397 bp, Triticum aestivum
  Clone ID: PAT_TA_75528
ccgggctgcaggacatctgtcttgagttttctgtagctagcttgggccgtacgtgttaccaaactccaaatcaatggcaagtagtagttctgcaggaggtgacacggtgagtaagctggtgaccatcctgagcatcgatggcggcggcgtgagagggatcatcccggccaccgtcctcgccttccttgagaaggagcttcagaaactggatgggccggatgttaggattgcggattacttcgacgtggtcgccggctccagcaccggtggcctcttgacggtgatgctcacggcgccggacaaggatggacggccgctgttcgatgccaaggatctggcaaagttctagcatcgacgagtcgcccaaaatcttcccacagaaggactcaatcttctc

SEQ ID NO: 75529 - DNA, 533 bp, Triticum aestivum
  Clone ID: PAT_TA_75529
tggtgattcagtcaccaagattcattgcgacatgtctgatgcggttaatatcctaacacatactgatgaaataaagctcaaagaacaaagggttgtagcgattggagaaaaaagaaaaagagtttggcaataagggatgacagcagaaatcttcaagcttcacaaataggtccttgaattgtgacacgtcgatagctctcagtgaattagtcaaggggccgagacctgaaggatctggacatggctcattcattaagcagccattatcagatgctgttttagatgggcgggacggggttcataaagatgtggcagctgatcaagctgagcggaacttgactgtcaatgggcgagcacccattgaatgtgaagggattcacaaagatgtggcagctgatgaagccgaggggaacttgacggtaaatgggccagtgtccattgtaggtaatgcggatcatatggatctttcagtcaccaaggaggcagcagaagccacaggttatgatcgggagaaggttggttgtggtttcagc

SEQ ID NO: 75530 - DNA, 443 bp, Triticum aestivum
  Clone ID: PAT_TA_75530
cggccagactggagctgaacgccacttgatcaggttcagcaacgagtcggatgcgtccgcggtgcgtacgataccgtctcgatgacggtcaaggaactcatcgcaaatcttcggggccctgaggggacccactctctctatctggccggcgacaacctcgaggagagttttcctggcctcatgccctacgtgtccccgctgccttcggagacgttcctcaagaaggaggagcttgcgtcactgggcttgtggattggtcgcgacggacaggtcacccacgcacacttcgactgcgttcacaacttcatgaccgtcattgccggcgagaaggagttcaccgtggcgccgcccgcctccttcctgaacatgtatccccacacgttcgcctcgtgcaacaagcaggaccaaaaaggcgagatctatcggttctcgcaggtcgacgt

SEQ ID NO: 75531 - DNA, 541 bp, Triticum aestivum
  Clone ID: PAT_TA_75531
ctgcaggaatcggcacgaggatcgattatcaccgtgcacgttggagggaatggacatatactctactgttctttatcatttgaatgaggaaatgaggctaagttaccttgctcaggagcttatttctgttgatcgactatctcctcaagcatggtgtgcagtgggaaattgctttgccttgcggaaagatcatggagactgctttaaagaacttccagcgtgctgtacagcttgactcatgagtagcatatgctcacactctatgcggtcacgaatattctgcattggaggattacgagaacagtgttaaattctaccgatgtgcacttcaggtagatgaaaggcactacaatgcctggtatgggcttggagtaatttaccttcgccaggaaaagttggagtttgctgagcatcattttagaagggcatttcagataaatccccgttcttctgttcttatgtgctatctagggatggccttacatgctctaaagagagatgaggatgcattggagatgatggacaaagccatattttctga

SEQ ID NO: 75532 - DNA, 388 bp, Triticum aestivum
  Clone ID: PAT_TA_75532
acgtctctggctataaacatgccccttgtggctccaggacaagacccatgaatccaaaccctggagcctcttgtgcagcactgttccatctctagctatcagcagagcacatcagtgatctgctcatgcctagcctgagggacagcagctcctcggtcatcatcctcgacctcgcgtccaagatgaagatcggcaacctcaagaaggcggcggcgatgtgcaagagcaagaccggcgtgctcgcgggcaggctcctcgtactcaactcgctccgccgcaggatggccaccgtcggcgccatctcgcacaggatccacgcgctccatggtggccaccgaatcgggtaaggacctcgacaaagacctcgggccgcgcaaggccaaggccg

SEQ ID NO: 75533 - DNA, 418 bp, Triticum aestivum
  Clone ID: PAT_TA_75533
ggctgcaggctgtattgtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgtcgctggggaagacagcccatggatctgtaatgtagcttatccattaaacctctttgaagagggttccgttactaacctgtttacctccattgtaa

SEQ ID NO: 75534 - DNA, 452 bp, Triticum aestivum
  Clone ID: PAT_TA_75534
accgatcaccagcacagcctgcgcatccaccgttgctagcaaggtcgaccaagcagcgccgagatggctgctgccttctcctccaccgtcggtgccccggcttctacgccgaccaacttccttgggaagaagctcaagaagcaggtgacctcggccggtaacctacccatggcaagagctccaaggccaaccaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcagctcctacgagtacgtcagccagggactcaagaagtacgacttcgacaacaccatgggaggcttctacaatcgctcctgctttcatgg

SEQ ID NO: 75535 - DNA, 517 bp, Triticum aestivum
  Clone ID: PAT_TA_75535
tgcaggctacggagaggtcgaggccaagttcagcttcagactccgatgtatgttggtcgaattagtcaaacgctgagcctcatccttgctggggctgccacgacttgctgacaagagatgcccttgaacgatccgacagtctcaagcatgattgtttcaccatccgctgtcatgtccttgtttgcaccccggatgaggtgctcctgcctcacatacaccagcatttcagccacctccttcaaaatatggtgggtgctgatgtcacctttgaggttggcggcgagacgtttaccgctcaccggtgtgtgctcgctgccaggtctcaggtgttcatggcgcagctgtttggccccatgatctagggcaccgccacgtccgataacgtcctacacatcaaagacctggaagcaaaagtgtttagggcgttgcttcacttcatctacacagactcgttccctgggatggacacggacagtgtccgcatggaggacgattaaatgccccgaatagtggaacc

SEQ ID NO: 75536 - DNA, 466 bp, Triticum aestivum
  Clone ID: PAT_TA_75536
ccgcgtcggcgctgcaccagacgaccagcttcctcgtgcaccgccccgcggcgcgatgacctcttccgcagcgtcggcaactttggcggccgcatcaccatgcgccggaccgtcgagagcgcgccccagagcatctggtacggccctgaccgtcccaagtacctgggcccgttctccgagcagaccccgtcgtacctgaccggcgagttccccggcgactacgggtgggacaccgccggattgtctgctgaccccaagacgttcgccaagaacaggtagctggaggtgatccactcgcggtgggcgatgctcggcgccctccggtgcgtgttcccggagatcctgtccaagaacggcatcgagttcggcgaggccgtgtggttcaaggccggcgcccagatcttctccgagggcggcctcgactacctgggctacccctacctggtgcacgcgcagagcatcctcg

SEQ ID NO: 75537 - DNA, 157 bp, Triticum aestivum
  Clone ID: PAT_TA_75537
ccgggctgcaggcaaaacttccaaggcccgcctcactggtatccaagttgaaagagataagttgaacaagtatggtcgtcctttattgggatgtactattaaaccaaaattgggattatccgcgaaaaattatggtagagcgtgttatgagtgtcta

SEQ ID NO: 75538 - DNA, 376 bp, Triticum aestivum
  Clone ID: PAT_TA_75538
aggttgcccaggctggtggtgtgattagggaggagaaaggagccgacggctagctagtgcggcgtgcagaggcttgaatctgagaagtagaagtgcagcgtgtagaggagatggctgaaatcagtgatgccccagcagttacttccggtgagcttgcggctgtattgcgagcgatggatgagaaatacagggctctgtttgatgcaatcagcaagcaagctagcagctccaaatcagaggctgaaataaaggaggagatacatcccttacagatgccacatgtgaagttagagggtcctgagaactatgtaagctgggctgagcatgctgaaaccatcctggtttcaaggaaattggaaggatacatccttgggac

SEQ ID NO: 75539 - DNA, 422 bp, Triticum aestivum
  Clone ID: PAT_TA_75539
ccgccacaccaccggagggagcgagctccagccatggccgccaagtgctacccgacggtcagcgacgagtacctggcggcggtcgccaaggccaagcgcaagctccgcggcttcatcgccgagaagaactgcgcgcccctcatgctccgcctcgcgtggcactcggccgggaccttcgacgtggccaccaagaccggcggccccttcggcaccatgaagtgccccgcggagctcgcgcacggcgccaacgccggcctcgacatcgccgtcaggctgctcgagcccatcaaggagcagttccccatcctctcctacgccgacttctaccagctcgctagagtcgtcgccgtcgaggtgaccggcgggcctgaggtccccttccacccggggagacaggacaagcccgagcctcctccagaagg

SEQ ID NO: 75540 - DNA, 100 bp, Triticum aestivum
  Clone ID: PAT_TA_75540
ttagaagtaatgacgatgaaagcaaggttgctgataacttaaagattgaagtgcaccttccagataaacgacgtgtcacagaggattttgcaacattacg

SEQ ID NO: 75541 - DNA, 471 bp, Triticum aestivum
  Clone ID: PAT_TA_75541
gagcatcccagacgacccaaggttctgtttatcaaaacaagtaagcaacatctcagtcagatgtcgatcatttgatgcagacgggagggatgatgcctgctgagaattctgagacccctgggcctggcgtccagatgcacctgcttaaccaggcggctgagcaggctgtcgtgcatttgcagataactgccaaccccatactttttcgtggccagtgaggcacgacggcatctttccatgtactacaccgccatcttagagtccatggttgacggggcgcgcctaaggaacgacaagaagaggaccggcatggagaatcgctgcctggcgagggagattgtgaatgtcgtcacctgcgagggttcggagagggtggagcagcacgaggtctttggccaagtgaaagaccaacttcattgttgtgctatgtccgcatggcctgacttcctttgaaccacgtattgtctgaac

SEQ ID NO: 75542 - DNA, 256 bp, Triticum aestivum
  Clone ID: PAT_TA_75542
tgcgtcggctgctgaagaaatcgaatctgatattgtttcgctagcacagtcagaagattcagatgtttatgacatatatactgtcaagggaggtggattgataccaacctgggagggagggcgcatctgcagcttcatacccactgttacaagtggacgatgaggatggcgaatgttacgatgatgatgagtatccatatgacacggatgactcaaatgccgaagacaacccactctatgattatcctgaagaact

SEQ ID NO: 75543 - DNA, 206 bp, Triticum aestivum
  Clone ID: PAT_TA_75543
cggtgctgtacaagttcacacagggcccctacttcccgctcgccatgtcggccgtgctcatggttatcatgatcgtgtggcactacgtgcacgtgaagcggtacaagtactgagctccagcacacggtgtcacccgacgaggtgaatgcacctcctctagctgccacgacctcaagcgggtcccggggcttggccttttctacact

SEQ ID NO: 75544 - DNA, 384 bp, Triticum aestivum
  Clone ID: PAT_TA_75544
ttttgcaacgccaggatcgacatgttcaaggatacgataggctggcggtggacaagtggggcctgatcgaggtggtcgaggagcccgccgacttcaaggtgaacgaggacaacaacatgtcggagatcgagtacgagctcgtgaacgtgccgccgaagaagcaggagcgtaagaagtgagcggtggaccggaccggctctctctggctgtggacatagattttgggaggcagtgggtagcagtagtaggttcgcttcattatcctggaatgcgctattagtagtagtgaaaaaggcttcagcaggaaggaaggcctggtctctttgggtttatggatgggatcgtgttctgtgtcggtagtggcgtcgtgtaattggccagcct

SEQ ID NO: 75545 - DNA, 101 bp, Triticum aestivum
  Clone ID: PAT_TA_75545
ttcggggtgctgctactggagatgctcacggcgatggcgaccgacggacgcgctatgtggtaacgctctcagccttcacaagtatgttgacctagctttcc

SEQ ID NO: 75546 - DNA, 271 bp, Triticum aestivum
  Clone ID: PAT_TA_75546
atcttcgagaagctcgccggcgagtcggccaagctggcgaggtacaacaagaagcccaccatcacctcccgggagatccagacctccgtccgcctcgtcctccccggcgagctcgccaagcacgccgtctccgagggcaccaaggcagtcaccaagttcacctcctcctaggcttgggcttggtcctcgtcgtctcatgcattctgtatgtacgtagttcgcagtacgatgttacaatctctgtaaggattgtgctgcttgcttgtggcct

SEQ ID NO: 75547 - DNA, 368 bp, Triticum aestivum
  Clone ID: PAT_TA_75547
ggcgaaagggaagcaagatgtacaccgccaggaggaagatccagaaggacaagggcgtcgagcccctccgagttcgatggacaccgtcgcgcatgctttctttgacctggagaacggcaaccaggagctcaagagcgacctcgaggacctgtacatcaacactgcaatccagatagatgttgttgggaacaggaaggccgtggtgatccatgtgccataccgtctgcgcaagcccttcaggaagatccatgtcaggctcgtcagggagctcgagaagaagtttagcggcgaggatgttgtctttgcttgcaacaagaaggatcgtgaggccacccgggaagggttctgctgttcagcgccctcgcacc

SEQ ID NO: 75548 - DNA, 153 bp, Triticum aestivum
  Clone ID: PAT_TA_75548
ttagttgttacagtgcagtttaagctgctgtccaagttcagattgatcggggacataagccaaatgatctggtagttagctgctgtcaaagttcagttctgatgtaaatctagaaatactgataaacaaacagatgaacagtgatccaatgag

SEQ ID NO: 75549 - DNA, 105 bp, Triticum aestivum
  Clone ID: PAT_TA_75549
aggcactacttccagaataccccagggctcatttttgttgttgacagctattatagggaacgtgttgttcaggctagagattagctccacagaatgctgaatgag

SEQ ID NO: 75550 - DNA, 432 bp, Triticum aestivum
  unsure (1)..(432): unsure at all n locations
  Clone ID: PAT_TA_75550
tatggcggcggcgatgcgatttgcggccggagtccagcgagcccagtccgtttacaaagccgtcgtctcgccgctggttgagggtgagcgtcgccggctgatgccaaggcttatcaacggcggccgacctgcgtattttcctcaaagttctatgtcctcgggcggcgacggctgcaacaccgctttgaagcgaccctgtgcaaaacccgcgctagacctcgacgccnagagagcatggggcggtcgtcagatagcagaaatcgagaccaagaaacacgatctcttctaccagctcgctgagcttgatagcagattcccctcgcgtaacaagtacttccgagagaacagggagcttatccaccatctcttcggacacattgagcccaatcccagtgacaccctatggcgcttctgtcgtgcaagagaaagttt

SEQ ID NO: 75551 - DNA, 294 bp, Triticum aestivum
  unsure (1)..(294): unsure at all n locations
  Clone ID: PAT_TA_75551
attgccgcctcacatgttgacgatattgcctcctactgattctcgcctgaggcctgatcagagacatctggaatatggtgaatacgaaaaggcaaattcggagaagctcagacttgaacaacttcagcggcaggctcgaaggttacaagagaaaggctggcaaccgaggtggttcaggaaggacgaggacgacagccactgctatcttngggggatactgggaagcgagggaaaaaggaaactgggacgggatcccccatatattcggccagagcagtgcatcgaccgggtagc

SEQ ID NO: 75552 - DNA, 278 bp, Triticum aestivum
  Clone ID: PAT_TA_75552
ctccaacatgagtccctttgttccatgctcgaatgccacgagtcatcatgggcactgcagatgcggaggagtttttccggggcgatctgcttgttcccggccgcgctggtgtcaactacctcgagccactatgaccatcccaaccacgctcacccccctttaagtcatgtgtttctcctaccagatcataacagatgtgaatttttggagtacagttgtgtatcagatccgttcatgattgaaatcgtggtcccccgaaaaaaaaaaaaaaaaaaaaa

SEQ ID NO: 75553 - DNA, 264 bp, Triticum aestivum
  Clone ID: PAT_TA_75553
tcgcgttcctgcgggagtgcgggctacaggattgcgacattgccagctgtgcatccgtgtgccaaggatcctcaaaatcaaccagcagcgcctccgggcgattgtggcatgtgccaaagctctctgtgtgccgcatggctcccggatgttgggacaagcggtgcaggctgtcgcattctttgacgaggagaagatcgccaccaaggtggaatacctgaagaagacatttaggtggtcggatactgaggtgggcattgctttgcc

SEQ ID NO: 75554 - DNA, 336 bp, Triticum aestivum
  Clone ID: PAT_TA_75554
ctcagatttggccctcggtcgttgtcgtgtcgtcctggtcttcagcttccaagggattggatctagtgcgggtgtttcttgcttgggtgtctgttgacggtccttggacagatactttgctggattcttttcttgccatatgtttgcctctatgctcgtcttgttggttgtaattggttgtaatggttgttgcataggagcgtttagtacggccgtcctgttgtttgatggttgtgatgcctttgttaaagccttgggtcaggaggatccgtatatacgtggttcaggctacttttggttatggatattagcttgtcgtgtgtttagattaagtgg

SEQ ID NO: 75555 - DNA, 242 bp, Triticum aestivum
  Clone ID: PAT_TA_75555
aggagatatgatgcaggaggatgaagcatgtaacacgtgatgtgtttagtaactactgagtccaaaccatatttgaatactgttttccctttatcgtgttgttaagctatctgtaatcttgtgtgttttcattgttcttgtactctgtcaatttgacgagtcagttttgtaggactccaccgaagtgcaaacttgttaatgatagttcgtcccaaaaaaaaaaaaaaaaaaaaaaaaaaaaa

SEQ ID NO: 75556 - DNA, 544 bp, Triticum aestivum
  unsure (1)..(544): unsure at all n locations
  Clone ID: PAT_TA_75556
cccgaagggtggacaattgcacgacgactttgcatggcggcgtcatcagcctcaactacccatctctagtggtgctcttcggcagccgcacacacgtccgcacgctgacaggacggtgaccaaagtctctgaacagccgtcagagacgtacagggtttctgtcacggtgccggacggcgtctatgtgaccgtgacgccgccnactctggtgttcaagcagaagaggaagaagatgagcttcacagtggagtgccgcactgatgtggtcaagccggccggggcatgggacttcggttccatcgcatggacnagcgttgaccacaaggtgaccagccccatcgccttcacttggggcaagtgatccattccgttagaatcgaaatttggatgcatgctattgggttgtttgtttatgtacgctgatnagcgacgggaacttggatttcgatgcatttgtttgtttagcatgttccacatccggcttcttaacaatcggttgaagccgattctgtgagtgttgggtgtctttctcacttctcagcaa

SEQ ID NO: 75557 - DNA, 383 bp, Triticum aestivum
  unsure (1)..(383): unsure at all n locations
  Clone ID: PAT_TA_75557
ctgtccgaccagacgagtgttaacctctcaaacaacgatctgtgcggctcgattccgacaaatggtcccttcaagaacatcaattccagcctcgccgacnacccgcggctgggcagcaactgctagaccgatgcacggcggcccgcccgccggagtgaagaataaactggcagtactactactactactagcaagcagccagagaatcgggcggcgcccggttcatgcatgtattacttgggtggattcgtgagtgagtttaatttagctgcgtgccatccatggaatgagttacatatatatacttcccgtacctnacggaatcgcgattaagttgctgctctgctcgatcgaataaaaaaaaaaaaaaaaaaaaaaaaaaa

SEQ ID NO: 75558 - DNA, 471 bp, Triticum aestivum
  Clone ID: PAT_TA_75558
tcgcggccgcgtcgaccgcggccgcgtcgacaagcagtggtaacaacgcagagtacgcgggtcctctcccttaccgtccctagctccatgggaaaccttagatccgtgctcttgcggatcggatgatggcggcggcttgcgtcgtgtccctcttgggggcatcattttggagcagggatcagccggagtgactcgtgtgtggttgatggtagtgttctgtacgggtccggcggcggtgcctttgtgtcgtccctgttgctatgcaagctcaagatcctcccatggctgccgttttgttgcggtgagcttcgtgctcttggtgttgtctcggttcttctttgctccatgacgcgcaagaagcctccccaacctgcttatcgtcccggattcactggcggagctcccagtccaggttcgtgtttggcactcgttgattgtggtgctcctgtgttgcaccgtgggtttggtatg

SEQ ID NO: 75559 - DNA, 362 bp, Triticum aestivum
  Clone ID: PAT_TA_75559
tgcaggaagcatggtaacaacgcagagtacggggacagatcggcagccggccggtggatttcgcaacacaaatcggcagccgatggaattctattcagtgtatgacgtgccgatcgaccagctgctcggagtaccacctgacgagagcgatctccacgaatgttgggaaggttttgggtccaatggaggccaacttgtagctccctattgtctttctacccacgacgagacgccagacaccacgccgcctgagacggagagcgccgctcatacagcggatggaccagagagcggctggaggcgcaagagaggccctcgcaagagaagggttgccgttgtgcacagaccaatcttggcatctg

SEQ ID NO: 75560 - DNA, 275 bp, Triticum aestivum
  Clone ID: PAT_TA_75560
ccaagctcgcccgctacaacaagaagcccaccatcacgtcccgggagatccagacctctgtgcgcctcgtcctccccggggagctcgccaagcacgccgtctccgagggcaccaaggccgtcaccaagttcacctcctcctagaccacttaggcttgatcctcgtcgcttcatgcgttctgtatgtacgtagtttgcagtatgatgttacaatctttgtaaggattgtgttgcttgctcgcggcaaaaaaaaaaaaaaaaaaaaaaaaaaaaaaa

SEQ ID NO: 75561 - DNA, 429 bp, Triticum aestivum
  unsure (1)..(429): unsure at all n locations
  Clone ID: PAT_TA_75561
ccctccctccctatccagctccagccttcctccagtcgatggaggccatgggagcagcgtacgtgaccacaaggatccgtcccagatccgcgcagcgaccaaggagaggtccatgaggtgagagccaccgngccgccgggaagatcccctccgctcactctccgccgggagacctccaatccactactcactcaagcaagcgacggcgatgcagctcgtctccgtgctgggctagacccttgtgccgacgccatggagctctcttggattccatctgctgcctttggctcctggtggttgttttctttctcacgcacgcagcaggtccgtcagtccgtccgtccgattcaattttttttttcatttctgagatcgaaaatgcatgcactgaatgtactcttgtttgagagatggatagagtagaattta

SEQ ID NO: 75562 - DNA, 253 bp, Triticum aestivum
  Clone ID: PAT_TA_75562
cgtggctgaggtatccgggagcatgaacgtagaatcatacaaaccggctggtgcagagggatctgctcctttaaaagaatgcccagtgagatgcaagatccgttgctcagctacttcacacaagaaaccatgcaatttctattgtaactactgctgcaagaggtgcctgtgtgttccgtccggcacggtcggcaacaaggaagagtgtccgtgctacaacaacatgaatacccaggatggcaagcctaagtgc

SEQ ID NO: 75563 - DNA, 376 bp, Triticum aestivum
  unsure (1)..(376): unsure at all n locations
  Clone ID: PAT_TA_75563
tcttttttttaaagtagtataccataacttgttcgaatcctccaaatggcttgtccggtcagcaaagcagtacgtactattaacaacacaaagtgccagtattatacagccggtaacagagccttgtggcaaaacaactcttgcaaccgtttcgatacagctgggacgatngctacgctcagatcaaggtcagccctaaagcactgcagcgccatcatgcgataagcaaagggagcaccgtcggcatgaacgcctcgtacccgaaagtcgcaaaccccgagtacgccgggtccttctacttaaacttctcggtcaggcccttaactgtgaggcagcattcaatgaatttgtcatattcaaccgctttgttcttgcc

SEQ ID NO: 75564 - DNA, 484 bp, Triticum aestivum
  Clone ID: PAT_TA_75564
gcagtggtaacaacgcagagtactgcgggctgccgcttgaacacgacgagctcatccctaacatcgccctccgctccgccatccaggagtggctccagcagcagaacgtggcagtgtgattataacccctccttcaatctgcgccctgatccgccgccgcaccttgcttgcaccgtagaagagcctgtgctcccatcagacggtgtctgttaacgggcgcaacaagcaggcagcatgaccatttgtgtgtacggtagaagacgcaacgggttggtaaaaacggtctgtgcccttcctcaggcgatgcttgtgcgtgccatggcatgggccgcccacaggcgccttccagcttgtcttgcacagttgcatgacacaggacaaggacagagctcggattttagcaacagcagccggccggctggtttctcagcccgtgcgtgtgagtgttttctacattacatttgctttggagcttgggggtctt

SEQ ID NO: 75565 - DNA, 209 bp, Triticum aestivum
  Clone ID: PAT_TA_75565
gcaggaattcgcggccgcgtcgacagcagtggtaacaacgcagagtacgcggggcttcaacgactgctaccctaggtgcaggagccccggcgtgccgcgctggctctgcatcccgttctgcgccgacaagtgcagcccccacaccaaccaggccggcgacagtgtctgctctgccaccgccacatgcaggatggcctgcaagatacaca

SEQ ID NO: 75566 - DNA, 437 bp, Triticum aestivum
  unsure (1)..(437): unsure at all n locations
  Clone ID: PAT_TA_75566
cgcggccgcgtcgacagcagtggtaacaacgcagagtactgcgggcaagctcccctacatgctgctctaccccacacaccttccgaaccacaaggggcgccgccgccggcctcaccgccnagggcatccccaacagcatctccatctaagcatggtacatcggagcttcgtctcgtccacgccaaccacggtgcgtgcgcgtccgaataaagagcgtgcgactcgttcaccgcgtacgggaacgtgtcgagagactagtgcagtgtgtgtgacactgtgtgtgagcttgtgtcagcaattgttcgatcacggtgttttttatttgtgtgttgctcttggccgtgtgcatcttagttatgcataggctggatgtgcttataaaaaaaattagcaataaataaagcatttaggtttccacggaaaccgtgtcatcataa

SEQ ID NO: 75567 - DNA, 339 bp, Triticum aestivum
  unsure (1)..(339): unsure at all n locations
  Clone ID: PAT_TA_75567
cgcggccgcgtcgacaagcagtggtaacaacgcagagtacgcggggatcaggctttctttttgggtcgtcatggcagtcttcacgaacaatggggctgttgccgtatggttgggggctctcatgctcatggctacccttctcgcctcacaaggaaaaccaacctacattggatgtttcgaggccaagcagaactgcttcccggatgaatgtcagaagaaatgcgaggacnatgttggaaaagatacgttaggtgactgccatcgggagcgtgagagtaaaccgtatcctgggcttgagtgttgttgcttccgaaaggacactccaccaaatgataaaca

SEQ ID NO: 75568 - DNA, 390 bp, Triticum aestivum
  Clone ID: PAT_TA_75568
tttcattcttcttctctactaacgacgaccgctccgctttgatccatcagcggcggcgctaatccgtcggaagcgataggggtgttgctgcgtttctgctgtaagatctccgctgcggcggtacacctgcttggactgtttgtagatgcaattttatcgggaaggaccattgggatgtaggctgccggtgcggttgcccatcgtcaaattgatcggacaactttgaagccggcgaggctctttcattcatctgttattttttctctcctgagttttgcatttgagggccgcactgttgttagttggtttatgttggagtagaaaacattgatgcattccttgtaggattataagtctgtatttcccttttgaaatttcctcgtgcatggt

SEQ ID NO: 75569 - DNA, 466 bp, Triticum aestivum
  Clone ID: PAT_TA_75569
aagtatgccatgcccaggaaccataacaccagcagtgggagctttgacacacagtgtaggagcacaagaagcagagacagcggcagaggctttgttcgggcgtcgcagttggttgccaccaggagttcagcgcggtcaggccaatctgatgacgcttcactggcatacaggttgcagcaggaggagttcatgacggctttcgataatgaggggggagagaggcagccacagaacaccatatctactgcccgagcaaatttgagagctatggcttcccgggccgagagggcagttctccttcgtgctcgcggctggcctctttagttttgactgattttcagtttcccagtacctgaatctttctctggaagaatgtagcataagtaccgtggtgtgatcaattacttgtattgtgtgaaagtaaaacgacggccagccagccatatgtgtttcctgtaatacacac

SEQ ID NO: 75570 - DNA, 321 bp, Triticum aestivum
  unsure (1)..(321): unsure at all n locations
  Clone ID: PAT_TA_75570
tcttacccagaggctcatgtatgcttcgggtgcgtaagtttggtgctgcgggatttgtcgagcttcaccggtgctttctttggtacaaatattgttgaggatatagacctgggagtcacccgccaggagggccggattacactaagggtcattgccagaaacccggagctaagttccaagatgatgggccagagatnggctgagacccggatatggcttaaagctcgtagtacaatctttattgttatagtagaacttgtagtataaggcaagtattgtttagagtccgagccggacactcttatgagccggccgggactc

SEQ ID NO: 75571 - DNA, 515 bp, Triticum aestivum
  Clone ID: PAT_TA_75571
cagctcccgcagccatgggaaaggagaacgatccacaatcagcattgtggtcattggccatgttgactctcgcaagtcaaccacgactggccacctcatctacaagcttggaggcattgcacgagcgtgtgatcgagaggttcgagaaggaagccgctgagatgaacaagaggtctttcaagtatgcctgggtgcttgacaagctcaacgctgagcgtgagaggggtatcaccattgatattgctctctggaagttcgagaccaccaagtactcctgcactgtcattgatgctcctggtcaccgtgatttcatcaagaacatgatcactgggacctcccaggctgattgtgctgtgcttatcattgactccaccactggtggttttgaggctggtatctccgaggatggccagacccgtgagcacgctctccttgcgttcactcttggtgtgaagcagatgatctgctgctgcaacaagatggatgccaccactcctaagtactcgaaggcccgt

SEQ ID NO: 75572 - DNA, 113 bp, Triticum aestivum
  Clone ID: PAT_TA_75572
aaaccatgggtggcgtttagagtttagtgccggttgatcagtccactgtatctctcgtagaaactttcgggaagtttaatgaggtcctagagcctggttgccacttcttgcct

SEQ ID NO: 75573 - DNA, 333 bp, Triticum aestivum
  Clone ID: PAT_TA_75573
acacttcgagcgctcctcctgtctcgtcctcgtcccccgtcccccgtcccctcgtcggcgcccgatctagtcaagatagtcgtggcgggagtgctggaggtggtcaaagttctctgggttacctgctttggagattgtgagcctgcaagcctgctgcagcacccgctgcgaagcccgcacctgctgagaaaccagcactggcagctgccgatataacccagcagattccagcttgcattccaggtagcccggcgaacaactactaccgtgcagatagccagaacacgggcaacttccttacggaccgtccttcaacccaggttcatgctgctc

SEQ ID NO: 75574 - DNA, 316 bp, Triticum aestivum
  Clone ID: PAT_TA_75574
gcacaatggagatacgcactcgaagctcttccccttcttcatgaccgggctcatgcctcaggaggccgtgcagtacctcgacctggtgtgcagatgcaccaagaacacccggcatctggtctccatgctcaggtcgctcgcggagcgtctggaggacgcgaacccgtcgataatccacaacaaccccacacgactatattagcacctacttgtaaaatccccataagctttagatccagcaaaaaaaattatttacgtgccacgtaaattgtgaatgccaaccagccctcttcttttctcttgtgtggagtgcagc

SEQ ID NO: 75575 - DNA, 470 bp, Triticum aestivum
  unsure (1)..(470): unsure at all n locations
  Clone ID: PAT_TA_75575
ccctagcgcggcgctccacttctctgctccctcctctcctcgcgcgcaggtcccggcgaaagggaagcaagatgtacaccgccaggaagaagatccagaaggacaagggcgtcgagctctccgagttcgaggacaccgtcgcgcaggctttctttgacctggagaatggcaaccaggagctcaagagcgacctcaaggacctgtacatcaacactgcaatccagatagatgttgttggcaacaggaaggccgtggtgatccatgtgccgtaccgtctgcgcaagcccttcaggaagatccatgtcaggctcgtcagggagctggagaagaagtttagcggccaggatgtggtctttgttgcaacaagaaggattgtgaggccacccaagaagggttctgctgttcagcgccctcgcaccaggaccctnacagctgttcatgatggtatcttggaggatgtcgtgtacccc

SEQ ID NO: 75576 - DNA, 259 bp, Triticum aestivum
  Clone ID: PAT_TA_75576
ctcaaatgctcccaaagttgctgttgccaagaagggcgatgccaagggcccagtgctgccaaggttgccaaggctgtgaagtccgggtcaatcaagaagaccgcaaagaagatccgcacgtctgtgacatttcaccgccccaagaccctgtccaaggccagggaccccaagtaccccaggatcagcaccccttgcaggaacaagttagaccagtacccgatactcaagtacccgcttaccactgagtctgcgatgaaga

SEQ ID NO: 75577 - DNA, 166 bp, Triticum aestivum
  Clone ID: PAT_TA_75577
cggctgcgacggcagcgatcgaggtacaaggttcagcaacgacaggcaggccacaccagcaaggcaggctgggagcatgtaccatggcggagagcatggccgcttcaaggaccaggcttcattcaagatgaagcgcaaggctcatctgtgatatggaaaggttcac

SEQ ID NO: 75578 - DNA, 374 bp, Triticum aestivum
  Clone ID: PAT_TA_75578
ggcgagggacggggcatcccggataagagagtacattctgtccccctacgcgtctgctgttcgatgagcgcggctctgatggagtgttttgacttaattcacgatgtgtgcactacattgatgtgccatcgtcaggtaagttaccaaatgcaaattcagcatgtgaagcctatctgcctatggccgccccttgtgttcttagttggtattcttgcaacccctggcaaatgtgaagaggggtgatctaagaccacgtctaacctcagatcacattttgatccaaccctccacaatcccatctctttcacctctcagtatcaaggtttgacacggaattccggtcatgttttagatcacttgtcttcacattttat

SEQ ID NO: 75579 - DNA, 292 bp, Triticum aestivum
  unsure (1)..(292): unsure at all n locations
  Clone ID: PAT_TA_75579
catagtggcttccatacctatctccggtagaactaaacaaaatagaaacctatgactagtagactcatacgaaaacttgaaagatctatttcattagaagagaaagttcactaatctatggcctagaaagccaaaagaaatgatcagtccaatgacagaaggacagaagcgcgttcccttcgtcctcaatgtgcgtccacagcttactcgagtgcttgagatattcatttggtttaaggcaccttcatcgtangaaggaaaaaacccggatccccgggcggatcattccctc

SEQ ID NO: 75580 - DNA, 295 bp, Triticum aestivum
  Clone ID: PAT_TA_75580
ctcgccttcctcctcgccaactactcctctcctctcctccgcgcatcgcaccggggtcacctaagatcacacacacaatggtgaaggctgtgagctgtgcttaccggccgtgagggtgtccagggcaccatcttcttcacccaggagggagagggcccgaccaccgtgacgggaagtgtcaccggactcaaggaagggctccacggcttccacgtgcacgctcttggcgacaccaccgatggctgcatgtcaactggaccacacttcaaccccgcttgtcctgtgcattgggcac

SEQ ID NO: 75581 - DNA, 233 bp, Triticum aestivum
  Clone ID: PAT_TA_75581
tcgccgcgcggcggaggcaattggtcgtcgggcgggagatgatggacgaaggcgacgacactgagctgcactgcggtgaccagatatggcgcagggccagcggcggctatgttgtcaatttttgcggcggcgaacaaggttgggttgggaaacggacaggataaggtcccgcacactttcatcgttggggctcaaagtgtaaaacacggaggaacttatgccgtctcctcccg

SEQ ID NO: 75582 - DNA, 421 bp, Triticum aestivum
  unsure (1)..(421): unsure at all n locations
  Clone ID: PAT_TA_75582
ggtgcaccggttagaattcacattgaaccaaagaggcactgcaataattgggatttcgagatctgtggatcttttgcagataggaactgcacaataattgattgcactggaaaaatagtggcgcagatngggaagaaagagctgatagaaagtaatgacttctaccacgtgacagtgcagtcaggatgtgaccaggcttttatcattggggtgatggcagttcttgacaacatccatggagaatccaccagatgttaataaaatgaatgggtgaatttgctcacttacagcacctactttagtcttgaagtagaggtcaaacgaatgtatgtccactggcaagtgacaacatcccactgtatcaggctatcagctacactgtatattagatttagccagttttcagaagttagcaagtgat

SEQ ID NO: 75583 - DNA, 552 bp, Triticum aestivum
  Clone ID: PAT_TA_75583
atctgaggtgccaagaatttgtattcgacggtgccggaaagaccattgatttcgggcaacgcaagatcaagcagtgcacatggtaccgtcttcgcaacctcagcctgcaatgggtgatgtcacccctgccgattcacagccaacttaaccattccctggcaatccagctcagctcagtgctcaggagcagcttatgtacgagcagtcgcaggagtatcagctgcagctccagcagcagtgccagaggcagctccagcagttctgggccgagcagcggtcagagatcgagcaggccaccgacatcaagaaccaccccctgccacccaccaggataaggaagatcatgaaggccgacgaggacgtccgcatgatctcggcagaagctccggcgctcttcgcgaaagcatgcgagatgttcacactggagatgacgatgaggtcatggatggtcgccaaggaggacaagcgccggatcctgcagaggagtgacatcgctgctgctgtggctaggactggcatttatgatttcttgctggatttatttaccagcga

SEQ ID NO: 75584 - DNA, 468 bp, Triticum aestivum
  unsure (1)..(468): unsure at all n locations
  Clone ID: PAT_TA_75584
tgcaggaattcggcacgaggctcatcgatcgtgaccgaggagatgttctcgagcatgttcctgcacaaggacaacactgcctgcccagccaaggggttctacaaatactaattctttcgtcacggcggcngagtggttcccggagttcggcagcggcgcccaccacgtcgacgcggacacgcgcaggcgcgaggtcgccgccttcctggcgcagatctcccacgagaccaccggggggtggtcgacggcgcccgacgggccctactcatggggcctctgcttcaaggaagagatcaatgcgtccagcaactactgcgacgccgaaaacaaggagtggccctgcgtccagggcaagtcataccacggccgcggacccatgcagctctcctggaactacaactactggccggccggggaggcgctgtgcttcgacgggctggggcagcccgagctcgtggcgagcgatcc

SEQ ID NO: 75585 - DNA, 136 bp, Triticum aestivum
  Clone ID: PAT_TA_75585
cggctttgcagtcacaactaacgtgatgtggagaactgtctcagtaaactgtttggaaggagaaagtgctacaatccatgagaatggcactgccatgacgggtgaacataacgttgtggtatgtgaaaatgggcat

SEQ ID NO: 75586 - DNA, 488 bp, Triticum aestivum
  Clone ID: PAT_TA_75586
ctcatctgacgactgctctgctcccgatcccatggcgccgtccacgccgtcttcaaccccccggacctctaccaccgcggcgccgctgtctctgcccgccgcgccgccgaggctccctcctgcctggacgcgggcggggacggccacgagacgtggatccgggtggagcggctggagaaggggctgtgtggggccagccggccagtcttcttccgcggggtggccaccgtcgtcgccaagctgttcaacgtcgtcgagcccgacgtcgccatgttcgggaagaaggattatcagcagtggcgcctcatctgccgaatggttcgcgaccttgattttgccgtgcagattgtaggatcagaaatagtgcgagaagcagatggtcttgccatgagctctcgcaacgtccgcctatcgcctgaagaacgggagaaggcattatccattagtagatcactggtaaatgctagaactgctgcgttgaataatag

SEQ ID NO: 75587 - DNA, 525 bp, Triticum aestivum
  unsure (1)..(525): unsure at all n locations
  Clone ID: PAT_TA_75587
ccttctccggctccggcgccggcgaacccaccgcggatcgagcgattcctccgatcaggagaggccagccgggaggaagagcacctacgcgggaggagaggagatggggctcacgttcaccaagctgttcagccgcctgttcgcgaagaaggagatgcggatcctgatggtgggtctcgacgccgcgggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatngggaccgtgttgttgaagcaagggatgagctccacaggatgctgaatgaggatgagttacgtgatgctgtgctgcttgtgtttgctaacaagcaagatcttccaaatgccatgaatgctgctgagatcactga

SEQ ID NO: 75588 - DNA, 461 bp, Triticum aestivum
  Clone ID: PAT_TA_75588
gacgaaagtactggacatactcctccggtataacgtaaaagctactttctataccacggtggtctttgcacggcatgcccctgatatcctggcccgaatgatcagcgaaggacacgaactggaatcgcacagtgtgtatcacggtcagttttcggaggaagacctactggcttcaaaagaggaactggaagcgctggcaggggtgaggataaagggatttcgcatgccccgcatgatgccggtaagtgatgaggcgattgaaaaggcgggctatttattcaactcttcactccatcccacctggattccgggacgctataatcatttatcgcgcccacgcactactttctatgtaaagaaggtattgcaacttccggcctcggtaacgccgattattcgttttcctttattctggattacgtttcatgttttgccaatgtggctttacaatttcttttgcc

SEQ ID NO: 75589 - DNA, 455 bp, Triticum aestivum
  Clone ID: PAT_TA_75589
ccaagacctgcccctacttccaccagctcgacgcgctctaccgcaccaaggcgctcgcatcctcctcctcctcctccggcgtcccatgcgcccgcgcttgcaccagtgccatccccggctcgcgtggagcccgccgcggtcaccgtgctttcgccggtgccgctgtcttcccagacgccgccacctgcggcgcagcacgtcgagcacggggccaagaacgtgatcaccaacggcaacggccatgggaacgggaacggcgcggccatgcaagtgaaggcgagcaacggctccggtgctgcggcgatgttcccctcccccgtccatgccgcaggcaacgccggcaacaacaacggcacggcgacgaacaaactggaactgaagcaagaaggcatcgcgaaggagacggcaccggtgcagccggccgtggccatgaaccacagctaccggcgcaacga

SEQ ID NO: 75590 - DNA, 118 bp, Triticum aestivum
  Clone ID: PAT_TA_75590
gcatttgcagcttatgatcaaggttatgatctttttcttggaaatctccgtggtttggtttcaagagagcatattgatgaaaatcttgcttcctccaagtactggaaatattctgtcc

SEQ ID NO: 75591 - DNA, 100 bp, Triticum aestivum
  Clone ID: PAT_TA_75591
gagacaaacacattcatattgggtagtgtgtttatccttagacctcattctattctaatcttccgctctaaacccatcagatgcctccgagacgtgaccc

SEQ ID NO: 75592 - DNA, 214 bp, Triticum aestivum
  Clone ID: PAT_TA_75592
attggccagaaggactcgtacgtcgtgcgacgaggcccagtccaagcgtggtatcctcaccctcaagtaccccattgagcacggtatcgtgaccaactgggacgacctggagaagatctggcaccacaccttctacaacgagctccgcgtcgcccccgaggagcaccctcgtcctcctcactgaggcccccctcaaccccaaggccaaccgtga

SEQ ID NO: 75593 - DNA, 159 bp, Triticum aestivum
  Clone ID: PAT_TA_75593
caagctagctagatcacgatgtgcttcctctccctcggctgctcgctctcctgctcctcgatcgcagacagctctggtgttgagctccgtgtccgccgccgctggtgctggtggctcgccgccgctggccaagggcctgtcgttcgagttctaccgcgc

SEQ ID NO: 75594 - DNA, 328 bp, Triticum aestivum
  Clone ID: PAT_TA_75594
ggcaggatgctgcttgactacggcaatgcagagcttggcttgtccgatatttcttcggagtgcagaaaagaaagggatacagcatgtccggcatctgggcaaacaacaggccggtgagggatggctctgggtgttcacaagggaactgttcctgatgatggctgaggtgctaccacggcacgccatacaccaccgacatcaggagcagcgtggagtatcaccggagcctgaccagcagaggctaccgtagcctgactctacagctggcgaccacgacatgacggtgcctttcatcggcacccaggcatgaatccgctccctcggcttc

SEQ ID NO: 75595 - DNA, 418 bp, Triticum aestivum
  unsure (1)..(418): unsure at all n locations
  Clone ID: PAT_TA_75595
gagaagagagagagaagatcgacgcgccactggccgtctcagaagatccgcacggcgccattacctgccccggcgaacaagaaaggaccccgaggaggagctcgacgccggcggtggcggcggcgccatgctgtccccgaaggcgccctggtgaacgntgagaggctggtggtcgtcctggcgtcgctgggggcgcgctccagggccctgaagggctcgtacggcaggctggcagccggtcgccgtgtcgatgattgcaaggcggagctgttctacgaccggccgatcccgctggggcggaggtgccgggtgcagcacctggaggagtccccttacctgtgaatgtgactgcttcgttgaggtggcagcggtcgtgctttcgctgtcgagttgtgtgtatgtggaagtggaattgtgg

SEQ ID NO: 75596 - DNA, 438 bp, Triticum aestivum
  Clone ID: PAT_TA_75596
ccgccgtcgcctctccactctcgtctctctcactcactctccccctccgccgccggcgcagcgtcctccccgcgactcccattgcgccagcatgtgtgtcaggcccgaggtgtacccgctgttcgcggcgacgggcgtcgccatcggcatctgcgcctttcccagcctcctccgcaacataccggcaacccagaagtcaggctcaacaagatggggagggcagcgggagtgcttgagaaccatgaggagggcaggcgctacgccgagcatggcctcagagcctatgtgcaggacaagacccccgagatcatgccaggaatcaacaagttcttcaccagcccgaaatgaagcactttagcctgtcagtggctcgctattagtaactgttgtggtccagtgcaaacctatttcaagcattcagtaatgttgtcgcgtcca

SEQ ID NO: 75597 - DNA, 388 bp, Triticum aestivum
  Clone ID: PAT_TA_75597
tgcagtgaattcggcacgaggattccatatgtcctccccctccttctccacctccggcctgccgccacggccaggccggcgtggtggtgcgccacccgcctcccgcctcattcacccatctccatccaccactccgcgacccatccatccatcagcggccaccagcatccaccagcacaccaccgaacgccgccgcgcctacagccatctccctactgccgctgctctccaaccttcttccccaatcttgttgcggctcctaaccttctccaatccccgacgctgctgctcttcttcttctcctgcgccctctgcctgctgctcacatccgttgctcgctgcttctcttcttcttccgttacctctgctgctgctcttcttccccatc

SEQ ID NO: 75598 - DNA, 433 bp, Triticum aestivum
  Clone ID: PAT_TA_75598
tccatatcgtaatgggtcgcgttatccgagctcaacgtaagggagctggtagcgtcttcaaggcgcataccacccaccgaaagggtgcttgccagctcccgtatcacttgattactccgagcgaaacggatacgtcaagggagttgttcgtgagatcatccacgatcctggtcgtggtgctcctcttgccaaagttgttttccgtcacccataccgataccaacacgtaactgagactttcattgctccagagggtctttacactggtcaatttgtctattgcggcaagaaggctcaacttgctattggtaatgttttgcctgtaggcagcatgcctgaaggtaccgttgtttgcaaccttgagtccaagactggtgaccgtggagcactcgctcgctcttcgggtaactatgccaccatcattagtcacaac

SEQ ID NO: 75599 - DNA, 113 bp, Triticum aestivum
  Clone ID: PAT_TA_75599
tgagacttatgaaataagactctcaaggagggacttatagggacttatagttgtaatatggtcttatagagacttataagtcccaggaaccaaacaggtagggactttttagg

SEQ ID NO: 75600 - DNA, 120 bp, Triticum aestivum
  Clone ID: PAT_TA_75600
tcatgggcagcaagggcagtaactggcaacacgaatgggttaccatgttgtagtgaaagtcgtgggcttatgggttcttgactcgtgagatcatgcttactgggctaagggcatctgata

SEQ ID NO: 75601 - DNA, 118 bp, Triticum aestivum
  Clone ID: PAT_TA_75601
gcttgtgtgctgcccttgttctgcaaagtaaagcttgcagaattgggtctcgagtgtcaaaccatggtgtaaagacaagccttgcccctatgatctggggttgtcactaaatacttgc

SEQ ID NO: 75602 - DNA, 395 bp, Triticum aestivum
  Clone ID: PAT_TA_75602
atcaacgacccaacagcagctgcaattgcctatggtcttgacgagaaggctaccagtgtcggtgagaagaacgtgcttatctttgacctcggtggtggcacttttgatgtctctctccttaccattgaggagggtatttttgaggtcaaggccacagctggatgacactcaccttggtggggaggactttgacaaccgtatggtgaaccactttgtccaagagttcaagaggaagcacaagaaggatatcagtggaaaccccaggtctttgaggaggctcaggtacttcatgtgagagggcgaataggaccctttcttccactgccctaaccaccatcgaaatagattcactcttcgagggagttgatttctattccaccatcaccagggccagg

SEQ ID NO: 75603 - DNA, 121 bp, Triticum aestivum
  Clone ID: PAT_TA_75603
ggcacgagggttcacgggcacatttgtgagtcatgttcatcatatacgccatcctggcacatgtttcctggcattttcgcctcaactggaaacacggcctacatggaggtagtctaccatg

SEQ ID NO: 75604 - DNA, 239 bp, Triticum aestivum
  Clone ID: PAT_TA_75604
tgaaaatattgtatggttaattggctactgccaccatacatcaccaataattgctctgcatgaaggaaaacatgtttctgctagtgttggtgcaaagattgatttgtttcgaatacatgcaaggaggaagccttgacgatcaactttcagctgaatcctgcaaacttgattgggacaaatgttacaaaataataaaaggaatatgtgaaggtttactttaccttcataattctgccact

SEQ ID NO: 75605 - DNA, 103 bp, Triticum aestivum
  Clone ID: PAT_TA_75605
cgcaagagacttgttagtgaagacttttgatatgattcagtgatattagctgacaaggataacaaggagtgactacaagaaattttgggagagctttggccaa

SEQ ID NO: 75606 - DNA, 334 bp, Triticum aestivum
  Clone ID: PAT_TA_75606
agcgacgaccatgacgccactgccgccgcggaggaaggagggaccctccctcccccgacgaagcaaagaattgtgggtcctgtaccggggctgctggctgaagccccagacggcggagagcgtcgcggtggtccaagcccagttcgagccgcgccccgaccacgtcttcctggccacctaccccacgtgcggcaccacatggctcacggccctcgccttcgccgtctccacccgccttcgccacggccacgccgtgcgctacagcggccacccgctgctcaccaaccatcctcagcacctggtgccgttcctcgagctgcccgaccgccggctc

SEQ ID NO: 75607 - DNA, 208 bp, Triticum aestivum
  Clone ID: PAT_TA_75607
ctcatcctgctcttccaggacgaccgcgtcggcgggctgcggtgctcggccgcgatggccgcttggccgacgttcagcccgtggagaacgccatcgtcatcaacaccggcgaccagatcgaggtgatgagcaatggccggtataagagcgcgtggcaccgcgtcctggccactcgcgacggcgatcgtcgctccattgcctccttcta

SEQ ID NO: 75608 - DNA, 285 bp, Triticum aestivum
  Clone ID: PAT_TA_75608
ccgcgatcgccggttcctacggatacatcgctcccgagtatgcctacacgctgaaggtcgacaagaaaagcgacgtgtacagcttcggcgtgctgctattggagcttgtcaccggacgcaagccggtgggcgatgttcggcgacggcgtggacatcgtgcagtgggtgcggatggccaccgggtcgaccaaggaaggcgtgatgaagatcgtcgacccgcgcctctcgacggtgcccatccaggatctgacgcacgtcttctacgtcgccatgctctgcgtcgcc

SEQ ID NO: 75609 - DNA, 296 bp, Triticum aestivum
  Clone ID: PAT_TA_75609
cgtgcacgaggacaccgcacgcgtttgacattttccgcccaccaccaccggagggagcgatgctccagtccatggccgccaagtgctaaccgaacggtcagcgacgagtacctggcggcggtcgccaaggccaagcgcaagctccgcggcttcatcgcccagaagaactgcgcgcccctcatgctccgcctcgcgtggcactcggccgggaccttcgacgtggccaccaggaccggcggccccttcggcaccatgaagtgccccgcggagctcgcgcacggagcccacgccggcct

SEQ ID NO: 75610 - DNA, 102 bp, Triticum aestivum
  Clone ID: PAT_TA_75610
atcggcacgaggtgtcgcctgggcagtacctcaagacctgaccgcaagtcctgcgccatcgtcgacccgaggctcaagctacaacacggtgtgtgcgggaga

SEQ ID NO: 75611 - DNA, 384 bp, Triticum aestivum
  Clone ID: PAT_TA_75611
gcttaaagggagagtcatcaacttttttggatttcatcgaacatcaaaaacaacgaatcaaaagaaaatgaataagaaactcttgatttttatttttttttgtcattggcatcagtttttgggtcaagcgtgaggatcaattgatccaagtcaccccaagtgctgaattgccaggtgcaaagggtgttgaaattcattccatctttccaggaaaggcagagcacttcccagcaggaaaggtccatcaattgtggaccttgtttcacaatggagcaactgaatacatgaacgtcacttacattgaagcacaattggtcttgccacaagataactctttttttctccaaaacttcaccaaacaaccatacttcatcaatgtcccac

SEQ ID NO: 75612 - DNA, 241 bp, Triticum aestivum
  Clone ID: PAT_TA_75612
cgtcgtttggctcggcgtggcggggtgacgcgcatctcggggctcatctacgaggagacccggggcgtgctcaagatcttcctcgagaacgtctccgcgacgcctccctacacgagcacgcccgcgcagaccgtcccgcctagacgtcgtctacgccctcaagcgccagggccgcaccctctacggattcggcggctaggccaagcgaatcggcccccgccatcagatttgtgctcgtagc

SEQ ID NO: 75613 - DNA, 240 bp, Triticum aestivum
  Clone ID: PAT_TA_75613
tgaggtgtgtagtgaggaaggtgcctctgtacaaggatctgtatgaggcgtccagccggcagcgggaccataggctcgggatacttgagtttgaggtgcgtcttgccgagaagggccgacttggacttgaggggctcaatgaggcccggccgcaaagtcacgcccaacagaaaggtggtgccggaaccttttgttcctctaacggacaaggatgaggacagcgttcgtcgtgctcttggt

SEQ ID NO: 75614 - DNA, 479 bp, Triticum aestivum
  unsure (1)..(479): unsure at all n locations
  Clone ID: PAT_TA_75614
cacgaggcacacacaccctccttagctagtctctcctaccaatcatggcctacaccggcatcctactgcttctccttgcgacggccgccatggcaggcccaggccacgccggcgcgacggagtacaccgtcggcgactccgacgggtggaccatcggcccnaacacctggcttggtcgcagaagtacaacttcaccaccggcgacacgctcgcgttcaactacgtgccgcggcagcacgacgtgtaccgggtgacgcgggacgcgttccagacgtgcgaaccgacggctgggcagacggtgcgcaagtgggcgtcgggccgcgacgtcgtcgacctcgccgcgacgggggactactactttatctgtaacatcaccggccactgcctcggcggcctgaagttctccgtcgccgtgggtgcgccgccgcctcctccgccgtcaccgcctcccccctcggccttcccgactgccatgccgc

SEQ ID NO: 75615 - DNA, 105 bp, Triticum aestivum
  Clone ID: PAT_TA_75615
gccatgtcgactctgtgcaagtcgacgaccactggccacctgatatacaagctatggagtgcattgacaagcgtagtcatcgagaggttcgagaaggaaacccgc

SEQ ID NO: 75616 - DNA, 525 bp, Triticum aestivum
  Clone ID: PAT_TA_75616
tggcacgtgctgaccatcccctacggcgcgttcggcgccgccgacctgcgcgacatggtcgctcgcggacgtggcggaggacgtgccccgatttggtgggcggaggcggcgacgggcgagcatttccagggtgctggtcgactgggtggaggcgcagcgaccctgagcccacggtggcgagggcttacatagcgccgcggcgaccacgacggcggcgagggggagacggcctcgtgcgtggtgtcgtcgggactgaggctcccgttcggcgaggtggacttcgggtggggccgtccggcgttcgcgtcgtaccacttcccgtggcccggcggcgccaggtacgtgatgccgataccgagcgcgcgcgggggcggggactgggtggtgtacgtccacgcggcgcctgaggtagtgaaggtcatggaggaggagccgacggtgtacagagccccgggtagcagcgacatattcgggtgacgggatgcgccggcagccggcggtatggatgtcttccccgtgtgcgat

SEQ ID NO: 75617 - DNA, 501 bp, Triticum aestivum
  Clone ID: PAT_TA_75617
gagcgtttcgtgttgttcatggagcctgtggaagttgagagcaggcgtcccaaggacactccgtttcggcaacaacgtctcaaggcttgccagcccattttgacgccttttgtggtgattggtgtgtttttgggtgtgggcattctgatgtttgttctcggcttcatcatgtggcactacaatgcgcaggtggtcgaggccacggtgcgctacgacagtgtctgcacgaatcccgaggtggttccagtgtcgcagagcaatccttgcacagtgacgttcattgtggacaagaacattcctgcgccagcctttttctattatcggctgaccaactttgatcaaaaccatcgtcggtatgtcagctcgcgcagcgacacgcagttcgccgggcagtctccgcagagcgcaagcggactctccgactgcactcccattatttcggtgaacaacaacgccaccagttccccgggattttacaatccgtgcggcctgattgccaac

SEQ ID NO: 75618 - DNA, 498 bp, Triticum aestivum
  unsure (1)..(498): unsure at all n locations
  Clone ID: PAT_TA_75618
ctagtcaagaaaggcaacttgaaggactttgtgctggccaaggtggacatcaaaaacgctttcaactccctcaatcgagacactatcttcgctgctgtcgcnaaatacttcccccaaatctacaactgggtaatcacgaactatgactgcgattccttcaaattcatcaatggaaagattatcactgctcagcaaggagttgatcaaggagatccgctcggacccttcttgtactgccttgcaacgcaagcaatcatcgaagagatccaagccaagtgcacactcgacttgaatgcattctatcttgatgacagcaccttcgtgtggcacatcgatnaagtgaagaaagcaattgaaatcttgaagagaatggcgcctgaaatggggctgcaaatcaacaagacaaagagcacattctggggcaaggatgtggaccaagtaccttaaggatattcggtggagaggtttaacattcgatgtcatgtcggccatcatcac

SEQ ID NO: 75619 - DNA, 491 bp, Triticum aestivum
  Clone ID: PAT_TA_75619
agcagccacctcccagagacaagttcaacccttccaggagaagcagagagaagggagaagatgtcggggcgcggtaagggaagaaagggggcccggcaagggcggggccaagcgccaccggaaggtgctccgggaacaacatccagggcatcaccaagccggcgatccgtcgtctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcactgccatggacgtcgtctacgcgctcaagcgccagggccgcaccctctacggcttcggcggctaggccaccgcccgattagctagcctgtgtctagggttcgttgtccatgatgtacttgcagcatctcgctgttgtttgctatcttctgtagaaccgaatggaatggaaattgaactagtt

SEQ ID NO: 75620 - DNA, 430 bp, Triticum aestivum
  Clone ID: PAT_TA_75620
aggagagaaggcaaggaggaaggaaggggaagatgccggcggggcacgggctgcgggtcgcggacgccccaacctgttcgcgcggccgttccgcaagaaggggtacatccctggctcaccacctacctgcgcacctacgaggtcggcgagcacgtcgacgtccaggtgaacggcgccgtccacaagggcatgccgcacaagttctaccacggccgcaccggccgcgtctgcaacgtcaccaagcgcgccatcggcgtcgagatcaacaagcaggtcggcaaccggatcatcaagaagaggatccatgtccgtgtggagcacgtgcagccatccaggtgcaacgaggagttcctccagaggaaactcaacaacgaccagctgaaggcggaggccaaggcgcgcggcgaggtcatcagcaccaagaggcagc

SEQ ID NO: 75621 - DNA, 190 bp, Triticum aestivum
  Clone ID: PAT_TA_75621
ccttgcttctgcttgcagtttctcatacacatggagaagataacatcgccacaatcttcttgcctcaagccagccggctgcggtggcgtccatgtcggccggcgagagcagctgggcgatgcactttgcaaacttcgtggcatcaacagacaacagacaggagatgtatcaccaagggaggagaagcctc

SEQ ID NO: 75622 - DNA, 103 bp, Triticum aestivum
  Clone ID: PAT_TA_75622
aaggactgtccctggcaatataattgcagtccaagctgatatgcctttcaatggtcttacaacatttgggggtgcattcctatcaaagtttgaatgctctcag

SEQ ID NO: 75623 - DNA, 296 bp, Triticum aestivum
  Clone ID: PAT_TA_75623
ggagtgcgaaaatctgtgcgctgtctctctggcggccaatggcactccatgtcgtaccttgatgtggacgtcgtctcccgagcaaagcctcttccgagcccgctgcaaacagcggctgccgatgagctgctgatcgtgtgcgtgcatggcctgacgcgcaatgcgcatgactttgaccacttggcagcatatctgcttcgcgtcatatgcgcacaagcggctgcgcatcgtgtcggtcgacatacccggtcgcggtcactcggaatggctgagcaatcctgcgttgtatatctatc

SEQ ID NO: 75624 - DNA, 205 bp, Triticum aestivum
  Clone ID: PAT_TA_75624
gcaacgatgcgcttccgctgcccggaggccctcttccaaccctctttcttgggtatggagtcggctggcatccacgagaccacctacaactcgatcatgaagtgcgacgtcgacatccgcaaggacctgtacggcaacgtcgtcctgtcgggtggaaccaccatgttcccctggcattgccgaccgcatgcagaaggagctcacc

SEQ ID NO: 75625 - DNA, 213 bp, Triticum aestivum
  Clone ID: PAT_TA_75625
ccccaacacgcaatcttgcatgtttattatcaggttatgtcatcggcatggtaaggtggcagaagcactagagctgtggggcgatatggtcgagaacgggtctggatcattcaccttggtgtcagatgttttgtttgacctgtcatgtgatgagggaaagctggaggaggctgagaggtgcttccatcagattactgatttggggcagaaacc

SEQ ID NO: 75626 - DNA, 361 bp, Triticum aestivum
  Clone ID: PAT_TA_75626
cggcgtgggagtggtttatcatgacaaaagagtaattgccttcacacccggccctgccaggaatgccccggctccagatccagcatcttaccaaaaagcttactacttccttcattttgttccctcctgctggccgccgtgctcactgaagcgtgtgagatcatcgccgcgcgtgtgctccaactggaccaagatggccttgctcggccactacatcagattcagaagtggtacacctgggcgctgcacagatgcagcgctggacacggtgctgcgtctcaggccggcaaagcgtttgagtgacaaaatcgggcagaactcggtgctggagccccgccgttttgggaggcggtcggggctt

SEQ ID NO: 75627 - DNA, 408 bp, Triticum aestivum
  Clone ID: PAT_TA_75627
ctcagtccgccgctactcccctgcctcccccagagctcgttagggttttctcttttttcgggggagaaatctcaagaagggggcccatgctcgtgtccaggaacagctttccggcgacgagcttctgtcggattcgttcccttacaggggagcttggaagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacct

SEQ ID NO: 75628 - DNA, 129 bp, Triticum aestivum
  Clone ID: PAT_TA_75628
gtcgtttgttgcacgcagaggactcgatatgctcaagagccatgtggagattgttgtcaagttgaagtggctcaacatttagaccatctagtaagtcatacactacatggtgtgatggtctacacatgg

SEQ ID NO: 75629 - DNA, 359 bp, Triticum aestivum
  unsure (1)..(359): unsure at all n locations
  Clone ID: PAT_TA_75629
ggatgaggataccatggatgaggatgaagaatccgtggcagccgtccacttccttcttttactctttggtgaagcgccgcggtctgaagttttcaagacaatcatctttagcaccatcacaaaaaaagttaagcagtgtcagccaatcgatcttgtctatgactcgcttgctaaaaattggaataagttgtgcaaatgtgcctgctatctatggctgatggttctagaggctctcatggaaacaaacttaagggttgagagaccaaatgtaatanaaccggctgaacctcatcacattttggtagatttgtttaaagaaatgacaatacacaaacgaaaggcacaaaaaacaaaaaaaa

SEQ ID NO: 75630 - DNA, 104 bp, Triticum aestivum
  Clone ID: PAT_TA_75630
agctatggcgctgcgcaccgttgccgcgaagctgaaggcccccgatcgcctctctcaagcaggcttgggcggtctgccgtcctcaggccaagggtcccaagctc

SEQ ID NO: 75631 - DNA, 498 bp, Triticum aestivum
  Clone ID: PAT_TA_75631
ttcctcgtctcataggatctctatcttgaggagatcgatcatggcctaccctccctcctgaacctcgtagcgcaccccgccgattcattgaggatttgaggttgagggcacaagaggcatgtcttgttcagcaactgggatggaaagcagatcagtccccaccctcgattcatagaaacacaaggtttactgaacataagaggtggcttaaatctagtaactattaaggtttcaggtgtggatgcgtgcaatatttcaatgtagttctccaccattactaccttgatatgtaatggaccagaatttcagtgcacgagcgaagggaaatagattctgctgcacataaggtatatatccattcccatataccatatgttcggaatatgttgctcccatggttatgtatctactggtcgtcttgctaaatgttgttgaaaacaagaatgttagtgcatgtcagggagaaaaaacttctgttgcaaaccagcggtatccttt

SEQ ID NO: 75632 - DNA, 510 bp, Triticum aestivum
  Clone ID: PAT_TA_75632
tcagctgtttggcgagatccgaggcagagcaaagaaagaattcagacattaggttcaataaagatggcagtcttgtggcatgccaggtggcagggaaaactgctgacatctatggattcttgatgaaacagaggcgacacggaaggccaagaggcggctgcacaggaagaaggagaaggcttcggcgaaagctgcggcagcggaagggaatggtagcgttatagatccttcgccagctcaagactctcagaatcccactgttgtggtcactgatgtatttaagcttctccaagttttgcggaccagcaagaaaatttgctctgttgcattttctccaagcaatccaccaaaaggctgccttgcgaccttgtctttgtctctgaacaataacgtgcttgagacatactcggtggattacgagaaggtgtctaagatgtactcagttgagatacatgggcatcgttctgacatcaggagtcttgcgcttaactcagaggataacctcctgat

SEQ ID NO: 75633 - DNA, 462 bp, Triticum aestivum
  Clone ID: PAT_TA_75633
cccatccccgtctcgcgtcgcagcggcagttccactccctcgccatgggcaagattaagatcggaatcaacggtttcggaaggatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgagg

SEQ ID NO: 75634 - DNA, 257 bp, Triticum aestivum
  unsure (1)..(257): unsure at all n locations
  Clone ID: PAT_TA_75634
cgccgccatgggacactcgaacgtctaggaactcgcaccccaagaactacggccccggatcgagggtttgccgtgtctgcggcaactcgcatggcctgatccgcaagtacgggctgatatgctgcaggcagtgcttccgcagcaacgccaaggacattggcttcatcaagtaccgttaagaatggaaacctcaaaggaagcaaggactagganattatcaacgaactgtggtgcttcatcgaggctgatctttatcc

SEQ ID NO: 75635 - DNA, 512 bp, Triticum aestivum
  unsure (1)..(512): unsure at all n locations
  Clone ID: PAT_TA_75635
gatatggctcttctgtgtcctgaagaagcaagttctgtagcaagagaccccgttgcctgaaaaatctgatggntataagtctggcaatgttattgctggaaacattcctaaggctgcacaagatagtgaggagcgtagtagtgagatggatttagctgatgagatactctttgagaagcttgagactcttcgagccgaaggcctgaaaaatccgagggatattattgaactccttgtaagtgcccttccatggctggaaagtaacactccagcagggattgataaacgattgctggacgatgtcnagcgcatctgcagtgagtttgaaaatggttctgacagggtgaggggaagagcttttcttgctgtggagaagctgcgcaaaggtgagaacaaactgcagctgatcctcagagtgctgactgaagcaagcctaaggaggattgaaagcgaagcgacgaanaaaagcatgaatgactggagcagcggtgctgctgtccagcctcacgccg

SEQ ID NO: 75636 - DNA, 426 bp, Triticum aestivum
  Clone ID: PAT_TA_75636
ctttcactcgccctgcagtgctggagacgaagcagaggttacttaatgtcagctacaatatccgctatgttgggcgttggtcactagcaacatttcagcggcaacagatctcggcggaaggtgtttatgacaccgagacaggctccttgtgcctgatcgcatgtcgacgggttaatgtctcctcctcagactgtaagattttgataactgctcactttgctagtctggacgctaaagcagcaaaacatgtccagggggaaaattataagcttgaggggcaagaccgaccctcttttctttgaaacgcttggccttgattcctattggatgttcataggccaagtggaagaatcaatattgagaatggacttggaaagcaccatggccctcatctcaatgactctgtcgtgtgccttcattgctgtg

SEQ ID NO: 75637 - DNA, 134 bp, Triticum aestivum
  unsure (1)..(134): unsure at all n locations
  Clone ID: PAT_TA_75637
ggctttgtgtaaaatcattataagtatagtacctctttagaggagtttaacgctnaactatgtatgtgattcatgtacctgaagtatccactatgatgcctattgccaaaaaaaaaaaaaaaaaaaaaaaaaaa

SEQ ID NO: 75638 - DNA, 167 bp, Triticum aestivum
  Clone ID: PAT_TA_75638
caccctccggaacatgctcacctcacctggtggtttcgcggagacgcgcgagggcgaggtgaggttcccggagatcagcaccgcgatcctagagaagatctgccagtacttctactggtctctccactacgcccgtgggaaggagacggcggagttcccgatcgagc

SEQ ID NO: 75639 - DNA, 192 bp, Triticum aestivum
  Clone ID: PAT_TA_75639
gaaaccgaggacaaggggagtgatggggaagattccgaggtcgacgatccatggagagagagaaaggggaccgacaaggaagagtctgaagttgatgataagtgaaagagatcacaacatttgaaccctggttactagtaactgtactgtaactccattttgttgtgtcacaaacgagaagttttggtcatg

SEQ ID NO: 75640 - DNA, 526 bp, Triticum aestivum
  unsure (1)..(526): unsure at all n locations
  Clone ID: PAT_TA_75640
gctgaaaggtctgtttctggacggaatggcgtaccagattggaatgctaatactaaagagtttccatgtcctgactcgtccatgaagtggtccgacctaacctctgccctcaaatgcctatgctcacccnagcttgtagatcacaaataccttgctagtcaggctgggctctgcttcccacgggaactgatgcttaactcagccctgctcggcggggcagctggctgcccatctccatcgcccgcctcatgcttactctgtctgcctcatcctccgtgttacattctttcctccaacagcaaggtgtggcttggctttcggttctgttttgccggcgagaatggtgaaggctttggttaacatttaagatcagcgtttaaacaggcttctactgtgcagcctgtgttatatcagtnaataaatggaatttaatttccatgccactagttgactctgaaactattaatgtgccattgcttttctcccatttacgagaatgccatattaaagattaaagaaaatggag

SEQ ID NO: 75641 - DNA, 488 bp, Triticum aestivum
  unsure (1)..(488): unsure at all n locations
  Clone ID: PAT_TA_75641
gcggcagttccactccctcgccatgggcaagattaagatcggaatcaacggtttcggaaggatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacnagacgctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgcccagaaggtggtcatctctgccccaagcaaagatgcccctatgtttgtggttggtgtccatgaggacgagtacacctcagacgtttacattgtctcaaatgctagctgcacca

SEQ ID NO: 75642 - DNA, 474 bp, Triticum aestivum
  Clone ID: PAT_TA_75642
ctcccccaatgatccctcctcgctttctagccgccgctcatgactcccccctccggcacgcaagctgtgcgacgacgttctcgtcgacgatgagtgcgaaacctgtgtgcgaagagggaaaatcagggaaggtgggcaggggccggtcaacctaggctcaatttcggggtctttcatggccacgcccgggccacttgcgctctcccccctcctgaagcgcagctgctgtttttggggctccgctcggagaggactactaccggctgccggccaacggaacaccctcctgggcctattcccttggagaagaagaagaccccttccgctttagatccccaccaggtgggtctgaggtgaccatgcgatttctggacgttcatcgatcggtcattttgttcgtgtttctgtcctccggcccgtcgggctgctcaacttcaagaaccaaagccatactgttattttgtctgatattca

SEQ ID NO: 75643 - DNA, 602 bp, Triticum aestivum
  Clone ID: PAT_TA_75643
cagtggagcctgctggaggagtcatggggtcgaggacctcctgctcaacagtacaacttcttgttttgtggccggtcactcaaggagctgagtgcaggccgcagtaagtacatgattactaatattaggatatgtatggtcccagaaaaaacatttgtcgggtttttggtggccaagtattattgatatggagatgaataactatgcggatgcgctcctgttgtttttctgaaaaaaaaacaagatgccatgtttacacatccatatttaattttggaaggttcacacatccatattagagagattcatcgcacataattttgtaaggtcaaaaaagcaattgctcagtacatcacaacaactcttcgatgcaaaaaggatggctcttctcaacaacttcagggtagctcagtcaaatatggcagctgtgcagtagtttcagttgagaaatcagcaagcgccatgctcagtccaaccccgtggttacagggtggccgagttcgtcgcgaccatcagttcggagacctgcgtcactgcgcgtgtcgctgccatggccacctgtgtcattgcatgctccgtcaacagcctcctgcacaaggaaa

SEQ ID NO: 75644 - DNA, 512 bp, Triticum aestivum
  Clone ID: PAT_TA_75644
atagaacataatttattatgtgaggcatttgccattacaacatcttgtccaggccatgcttggcatcgcctcgtcctggtcttcggcgctcctacaggaactgagcgccagtgtggtcgagccaagtacaacaccaacaagcgacaacagcgcaccaccctggggtgttaaaagggactcgaagcattttcatgtgtcggagcagtggtaggtggcatgtgcagttgaagcttattttcttgcatgagtggtgaagaaaatgagtgacaaggatgatgagaataaagggagtgcaatgtggttattgaagaagggcaaggaagaggaagacacatgttggtcgggtgaagtcagcagcgatcgctatcagtgatgttattggccaaataggttgtctaaacattttgctaggtctccctcagggatgatcgtgtaaccttgtttcaagtagatcaacagaagtgggctaaaagagtgtcatattacaacagatcagttggtgtgaaactaga

SEQ ID NO: 75645 - DNA, 196 bp, Triticum aestivum
  Clone ID: PAT_TA_75645
tctgggtgtttatctatgcccgaaacttctaacttgctaagcttgcttcatgagaagcacttgtacagctaggcagcggcctgtgtgaaatgattatatgtactgtacctaattcctaggtatgttctaaatacatccatttttatgcatttctcgacgagtatttccgaaaaaaaaaaaaaaaaaaaaaaaaaaa

SEQ ID NO: 75646 - DNA, 642 bp, Triticum aestivum
  Clone ID: PAT_TA_75646
gtcccacttctcttctcctcccagatgtcaccgacgagctggatatttctctccccttccagcgatactctttcttcttcattcttctccctcgtccccttcgcgagctgcattcaaatctgcatcaccacctctcctattctgtcgcccacctcttccccaacgagctaccgctgggctccggcccgcaccgtggtgccccttcactatccatcaacccacgcgtcgccggtgctctggacgaagcacgacgccgacgaactgtcactgcacatgaagcccgggcaatgacttcggagatgaaggccagcggccaggcaaggaccgatccgtcgagctcttctccaatcattttctttcctcgcatattctctctcagaagtttctttcctcgatttttctctagaggttccctggtatttttttgtatgagattatagcttgtttcggtgagatcttctccaagttattcccattcctcatctttttctctctgagaagtttatttcatcgatttatctctccatgattcctgtaactttctgtacgagtcatattgttccgaagagtttttctcaagttgctttctttgctccttttttcgctctccaaagtttcctgggatttttatgtgagaaccga

SEQ ID NO: 75647 - DNA, 534 bp, Triticum aestivum
  Clone ID: PAT_TA_75647
atgtgatatatagattcttcccttgcttttaactgattgccagaaactgtacatccctggttgacagtcatgaacttttattgttggtaatctaaaatattctgcatatttagtgtccaaatacagtccaaagataaatcttagctgtaaatattctgcatatatagtgttcaatttgatctataagatctgagtttattgtactattaatgtttgctgcatatattgctgccaatcatgtttgcttagatgtttggcttcctacttttgtattgttttgtaatggattagtgaccggcctaaatgcttatatacctgctgatgatctacgttgccttgcatgttatggatgtctggtccctgcaatcgagcatgtactatttaacccccgagagctaatcacgcacacagggtgctcatgtgtgctccggattaagtttcctggtgttgttctgttggctcgtctcagtaggattcagtttggtgagggttgacctgattggtgatgctgtattattgtgtctgtttgacttg

SEQ ID NO: 75648 - DNA, 169 bp, Triticum aestivum
  Clone ID: PAT_TA_75648
acacgccgagtctgagcgattcgtgccaccattgtatgtaaaaaaaaacgcttgctcaattagcgttagacgttgtgtgccactgccacgagaggatcaatcccctccttcgttttggaactagtgattgtcgataaaagtgcaatgaagttgttctaaaaaaaaaaaa

SEQ ID NO: 75649 - DNA, 397 bp, Triticum aestivum
  Clone ID: PAT_TA_75649
gcagcagcaggcctccgttattgtcacaggtctccaccactttttaggttcttcattcatgtaaatacttagcctttactaccttatagcagatgtatgtctcgcgtttccgtccgcgaaaccactagtatgtgaaaaacaaccgccgccacggaagggcatcttcccgtgcgcgataattgtcggagaaaggctttggaatggatttctctttcctgtagaacgaacgttgtgtggaattgccgggtctgtgtgctgtgctttggtatcagaatccttcattgtccatcggcgacaggccttgccatcatccgtctcaggttcttcatgtaaatattcagcttgggctgccttatagcattgccgagtctcggttccggtccgcggaaccgcctgt

SEQ ID NO: 75650 - DNA, 157 bp, Triticum aestivum
  Clone ID: PAT_TA_75650
cgccgagaaggacaaggggaagaaggcccccatctcccgctcgtcccgcgcggggctccagttccctgtgggccgtatccatcgtcagctggagcaaaggactcaggccaatggccgtgttggtgctactgcggcggtctactctgctgctatcctg

SEQ ID NO: 75651 - DNA, 506 bp, Triticum aestivum
  unsure (1)..(506): unsure at all n locations
  Clone ID: PAT_TA_75651
gattattttggtcattgacagagatctgattggtctggtcctatcttttgtaggcagcaggactctgctagaagaggtcaacgagaacaacatgaacttggagcctcttcattacccttgacgacgacgccgtgtggagttgccggcctgcacggcgtcaatcgccaacgaccagatttgcgctgagggcgctgttccaagggcaggcagtgcagataacctcaagcttcagagcactacatcgagcagggtccgggttggggcctctgcgctaggcagagccccatgtgctgataggatttcagcgctngagaaaattgttcaaaggagacagagtgcatggtgccacagctcgcaatgatgacggttgagctaatgagtcagggaatagcctagtgggattattgcctccaacaaagaggaaggagatgggaaggcctacaagcagagagaaggccttgtacgagggtttgagcattaggacaagattcagcaccatttgtcgg

SEQ ID NO: 75652 - DNA, 361 bp, Triticum aestivum
  Clone ID: PAT_TA_75652
ttgacgttttccttcccgtctatcgtggcgtcgagatctattgcccaactcccgagggcacgtcggatgtgaggaagaagagaagagggggagagaggtgcctctcccatcttgcgcccatgttgctgtgcaagtggagataaggctactccatccccgccctgcacgatcgccacgggccccccatccgtggtggctttccattagacttcctcttcctcaccggcggggtgaactgactccggggttgctgcttgactggaatgcgcttaaaggaaccaaggagaacaggcttgaagatagatcgtgaagatccagtttattgatagaatcctaaccctcctatatctttcgtcgacca

SEQ ID NO: 75653 - DNA, 135 bp, Triticum aestivum
  Clone ID: PAT_TA_75653
tcttcgagtacatcatcatcggcacacaggcgtgggcaagtcatgcctgctgctgcagttcaccgacgagaggtttcagcccgtgcacgacctcaccatcggcgtcgagttcggcgcccgcatgatcaccatcga

SEQ ID NO: 75654 - DNA, 295 bp, Triticum aestivum
  Clone ID: PAT_TA_75654
aggtggtggccgggtgcatgcactacttcaccatcgaggtcaaggaaggcggcgccaagaagctctacgaggccaatggtgtgggagaaggcctgggagaacttcaagcagctccaggacttcaagccggccgcctgaaaagatgtaaataaatatgttatgtgagctgaaccgctcaagcttgtggatggggcctatccaacacgcctgcctcactggatactggtgtaatatgatgaaataaacctgcttcctgccaaaaaaaaaaaaaaagaaaaaaaaaaaaaattttccc

SEQ ID NO: 75655 - DNA, 252 bp, Triticum aestivum
  Clone ID: PAT_TA_75655
cactcttctgcaaggctgtgcatgtggtgctgcatccgtgtacatttccaggctgttaggagcgcgcctccagaggccaagtgtcctgtatgccgagaggttggtgtctttgcccatgccgtgcacataaatagcttgacttgctcatcaaaaccaggcgcaaagataactggagatgcaggctacgcgaggagcggaccgagatggtgaagcaatccaaagaatactgggagtcccaggccatgctttcga

SEQ ID NO: 75656 - DNA, 186 bp, Triticum aestivum
  Clone ID: PAT_TA_75656
gatgctgcgcggcgctttgctgctgctgcctcctcgacgcctgcttctgcatcgacttcgctcccactgttgttccaccgtgcacatcggcgccgcatgtgagtgcattttgcttcttttttgtatgcggttgacgtgctgagttactagtcccagagcacgattttctcgtgtgtcatgtgtgcg

SEQ ID NO: 75657 - DNA, 327 bp, Triticum aestivum
  Clone ID: PAT_TA_75657
attcatgaaggacaagggaaaacatggttgaatttcttaatatgagccaaaaagagccactctcattattgtcattctttctagattcatgtgttctgtttgaccatggctgtgatgatgaacacttgcaacaaacatgccagttctgcttctgaaaattcatgactgaaaaacatgtcatacaagatctgtttagtactcatgtattatggccgtggcttatttagtctgtgcttgctgtgccttgtgtattggagcctaattcgcttttgttaggggataatctactggttatagcacgattttactcttgtgctgtggaataga

SEQ ID NO: 75658 - DNA, 102 bp, Triticum aestivum
  Clone ID: PAT_TA_75658
cctcttcttcacttcgcagaatcgctagtcttctcgtcctctagttaagtccctacgacagcaataggaggaggcaacgactgtcataggtgtacccacccg

SEQ ID NO: 75659 - DNA, 339 bp, Triticum aestivum
  Clone ID: PAT_TA_75659
tctccgcgatctcaccgggaaatcctcgaccgattgaaagccaagccctctcgtcctccttcaagatgcagatcttcgtgaagaccctcaccggctagaccatcaccctcgaggtcgagtcgtctgacacgatcgataatgtcaaggccaagatccaggacaaggagggaatccctccggaccagcagcgcctcatctttgccggcaagcagctagaggatggccgcaccctggctgattacaacattcagaaggagtccaccctccacctagtgctcaggcttcgtggaggcctgcagatttttgtcaagacgctcaccggcgagaccatcacccttg

SEQ ID NO: 75660 - DNA, 207 bp, Triticum aestivum
  Clone ID: PAT_TA_75660
aggccggcatcctcggatgcggattgtgatgcttttgctctggagaatttcattgaagctggcagcaccctgaaacttgttacttatggtgaaactacaacaaccttccttgcctcttgaaattcttctaaggcggcgctgccaaggtagccactaacgcatcttgctttggtacagcttcattgtaacttctatcagccataaatt

SEQ ID NO: 75661 - DNA, 470 bp, Triticum aestivum
  unsure (1)..(470): unsure at all n locations
  Clone ID: PAT_TA_75661
gcgaacgaggaggcggagatgcgcaaggcatgagtaggaaaaacgtgctctggtcccctccaacggcccgccggaactccctaacatgtgtcagtgccatacttctgtacataaaacgattgaaccggcatcaatcacttgaacgggcatgttgatttggttttcctgtctatgtgccttgagcatttcttcctctacaccaggcaatgattgaggattcacggcatatattgagatcaacttttcgatgcagtttggatcatcaaatcacactactatctgagcatatataagatgttcgcacagtacgttttaatgctncatttttaaatgttcataaggtttgtgaacatacgatttactacatgaaggatgtgcctggcttccatgttgaagtagtaggactatttccacatatgccagagaagaactatgatcggaggtactatgtatgcttgatccaatttaga

SEQ ID NO: 75662 - DNA, 287 bp, Triticum aestivum
  Clone ID: PAT_TA_75662
tggaagatcgaagggacagagcagccaagcggggctggttcggagcttgattcgcgcgcttatctgaactcagcgcctgcattcgcgcaccatccactcggctccagcaactgcttccgatcgaggcgaccctctccaaccaaaatggagataacctctgatctctgatgctccacggtagccacgttactcacgacggcggcctgctcagctcagttgtctgcgtctgcatacggggtcggacgccctgcaggttttcgatgaattgcctcagcagagagattgcg

SEQ ID NO: 75663 - DNA, 400 bp, Triticum aestivum
  Clone ID: PAT_TA_75663
aggatcgggaggctcgtcgccagggtcgccctccagagcgacgattcgagctcgtcgccgtcaacgaccccttcatcaccaccgagtacatgacctacatgttcaagtacgacaccgttcacggccactggaagcacagcgacatcaagctcaaggacgactagactctgctctttggcgagaagccagttaccgtctttggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcagacgt

SEQ ID NO: 75664 - DNA, 512 bp, Triticum aestivum
  Clone ID: PAT_TA_75664
gctaccggaggatggcccgcgtctaccctgactcttctcaccttgttcaatctcgaccagcaccaccgccacttctttgagctcatctatgggtgcggggaagaagatggcatcgaggtgctgacgtaggccctggctcggggaggcgacctccatcgccgccacgagaggagcaggggtggaggctgctcttgggtacgagaggagcacatcaggggagcagggatggaggctgctcttgagtaggccatgggacgccgaatcgagtgaaggccgtcagagcgagcacgtaatggctttctgtgattttcttggctgatttgggtgtgaatcgcgcggtcgtcctgtaaagcacgccgccgcaggggctctacccgcacccagacgttgacctcaagaagttgcgctggctcatcctcaagttctatccgagccttagctgatcaagtgctgcgccaactggttcttgtggatcgtgttggtcgttccggggcattggagtgggccaacta

SEQ ID NO: 75665 - DNA, 117 bp, Triticum aestivum
  Clone ID: PAT_TA_75665
cgaagatggaaggtggcggcgatgacaccgtgggtccgggctctcaccagcatgacatgacgtgcgccaaagatgcttcaaagcgttcgccgcattgcatcatatcggcttcggcgg

SEQ ID NO: 75666 - DNA, 307 bp, Triticum aestivum
  Clone ID: PAT_TA_75666
taggacactggcataaataacaacactctaatgtccagcaaggtatggtcgtggcgcagaagaggggccagtgagtgaggacaaccagccaagaggtaaacaaccatcctaatgcccagcaaggttttggtcgtggcgcaagaagaggggacagggacgaggacaacaggccagcagggaataaccattgccagcaaggtttcggtcgtggtggaagaagaggggacagggacgaggacaacaggccagaaaggaataaccattgccagcaaggttttggtcgtggtggaagaagaggggacaggga

SEQ ID NO: 75667 - DNA, 381 bp, Triticum aestivum
  Clone ID: PAT_TA_75667
aatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctaggaggaacaagctcgatcaatatcagatcctcaagtacccgcttaccactgagtctgcaatgaagaagatcgaggacaacaacacactcgtcttcatcgtcgacctgaaggccgacgagaagaagattaaggccgctttccagaaaatgtacgacattcaggccaagaaggttaacaccctcatcaggcctga

SEQ ID NO: 75668 - DNA, 185 bp, Triticum aestivum
  Clone ID: PAT_TA_75668
tacagactctgcgttctatatatgcttttgatctccaatatgaatcatatgttttttttccctcgcgatagcgtagaagaaccaactcagcacacgagtagattcagtcgatgagagggtgcatcgtcttgtggagaacagaaatgtttgatcataatgcagtttgtctgcaattttctgaaaaa

SEQ ID NO: 75669 - DNA, 196 bp, Triticum aestivum
  Clone ID: PAT_TA_75669
gacgggcagatatcgcgaaaggaatactcatggtttctgaagactgaccatgctccctcgagtactacgcagcaacaaactcagtaaaaagagggctcagacatggcgacgagaatgaaggtagagggaaaggagtggagagaaagtattctggaggttgatttgaataccccgggtatagtaggtatatagcata

SEQ ID NO: 75670 - DNA, 176 bp, Triticum aestivum
  Clone ID: PAT_TA_75670
tatttgcttggtgcagtgataaattgggtctgagtcttgagttgggttcatttgcagctggcgttatgatatcaacaaccgatcttgctcaacatactcttgaacaagtttgttctttctgcagattgaaccgattcgaaatctctttgccgcccttttccttgccagcattggga

SEQ ID NO: 75671 - DNA, 469 bp, Triticum aestivum
  unsure (1)..(469): unsure at all n locations
  Clone ID: PAT_TA_75671
ctgacgggaattgctttagtgctgaccctgaacaccagcatgaggctaactattgtcaacaaccttatgaggggagaagatcaggcaaggattttgggcttgtggttactatcgtcggtatagtgctgattgtgcttgttctttctcttctattagtggcatctaacaaaaggaactgtcagagagttacggcagaacaacaattgctgcaaaagcaaatgcaagataattcgactccaggaatgtcctccgaactgctagaaagtgcaaggtacatatctcaggctgtgaagtttgggtcgcaagtnatgcccacacatcgtgtattttctttagaatagcttaaagaagcgacagaatgctttgaacgatcggcattttttaggccagggatccattggaaagctatacgagggaaaactagagaatggaaccgtgattgccataagatgtttggcattgcaccaga

SEQ ID NO: 75672 - DNA, 152 bp, Triticum aestivum
  Clone ID: PAT_TA_75672
atcgatagcctgcaaaagaagagtagccgtcgtcgtgcactggtcgataatggctccactgtatattatgttcttgtcgagtttctttgtgtgggctaaggtggttccactgtgctgtgtaatggtgatgtacgttccttgagctgaatagc

SEQ ID NO: 75673 - DNA, 498 bp, Triticum aestivum
  Clone ID: PAT_TA_75673
gtgttcttctcaagggacattgcatgatcaacaacaggtactatggatatctgatgatggtattcctgatttaggcggcacatataaaggagatacatgctttgctgatgaagtcattcaacctgcactaacatatcctggcgcttataggaggatttctgttgagcttaagattcatcatttggcggttaattctctccttaagagcagtcaagtggatgaaatggaaggaggatctatcggcaactttgaaaatgatattcctcctggtccaaatgccaccgagactgactatcatgacgcccgcttgtgtctacctgctttccaagtgctgaagcaactcattcaaagatgcatctcggatgcagtgtcttctggaaatgtatttgctgatgcgatattacgacatctctaccgttggctttgcagcccacgatcaagacttcatgacccagctctccatcgcctccttcataatgtcctgaagaaggtctttgc

SEQ ID NO: 75674 - DNA, 491 bp, Triticum aestivum
  Clone ID: PAT_TA_75674
tacaggccgagctcggatccacacaaacatcctgccctgagaggatccggccctcttctccccccaaattgcagcgaccagggacgccatcttgaaggaggcctccccgccgccgagcttggatccaccgcatcaacccgcccagcgagcaccctgacgtcttttccccagcacctggcgacgtctctcggaaggggctttgagagatgaagaggaagccaccctttctatgtcctacattacacggatacttcaaaaagtgcgcgtatcctgccggatactaccccgatactcggatactgccccgatactgcccgatacgtatccccgccgccgcacgtcatcctcgtcccctcgattgaaaactggccacctcgtcccctcgactctttggagcaggcgagcagccacagcccacaggtctccaactctccataaatctcagctccagtcctctcctctcccacatgttcttctccgactctccatcc

SEQ ID NO: 75675 - DNA, 569 bp, Triticum aestivum
  unsure (1)..(569): unsure at all n locations
  Clone ID: PAT_TA_75675
ggagcgagtgtagatgctacgatggagccatggagattgtttgaaattattaggcactggccctcttcaagtcctactttagtgcaacggtgcagagactatgcacttcggttatcctcataatcccagtaccataaattttgaagttaaatataacccaggaaggcgtacggtcaccattttcctccaaggtcagagatatataaaaaatgaagttggttgtattggatatacaaaaaataaatatgtatgttcctatttattttctagggagagttctaatatgtgacgtgacaggaaagatcctgatgaagtacttcctttttgggatgcctatctgaagttgggactaaatgacaagatttaattggcttagtagataaaaaacttgctaaagaaaaataagattcaaaatagatgtttttattatagatgaggattcgtgtgttctgccaccgggttgacttctcatatcagaaggcaagccgttngttcatatcatgctactttccactattgtagtgagagagagagagggattgagaggctcctactttttgtattgttgt

SEQ ID NO: 75676 - DNA, 277 bp, Triticum aestivum
  Clone ID: PAT_TA_75676
aaaggtgtttagattttgttaaatttttgacatctcatcattttttttggtgcaccggttcatctttctgaattagtggtgtgattttaacccaccccaatgagcaatgccttgacctcaactgtttcatgttggtatttacttctatagaatatcattggggtgggtcaaggcattgcctgcagaatattttagtggttccccttccctcataggtcattgatggatcccaccgactattcgctgcaggctgtgatctatttttatcactactctc

SEQ ID NO: 75677 - DNA, 461 bp, Triticum aestivum
  Clone ID: PAT_TA_75677
agtgggttcaaagtcaatgctattgacttaacaggctccgggattaaattcttctgatacaaacaagattagcagtctttcagagtatgctgagccacttacatcttaccttaagggcctaggtgatgctgaaaaggttatcttggttggacatgattttgggggtgcttgcatatcccatgcgatggagatgtttccatcgaaagttgccaaggctgttttcctgtgtgcaacaatgctgacaaatggacataatgctcttgatatcttccaacaacagatggatacaaatggtatgctccaaaaggcacaggaattagtatactccaatggcaaggaccggcctcccaccgctatcaacatcgacagggcttcagtaagagatctattattcaaccaaagtcctgccaaggatgtgtccttggcttcagtgtccatgagacctatcccctttgccccgg

SEQ ID NO: 75678 - DNA, 219 bp, Triticum aestivum
  Clone ID: PAT_TA_75678
tccgtaaagaagagcttggtcacatccacgctcccatcccatggtgtggcagaactgaacacggttacagtaacagaagaagcagatagcagcaaatatgaaatggccgaggtacaggcagtgtttttgacgctcttgtggcatgagggcatggacctcgccggcgctcggccggagactgtgagacggccgtcgggtcggaacccccttctcccaccc

SEQ ID NO: 75679 - DNA, 492 bp, Triticum aestivum
  unsure (1)..(492): unsure at all n locations
  Clone ID: PAT_TA_75679
gccaaagagcaggttatttcagccaatgttggttcccatcacacctttgattgatcacacagcggctgctatcgtgctagaaggggatgactgtccatatgctggttcaccacatatttaaggtacattttgtcttgctcctgctgtgtgacatactgacctgctgtacatccgcgtgaagcacacccacccgctgccggaggcgtcccgcgcccacgctgacttcaaagcctgaaagacgccgggctccatactgctgaccctatagaactaagcaccgtcntcttttttgggtaggagaagaaggcataaacaggggactcggcgaagaatctacaatgcttgtcaatatgtttgcatctgaacactgaatcctttttctctctgtttctcctggttatgttggcttcagtatgagtgagtgtgtttgttggttatgagttggatcgtggtcttgctgtgcacatcattgtttgaagcatgacgagttgt

SEQ ID NO: 75680 - DNA, 331 bp, Triticum aestivum
  Clone ID: PAT_TA_75680
gggcgacgacaagtttaagcaatgcacataaagttgctgttaaactgcagactgccattccttgatattgattttcaccagtagacattctgaatggtgtggaaggctgtcagtcactccatggtttggctgtgggcatgaatatactagattgtagtaatggaggcttggaaacatattagattggggcattgagccctctgttagttttctggaaacgcttgtctgctgtaagatgaacaattggatgccagtgggcattctactggacggtacatggggatggggcattggcctcttgggctagaaaaaaaaaaaaaaaaaaaaaaaa

SEQ ID NO: 75681 - DNA, 250 bp, Triticum aestivum
  Clone ID: PAT_TA_75681
ccagcgggctcgggttcgtgccggtcagatgtggtcgaggagggaagctttctcaaggtggccgtggacagggagctggccagagctgactgaccgatttttgcttctgcttgtacgagcacgtgtatgctgcagagtagtagtatgaaccaggcatcgttcagtcagtgataatcgttaagtgagctcatgttttaaatttttctttcgagacgaggactacgaatgcggaatgccattaggctatgta

SEQ ID NO: 75682 - DNA, 105 bp, Triticum aestivum
  Clone ID: PAT_TA_75682
aacaagatctagtacgacagtacttatactaggtagtaagattcaaaatgccatactatatttcagaaaggtactattataccttttgctggatactctttggtt

SEQ ID NO: 75683 - DNA, 542 bp, Triticum aestivum
  Clone ID: PAT_TA_75683
caggagtgtggatatagtcatagttactcggaatgtagatgatttgccatacttccctcatatattactctttcccagtgtactaaaatatgcttcccattttagtcttagccttatattgttgatatgtaacccaaataggttaaaccgaatgttgtatcgaaacatgtagtatttacttgcaaaagagcaactgagagcctggtgggtcgggatgaaggaagaatacccctgagagcccaaactcgagttcgaaaatatatgcagaatatatgtctgcctctgctatatacatatgtaattttccagtctgtgttttctgctcctctttaggcgcactgtgcaagatgttggttttaaaggctagcagggaagccagtgatggagtaatcagtggtttatgaggtcatggagcccaagaccggatgcagcacaagaagcagcgtccttgccgtgcactaagaaggtcaacagagtctgtgaggcggaagatccatagcatacagcggatgcgttggatatgccattcctcaatgtgtacc

SEQ ID NO: 75684 - DNA, 194 bp, Triticum aestivum
  Clone ID: PAT_TA_75684
gtgcttgtcagcatctacagaagctggctgatgctgaggtgccttgtgcaaagaaggctttgcaaaggatatccagcagccgattcaaaagcttactttccagagggtggaacaactagtccatccgctgcattggggtacgttgaagagaacccaaatgtggagagcttcgaattatagaagaaagcttaagt

SEQ ID NO: 75685 - DNA, 220 bp, Triticum aestivum
  Clone ID: PAT_TA_75685
atcgggaaggtttatccggccggaggacgtgggatccgacggcgtgcgagcggtttgttccgtttgttgcgacgggttttctgttttttttttccagcaaccgctctgggtttcgagtcatggtggtgtggattgcgaagggtaggcggaaggtggcggtagagcgaggatgggctggggatgttttgtccaatgcatcctctggcatgggaattgctcc

SEQ ID NO: 75686 - DNA, 157 bp, Triticum aestivum
  Clone ID: PAT_TA_75686
ggcgagagcacacgaacgacttgtctccagtacagcagtaccaggacgccactgccgacgaggagggcgagtacgaggaacaggaagagctggagcaggagtaagatcggtgacgatgcatctctccctttatgtggtattgtggttttcgtacaac

SEQ ID NO: 75687 - DNA, 316 bp, Triticum aestivum
  Clone ID: PAT_TA_75687
gcaaaaaggtgtttgtatttgaggatgcaaacagcgtgccttgcaatggaagaatgcaattgaagatctccagaactgccaaaagatatattttcaatcgaaatcaagataccgaccaaaacagttatgttagcactctgaatacaccttagccctgtttttcacttggaggaacacattggggtttctcgctcctgccctcctcgcgtgccttggaaggaaatcacttgtggcatgttgatcgatgtcccccgtccgtagacagttttgtttgtttgttagttgctgcagcagatagcatcagagtgattgaaat

SEQ ID NO: 75688 - DNA, 422 bp, Triticum aestivum
  Clone ID: PAT_TA_75688
ggccaagatccaggacaaggagggcattcctccggaccagcagcgccttatcttcgctggcagcagctagaggatggccgtaccctcgcagactacaacatccagaaggagtccaccctccaccttgtgctgcgcctgcgtggtggcatgcagatcttcgtgaagaccctcactggctagaccatcactctggaggttgagagctccgacaccatcgacgatgtcgaggcctagatccaggacaaggagggcattcccccggaccagcagcgcctgatctttgctggtcagcagctggaggatggtcgcaccctagcagactacaacatccagaaggagtccacccttcaccttgtgctccgtctccgtggtggtcagtaattgccctggcgtttgatccacccttcacatggtgctccgtc

SEQ ID NO: 75689 - DNA, 176 bp, Triticum aestivum
  Clone ID: PAT_TA_75689
ggagcttcagatcggtctcaaaaactatgacccacaaaaggacaaacgtttcagcggctcagtgaagctgccccatatcccccgcccaaagatgagggtgtgcatgcttggtgatgcccagcatgtcgaccaggctgagaaaatgggacttgactacatggatgttgaaagtctca

SEQ ID NO: 75690 - DNA, 100 bp, Triticum aestivum
  Clone ID: PAT_TA_75690
gcaacacctgctttgcgttttagtttgtgctagcatgaaccactgtgtgtaatgctttgaatcaaagttacatgaaacaccatctgtaaattcataactc

SEQ ID NO: 75691 - DNA, 470 bp, Triticum aestivum
  unsure (1)..(470): unsure at all n locations
  Clone ID: PAT_TA_75691
gaaggtagttcaagggctgtcctgagaagctcaaatggctcccaaagttgctgttgccaagaagggcgatgccaggcccaggccgcctaggttgccaaggctgtgaagtctgggtcaatcaagaagacggcgaagaagatccgcacttctgtgacatttcaccgccccaagaccctgtccaaggccagggaccccaagtaccccaggatcagcacccctnggaggaacaagctcgatcaatatcagatcctcaagtacccgcttaccactgagtccgcaatgaagaagatcgaggacaacaacacactcgtcttcatcgtcgacctgaaggccgacgagaagaagattaaggccgctntcgagaaaatgtacgacattcaggccaagaaggttaacaccctcatcaggcctgatggcgagaagaaggcgtacgttaagcttacaccagactacgatgctcttgatgtggc

SEQ ID NO: 75692 - DNA, 99 bp, Triticum aestivum
  Clone ID: PAT_TA_75692
atacagcgaggatgatgtccataacgagtataaaatgcaatgtgtgggctacgtaccacctatggaaatcagaagcttgatgctgcttatcaagaagct

SEQ ID NO: 75693 - DNA, 321 bp, Triticum aestivum
  Clone ID: PAT_TA_75693
gagactctcctcttctcccgcggtgcatgctcttccattgggtgatgaaatcctgggagctgcatggcagatcgagtctgatcgcacaccacaatgtggaactgctcggcgccgtccccgctcttgctgcccttgagcgacgactacgtgaaatgtgaatcctcgaattctgcgcccggagccgcgggtttcgacggaataagcaggctcgccgcccactattgccctctctgccaccacatgtcgtcgcttctgagccttccggcgcccgctctcttcgccacgcgcagttcccagagctttttcggactgggagacggg

SEQ ID NO: 75694 - DNA, 346 bp, Triticum aestivum
  Clone ID: PAT_TA_75694
agaagacgacgacaccaagaggggtcgcgaggtggagctccgcgtgtggggttcggcaaggaggtggtgctgaagcagcggcgtgcggatgcggcgcaggccgcggctgggcgaggaggagaaggcggccatcctcctgatggccctctcctccggcgtcatctacggctgatccaggccgacccagccctacctcgctagcagcagcaagcggagagaagagaagagagatgagaggagatccagagtgtgagtgatttgctcgcttgctgctgcttgtctagcaagtaagcatgcatgcaggcggagatatcgaggcgtctctgcccccccttgttctttcctg

SEQ ID NO: 75695 - DNA, 542 bp, Triticum aestivum
  Clone ID: PAT_TA_75695
tttctctgctctgctctgtcccgtggagattgcagcaggcacgaggccaacgggccggcgatcggcattgacctcgggacgacctactcctgcgcggccgtgtggcggccggtgcaccaacgcgtggaggtcatcgccaacgaccagggcaacctcaccacgccttcctacgtcgccttcaccgacgcctggcgtctcatcggcgacgcggccatgaaccaagccgccacgaaccccgccaacaccgtctttgatgcagagcggctgatcggtcgacgcttcagcgaagagtcagtgcaaggagatatgaagttgtggcctttcaaagtcatttcaggccgtagcgatcgaccgatgatcgtggtgaagtacaggggcgaggagaagcagttcacagctgaagaaatctcctccatggtgcttatcaagatcagggagacagccgaggcctacctcggcacgacggtgaaggatgctgtcatcaccgtcccagtctactttaacgactcacaagccagtccaccctcgacgcttgcgccatt

SEQ ID NO: 75696 - DNA, 260 bp, Triticum aestivum
  Clone ID: PAT_TA_75696
ctcgcgtgctccaacgcctcgcgcggctgcgccgccatgacgccgtaccaccgataggccgatcacgagagcagctgcccccactcaccccacccctcgaccctgcgcgcagtcatggtggcggcgcccatgccccaaggctttaagttccggcaaataaaatagagcgggaccccttgtacgggctactactacgtactagtacctcttgtcccagaatataaaaactacagcaacgttgtatatttgggtacacagga

SEQ ID NO: 75697 - DNA, 465 bp, Triticum aestivum
  Clone ID: PAT_TA_75697
gctcccgctcggcccggcttcctcccgccgccatatccttcgactggtcctgcccatggcaaggatacgggtttatggatttcatggccctgaacagcgacatcatcgccgtggacgacacgggtcacaccctaatctacgacggcgcctcgcgcgccgtccgcggcatgaaccagatgatagtcccgaggcgccctccatgtccgtcaccgtccgcgacgccctctacgtcatggacctgcggtccgaggtacactacttcaaggttttcagctacggacgaccaccgccggggcactgccggcaggaggactggtactggagctgtcttcggccgccgcccctcaatcccgacgacccgcccgtgcgacaccggcacccctatgcggttagcgcctacacggtggttggtgactcgcagatctggatgtccatcatgggcgccggcacatactcgttcaacgt

SEQ ID NO: 75698 - DNA, 426 bp, Triticum aestivum
  Clone ID: PAT_TA_75698
gactacaacgtctggtccgcgaggacgttgccgtctacacgaggataaggccatcggcgaccttgttcgggatgattctccggacgtaatcttcttccaggaagtcacgccgtacattcagtcgatcttcgagagcttcccatggtgggaggagtacaacagctcaccagtgccccccgagggacaaacggggaaccaccacttctgcctgatgctgagcaagcttccaatggagaggtacgcgcgctggaagttcgccacttccccgacaggcaagtgctacctggaggccgacattacccctcgaaatatgtaccccatacgcatcgccacggcccatcttgagtgccccgtgccaccggcgtcgattcacctcagggatcggtacatgcaggctaagcatgtcgtctccgcgctcagcagcgc

SEQ ID NO: 75699 - DNA, 489 bp, Triticum aestivum
  Clone ID: PAT_TA_75699
cgcctcgtcgtcgccttgcgcctggatgccctgcacctagagctccaccggatcgcacagccgccgaccatagtcgccctgcgcccacgtccccgctgccaactctcctcaccgaaggagcactgggaggagtggaacaccaccgtcgtcgcctcgttccctgcttccccctggtcttcatcgcgaggtccagcaagtccggtgcccccccaagtccagcgaccgtcccggtcacctccggactgccaggactctccagcaagccgccgttgcctctgcttcacgaaaccacgctgcggcgccccagtcacctgcgacctcgggtcgtctctgcttcgtcctcgtctcacaccatgcctctccgcgtacgtgttcactgcgccgccctcgcagcgcctccccaagttctgcccctgcctcgttcggctaccacgaccgcaccggctcgctgctgctctgctcgacgcgcccttcttccttgcctttccc

SEQ ID NO: 75700 - DNA, 450 bp, Triticum aestivum
  Clone ID: PAT_TA_75700
tcgacacagcagcacacaccaccacaccgaggcaagcgaacattcgcggccgcggcaagggagggaaggggctgggcaagggcggcgccgagcgccaccggaaggtgctccgggacaacatccagggcatcaccaagccggccatccggcggctggcccgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggattcggcggctaggccacgcgaatcgacccccccaccaccagatttgtgctagtagctcgcctatggctgtgtagtgttcgtgggctttggtttaatggccgcatcttgc

SEQ ID NO: 75701 - DNA, 409 bp, Triticum aestivum
  unsure (1)..(409): unsure at all n locations
  Clone ID: PAT_TA_75701
ggagggaaggggctgggcaagggcggcgccaagcgccaccggaaggtgctccgggacaacatccagggcatcaccaagccggccatccggcggctggcccgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggattcggcggctaggccccgcgaatcgacccccccaccaccagatttgtgctagtagctcgctnatggctgtgtagtgttcgtgggctttggtttaatggccgcatcttgctgctgtatgtcctggcct

SEQ ID NO: 75702 - DNA, 224 bp, Triticum aestivum
  unsure (1)..(224): unsure at all n locations
  Clone ID: PAT_TA_75702
gagcccgagggccgggtcttctccgccaccacgcgcaccgatntcgccgcgctccttggcgagccctgcgaccagatcctcgccggtcgtgcctccttcgccgacctcaccgcacagcagtccggctcctggggagtgaaacgaactccagttcacgctctgttttggtggatctcacgacgctcaggaggtgttcgacgaagtgcaaagcccgagaaaaacta

SEQ ID NO: 75703 - DNA, 431 bp, Triticum aestivum
  Clone ID: PAT_TA_75703
ggtctcgtgaggaagtgcgccggcacgaggcgggatgcgccgtccacgaggcaggcggcggcgaagaggatgcgggtggcagcggccggtggcagccgacgagaggaggcggccggcggagacgaggagtggaagcctcaaatagcaagtggcggtcgattgggggggacggagcggcggacgatttgagaggggagatcaccggcggcgtccctgtgggtgtacggggatctagccttcgtcgtctgcttccatacgtgacgccgtaggcgcggtgcttggtccagagcaacattgctcggggaggagctgcagcaggagctggccatggacgggagctgcgttcagaaatcagaacctcacgacggttgtagaagggggcgcggggttcagcgacagccgggccaccgaccaccagagctcttcatggc

SEQ ID NO: 75704 - DNA, 521 bp, Triticum aestivum
  Clone ID: PAT_TA_75704
atcacgacacatcacgtacgcggatctacctcttgggcgagagctcgctcgcggttggtcgttccggcgagatgcagatcttcgtgaagaccttgatggggaagaccatcaccctcgaggtcgagagcagcgacaccatcgacaatgtcaaggccaaaatccaggacaaggaagggatcccgccggtgcagcagcggctgatcttcgccgggaagcagctggacgagggccgcacgctggccgactacaacgtccagaaggagtcgacgctccaccttgtgctgcgcctccgtggcggcagccgcggcggccgccccacctctatcccgcccaacctcctgcagctcgcgctcaagcacaacgagaagaggatggtctgccgcaagtgctacgcgcgccttccccccagggctaccaactgccgcaagaagaagtgcggccacaccaacgagctgaggcccaagaagaagtttgtttgagcagcgagcgagcgagcaattctgcttcgtcggctattcttt

SEQ ID NO: 75705 - DNA, 333 bp, Triticum aestivum
  Clone ID: PAT_TA_75705
cctcgggacgacctactcctgcgtggccgtctggcgagcctggtgcaccagcgcgtggaggtcatcgccacgaccaggtcaacctcaccacgccttcctgcgtcgccttcaccgacacctggcgtctcatcggcgacgcggccataaaccccgtcacaccgtcttcgacgcgaaacgactgattggtcgacgattcagcgaagagtctgtgcaagaagatatgaagttgtggcccttcaaagtcatttcaggcacccagtgatcggccgatgattgctgtgaagtacaggggtgaggagaggcagttcacagccgaagaaatctcctccatgg

SEQ ID NO: 75706 - DNA, 219 bp, Triticum aestivum
  Clone ID: PAT_TA_75706
ctcacttcataaaagatagacgatgcaatactgcaagggcagtttttgcattggagtcgaatacaagtgggctctgagtgggacaccattgcaaaatcgtgttggagaactttactcgctgattcgcttcctgcaaatctttccctactcgaactacttctgcaaggactgtgactgtcagatactagataccacaaaaaaaaaaaaaaaaaaaaaaaa

SEQ ID NO: 75707 - DNA, 490 bp, Triticum aestivum
  unsure (1)..(490): unsure at all n locations
  Clone ID: PAT_TA_75707
cgagaagcagatcaagttcatgacctacaacgtttggtcccgcgatgacttgcagtctacagaagaatggaggacatcggcggctgcgtgaagaaacaccagccagatgtgattttcttccaggaattcactccatacatcttaaggatttttcagagtttctcatggtggaaagagtaccactgttcaccgatctccctggaagaacggaaaggcaaaagcttctgcatnatgctgagcaaggttcctatggagaatcacgcgcgctggaagttcaccaccacggccacatgcaaaagctacctagaggccgacattagcccgggcctggggctggggtcggcgacgacgatnaagccgatccgcatcgccacgacccagctcgagcctccctgcccaccggagtcagtgcgctgcatggagcgctacacgcaagccgagcactctgtcgcggcactgagcagcgcggagaacgtcgtgttcggcggct

SEQ ID NO: 75708 - DNA, 303 bp, Triticum aestivum
  Clone ID: PAT_TA_75708
ccgctcctccacttttgtgtccttctcctcgtcctcttcatcctctcctcacccgccgccgtgcccgccgccatggcccggccagtcgtggacgtgctcacccccgacgtcctcctcgtctcaccccccgccgcgccctcggccttggcccccggccccgacgtgcacgcctccgactacgacgtgtacatagtctttgtcagccgtactggttacattgactccttggactacgacctccggctgctcgcctccgtcatcggaagcacgcacgaggcaaagaaggccatgatctaccactat

SEQ ID NO: 75709 - DNA, 558 bp, Triticum aestivum
  Clone ID: PAT_TA_75709
ccgcctcctcccatgtagcggtcaacagcgacagccgcagcaggtggattcggcgtcggccagcggagacgcgattcagccgccgatgcccactccggttggggacgatgagccgccgccggaatctgcggcgattcccaatggagaacatgctgcgccgccgccagttgaggcggccgatggcgtcgagtcaccggtggattctgcggcagcggccaatcgagacccgtcgacgcctacagttggcgacgagatgccaccggattcagcggcgccggccgacgcgaactcgccgccttcgattgaggcagccaacagcggcgagccgtcagcaaagacggggtcagaggaccaggtcccggaggagaggcgggactcgtcgccggagcatgaggtggagaatctcaagtcgctcaacggcacgctccttaaggaggcagttgaggcgcggggggtggtggccacgctcaccgggcaagtcgaccagtgctctgccgattctgctgcactcgccgatctggagcatgtggtcttccgggctgcccttgttgccccctc

SEQ ID NO: 75710 - DNA, 210 bp, Triticum aestivum
  unsure (1)..(210): unsure at all n locations
  Clone ID: PAT_TA_75710
cggtgttggatcgatctgggcccacgcaggcctgcaacggggcgcggttctattggtcggcatcttgcggcgctccngtatcgcgcttgcatctggcgacgcggcacggagcccgacagtggaggtgaggagtgtggcggcattgcaggcttgatggcttgatctgggctcttgcaggcttaaaatttatttcaccactcatcatctacc

SEQ ID NO: 75711 - DNA, 499 bp, Triticum aestivum
  unsure (1)..(499): unsure at all n locations
  Clone ID: PAT_TA_75711
cgtttgtgcatcccagtgcgtgtgccgcgcgtggcgcgacatcatcaacgatgatcattggctctcccttgagcgctacttccctcggcgcgcccttcccggactcttcgtcaacaagactgggtgccgctccgatacgtccttcttcgcaccgccggccacccgcggcgcgtctggcttccggggacccgtctacccgcaccgggcgatagtattccagtcctgcaacggcctcctcttcctcgaggagtgggactattatgtgctcaacccggcgacggcacggtatgcccgtttgccgcggccgtcgaagccgtggtgcagctatngcgtatccttggctttcgaccctgccgtgtcgctgcactaccatgttttcctctttccgaagggtggtctgctccaggagccattaatggccactagcacgcaaggtccggttccgccattccgggaagcacacgcggaggagttcgaggagcccaagaaaaatgtgtta

SEQ ID NO: 75712 - DNA, 497 bp, Triticum aestivum
  Clone ID: PAT_TA_75712
cgtcacgccatcgctcccattcccctcctcccgcttctacaaggcagcccaagcagaatgatttctatccgcggtgcacgccgagagggccggctccccagtcccgcgacaccccgcccaagagagacactggtattgctagtgagaaggaatgggggatcaacctgctcgatgaagcggtcaaggagtctggcaccaacgaggattgaagcacctggtacagggagagtggcgaggatctcggtgagaacgggtaccgttgccgcttggccaggatgggtggacagacccatgatggttccactgaatggaaagagacttggtgggagaaaagtgactggactggatacaaagagctaggtgctgagaaatctgggaagaatgctgagggtgactcttggtgggaaaagtggaaagaagttctgcaccaagacgaatggagcaatcttgcaagactccagaagagcgcagagaagcaagcccaatcaggggaccga

SEQ ID NO: 75713 - DNA, 580 bp, Triticum aestivum
  unsure (1)..(580): unsure at all n locations
  Clone ID: PAT_TA_75713
tccatgggcgaggacgatgcggcgccgcccgtatcggagccgccggcgagggactggtcgctgctgccccttgacacgcttcctcgatcttcgtcagggtcggcgccgtcacgtcctcatgggcgctggcctcgtgtgccgctcgtggctcgaggcggcgaagttgccagacgtgtggcgagccgtggtcatggagaaccacgatgtcgtgttcctaaaggacgaacttgtcctgtgcgcaatggcgaaggcggcggtcgaccgttccgacggacagcttcgggtgttcgctgggaatcagttcgtcaacaatgtgctcctcaagtacatcttggaaaggtcaccctcgctcgctacccttcggctcgtatcatgcgttgaagtcttcagcacacgactcatcgatgtgatnagagatgcacctttgctggagctgcgttcccttgaactcgacgacgctttcatcaccgtcggagagctgaccgccgtccttgagagctgtcccctcctagaggttcttcgggtgcaccattgcttcgaggtctacgacgaggacgagcaggtcctgcgagcgaaattc

SEQ ID NO: 75714 - DNA, 490 bp, Triticum aestivum
  Clone ID: PAT_TA_75714
accggcgggatgcggcagccggtaggcgagcgacggctgctggtgctactagcgactggggaacctgctcggcctaggcttggcggcggcaaggacgcgcagcaccatcagcccagatatccaggacgcatctcctcttccttctccacgcacgcgttggtgcgagttcttgtccgcgtggcgactgccaacaagtagcagcaagtaggcgtatcaagatccgtccagccacatgtagttgctgacgatgaagaagttggtttgttcgtgtgctggacgatcctgtggcaagtttgttatgggtttgtttgctgcgtgacgaaacattcgtttaatttctgaaaaggattggagattcagccgatagattttggcatatattttcatgacctactatgtattagaattatatcaaagtgtaaggtacaaagatatatgtgatatgtaatctcaacattcctgtgtcaagagatcaattccattacatttc

SEQ ID NO: 75715 - DNA, 140 bp, Triticum aestivum
  Clone ID: PAT_TA_75715
gctcctcgagtcaccccgtgctttctcccgcgctgccagtttggccccgcctccactgcttcgcccggattggctcctcgctcaggggcgggtggtcggcggcgttcaacaaggtggagcactacggggtccagagagtc

SEQ ID NO: 75716 - DNA, 424 bp, Triticum aestivum
  Clone ID: PAT_TA_75716
tgcagccgccggccgaggctccgtcgccgtacgccggtgcgttgaactgagaggccgcggccgccccggaggataccgcgacgtcgtcgtcgacgtgctgtggttcgtgttcaagtgggccaaggacgcctacgccgccgccggcgggcgcacggtccaatgaaaatgaagccggccggcgtacgtcctcgctgcatcggtcgtcctctccggtagcctggtccatctgtgccttacggaggagaaaataataacggtgcacgcttgtgctggcctccttgactgattgttcccttcgacaatacagcaccctctcgttctcatttccagctcttttatcctcccggcgtcgttctcacttgtcaatgacgatcaacagtgctgtttttccaagttccaaaaaaaaaaaaaaaaaaaaaaaaaa

SEQ ID NO: 75717 - DNA, 351 bp, Triticum aestivum
  unsure (1)..(351): unsure at all n locations
  Clone ID: PAT_TA_75717
tcggtactggagggaaagaggagaagaggagggagcgcagcgcgtgcagctgcctgccgttgagttgagggtcgaccgccgccgtctccacctgtccgccgtcgaccacctcctcgtcggctcgctgctgtcgatnagagatgaccacgaagcttgaggagggggaggatgtgcctgcacctgcacgccgtctcccctgcacctgttcgatctcctctgtcctctcctctgcattatcccatctcttaccgagtatagtcgagcattcatattgtgatttccaactacggaattatcactgaatccacatcctggaagcggaacgatctccaaacctcatgctcgaattgg

SEQ ID NO: 75718 - DNA, 434 bp, Triticum aestivum
  Clone ID: PAT_TA_75718
cgagtcccctccgacgagcctcccagaaccatcgcaaacgcaacggagagccggccgcatccctcccctccgccgactcatctctccccaggcaacacttataagcaaatagttctcgccggattcctgcgccgataccttctcttggcgagggtgcagatcgattgccggcgactggagacgggggatgaggatacggagctagcgcgcgcaggcggcgagcgggagacgctcccgtccttccatagccgtggggagacgcgctcgcggcggtatgaggcgccggcgtccacacggctctgcaacaagcacgcagagctcccatgtttccacacaagcatgaagcctcttaacacatgatgtcgtgatgtatacttccaattctgattccagatggcaaaggcgcgggcaaggcgagggaagcgggaagcagc

SEQ ID NO: 75719 - DNA, 367 bp, Triticum aestivum
  Clone ID: PAT_TA_75719
cctctaccgaccgcgtaggccactggagtcgtcgacagccggagcctggccacgtcgcagcccctaccgccggcgacctcgcctggacccgacaagctccgtcacccaacctgcatcatgctgttcaccagagtccttctgctgctcccctatgtccagtctgctgctgcatcgtcgtctgcatcctccatggcctcgcctctgctcgaaacagatgaacaacagcgtccggcacagcttcctttgcatcgtccagcttgcgccaagtcctgtttgtggatttcgtcaagttcgagcttcgttgaacgagggcttttgccttgctcatttttgggacacgacgagttcatcttcgaaagaacgtctg

SEQ ID NO: 75720 - DNA, 470 bp, Triticum aestivum
  Clone ID: PAT_TA_75720
ctcttcgttgcctcccctcgcgccgccgccctccgagaagcaacgcggccactactgctctgtgttgcgccgagcttgccaccgccgccgctctccccgtcgagctcgtccctcaccaccggccctcaagttgtggaggggcaacaggcagcggtggacgaggagatcgccgccacccaccgcctcgagccatgccgtcggcacccatccacccgtcctcctctcccctccctcctcgctgagatcgccgtcggtgctgctctccccgtcgagctcgcccctcgccattgccgggaggagacaccaccggccaaagcgtcgataggggcctccatggttgtcggcgacctcctccttgccgacctcagcccgccacatccgtctttcatgcccgtctccctccactcgagccgtcgactcgcgctcgcccttcgtcggaggagtgacgaggaggccaggtggaacgcgcc

SEQ ID NO: 75721 - DNA, 634 bp, Triticum aestivum
  unsure (1)..(634): unsure at all n locations
  Clone ID: PAT_TA_75721
aagctgctcaacgagctacccgtaccagcgggaggacgcggtgaactcgctcgcctacgaggccgacatgcgcctccgcgaccccgtctacggctgcgtcggcgtcatctccgtcctccagcaccagctccgccagctccagcaggacctcaccccgcgccagatacgaactctcaaagtaccaggcggctgctgcggtggcggtctcggcgtctgtgggttgcaacgggacgccggcaatggcggatttcatcggcaacacggtgcccaactgcacgcagaacttcatcaacatcagccactccacggcgatcggcgcgggtcttgggttcgggcacgaccagttcgcggccgttcagatgctggccaggagctacgagggggagggcgctgtcgcgagactcggcgtgaacggcggcagcggcggcggctacgacttcgggtacacatcagccatgggcgtcgggccggtgtccggcctcggcccgctnagcggcggacagttcttgaaacctggcacggccggtggggacgagaggcacaccgccgcgcagtagcgcccggtgttcgatccgacatccatcgatcgatctttggcaggttcggctttcctcgccacacatgctcaattgtt

SEQ ID NO: 75722 - DNA, 523 bp, Triticum aestivum
  Clone ID: PAT_TA_75722
acagcgccggcgccaccctgctcgacgacctgcccgagtcgatcctcgtcgaagagatactcgtgcggctgccgtccaaagatgtcctccgctgccgggccgtccgcaagtcgtggcgcagtgccacctccgctcccggattcctcgccaatcaccaccgtcgccagctgctcctccctctcatcaatatcattccggagagcgccgacgacctctgctacgaaaggaacgaggaggatgtcaacagtaggtacgtcgcctttcgcgacggcgagcgcaagctctggccggtcctccgcacccgccccgcgaaggggaccacggtccacggcgcctgtgatggcctcctcatcgtcgcctacacaaacgtcccctatgaagacgccttctatgtgtgcaaccctacaactcgccagtgcgctcctctgccccaggttccaccgcgctgctccggcacggccatagccggctattaccggcaccaccagtcccaggaataccgggtgttgtactggctcgtgtc

SEQ ID NO: 75723 - DNA, 444 bp, Triticum aestivum
  Clone ID: PAT_TA_75723
acccacttcgctctccaccttcctccctgcgtcgccgtctcaacatgcgcctaagccaaattgccgtgcagaccatcgcaagccgctgtcctaccatagactgcctcgtcgtgcgcacccggactgaagccctcgaatcctccgcgagtatgcatgcaccaccacgccggcccccagcctgttcagcgccgcccgcgcacggcctggatcccggcgcctcctggggccgacgggtacgaggaggagggccactaccaggatggcacttaaccgtccaactccgctgctgcgagggcggctgctaggttcccagtagtcgcgaacctagcgtctacaagtcggacaatgggcagcggtgggcacgatgcttccagcaggctcattttctcagccgaactctgttcccgattaagttaccatatcccttgtttcttaaaacattcc

SEQ ID NO: 75724 - DNA, 398 bp, Triticum aestivum
  unsure (1)..(398): unsure at all n locations
  Clone ID: PAT_TA_75724
cgtcgcgccgccgcagcactgtgcgtttgcggcgaacgagccgtcgatgtgtcgcggcgagctatgttgcgattctccaggcggcgaactacgtgtcgtcctccttgggctacgcgctggagctgcaagggaagctggcggcgcgggacgcggaggtcgcggcgcttgagaagcagctggaggagacgaaggccgagctcgccgcggcgagggcggagcgggacagtgcgagaggggcgcgcgctggagcgctggaggagtggtaggggagcggcacggaggacgtgaggccgcgtcgctncgagactcgttatcccgtgcgcaaagaanatggactatgccattgaactggcatcgaaagattggttcgtggcctctgaaaaaattacaagtactgg

SEQ ID NO: 75725 - DNA, 123 bp, Triticum aestivum
  Clone ID: PAT_TA_75725
gtttcgcgaaggcaacgtggttgaggcgccgacggcgtttaaccacgacaggggttaggcgcgacgacaacggcaattcgctcctgacctcgacggcaactcgctcgtggccgcgacgacaac

SEQ ID NO: 75726 - DNA, 474 bp, Triticum aestivum
  Clone ID: PAT_TA_75726
ttgccggcggcggcggcggcggcgctgccgctggacgacgacaacctgctccccgtagatcctcctccgcctcccgccgctcccgtcctccctcccccgcgcctccgccgtctgcacgcgctggcgcagtctcatctccgacccagccttctcccgctgcttccgcatccaccaccgccgcaacgctccactcctcggcttcatccagccatttgacgtccgcccatccttcgagcctactctggaggccccagatcgtgttccgcccgggcgcctctccttgcagtccgacctccaccacttccgggtcctcgggtgccgccatggccttgtgttaatcctcgacacgacgaggttccagttgctcgtatgggaccccgtcaccggccaccagcaccgcgtatccattcccacgggattcgcttggttcgggacagtgatctgcggggcggtgctccgcgctactcccgggga

SEQ ID NO: 75727 - DNA, 546 bp, Triticum aestivum
  Clone ID: PAT_TA_75727
ggaatatatgcggacactaggtttcttcatctccctcaacgaataatctccgttgtttcgtcccactaatccttctcatcttccctctatttctacctctctctccatacaactcgcgtcattccgattggtcaggtctacgacgagcactgctccctcggcaagtcgctggcgcgggtcaagatcttcgagctcacggccggcatgctccccaagaaaggcgccctcatagtggtgctctgctcacggaccagtgcgtggtcgtcgcgactgctgcggcctccacggcacggacgccggcaccgggtacgcctacacgcggatggtcgaggccgagcgcgagtgccccagccagtgtctgggaggaagggttggtaacgcgtacgcaagggatgggggcgcactccagctgctacatgttggattccacattaaggtttttctgttccgacctttcagaacaaaagaatcgggacaaaggaacccacgtttatttctcaatttcttgattgtaggatcctgctatctctcttgccatgcaaagca

SEQ ID NO: 75728 - DNA, 223 bp, Triticum aestivum
  Clone ID: PAT_TA_75728
caagactgtgagggactactttcgagaaacctgcaagctgcagactaagttacgattttctcccctgcctgcaagttcgtacagaacaaaaaccgaactatcttccaatggaggtttgtgcattggaggccaagttgctgctgtggtggtatggcaagactgaactcaactcatcgactgtggcaaaatgatctccctacaagtactaactaatttgcatata

SEQ ID NO: 75729 - DNA, 269 bp, Triticum aestivum
  Clone ID: PAT_TA_75729
cccgccgcttcctccttgcccaccacgcccgccaatccgccctccccattttctccagcgacggatagccgtaacctcctcgccttggaccaccgggccagccagctccacaccgtcgcccggcatgacgagcccttctttctggaggcttcctgcgatagcctccttctatccaggtcttattctggccgccgcctcgccgtctacaacccggccacgcgggagcatgcctccctcgggaggttaccgtcggacttcaggatcttggg

SEQ ID NO: 75730 - DNA, 152 bp, Triticum aestivum
  Clone ID: PAT_TA_75730
tgccctcccctcctgatcggagtctcagccgcggcagccattgcgaagacctaccccgttgtcagcgccgagtacccagaggccgtcgagaaggccaggcaaaagctccgcgccctcatcgcccagaagaactgctccccgctcatgctccg

SEQ ID NO: 75731 - DNA, 536 bp, Triticum aestivum
  Clone ID: PAT_TA_75731
tgctgacgcacgcccacggcgcctccctggtgccctgatttcatcttcgcccagtcacgacgccatgcctggaaggcgccgccgcactcctacagcacgtcccacgtccgcttcgcttggccatgaagccggccctggacggcgccgctgcacgtccgctgcgcctcactactcctcgctacaacttcgcccagccacgacgctgcgcctggatggcgccgccgcatgcccgcagcgcctcaccggcacctatagtgcctccccggtgcccctcattggctttcccggaccaaccatatctgatcgtccgcatcggcttcgaccatccggcgctaccgtcggcacccaccccacaccgttccagcgccatcaaggatcgtgccactacccgtccccttttggtccctcctccctttgctctggtgtggagctcagcaaacgaacagcatatcgtacgctgggagaggaagaggagagggtctttacagttctgcttgcctccgccactctattcagttatctccatcagacatcgc

SEQ ID NO: 75732 - DNA, 427 bp, Triticum aestivum
  Clone ID: PAT_TA_75732
aactcaaggcgctcaacggcacgctcgttaaggaggcggtggtgacgcgggggctggtggtcacgctcaccgcgcaagtcgaccagtgctctgctgatgctagcgcactcgcccatcttgagcctgtggtcttccggcctgcccttgttgcccccctccaagctgccgccgaggatggcacggcgctgcgtgggcacatagccgacgaccagcaatcgctccaggtcgcggaggcgagggtggctcgcgagacggatgccagggtcgaggctgcagcgcgcttggaggaggcccaagtggagaaacttcaattcgaggagctcctccgcgggaagcacgcggcagccgcgtctgcgtccgaaaatgtcaccgaattggaagcctctcttggtgaactggcggggaagagcactgagctgtgtgcaga

SEQ ID NO: 75733 - DNA, 529 bp, Triticum aestivum
  Clone ID: PAT_TA_75733
cggcaccagctcaagtggcgtgacgggagctgcgactgcgagcattggcagcgttgcggggacgaagcagcacaatgtgtccttgctcggggacgagcacgcgagggagggattacgaggacgaaaggacccaagcctacatgaaatccaacgcagccagagcgctgtgccagctagccatgggcaatgccgccgtgtgcaagaacatcacggagtccagggcgctgctctgtttctccatcctcctggagaaaggcgcccccgacgtgcagtacaactccgccctggcgctcatggagatctgccgtgtggcttagcagaactcggacctcccgcggtcggcgttcaagccgacgtcacccgccgcgcgcgccgtggtggaccagctcctccgcgtggtcaccatggcggagtacgacgatctcctgatcccctgcattacgtcgctaggctgcctgtcgagaaccttccgggcgacggagacccggatcatcgggccgctcgcgaacctcctggaccagcgggaagc

SEQ ID NO: 75734 - DNA, 332 bp, Triticum aestivum
  Clone ID: PAT_TA_75734
gtcttcacggccgactccccggcgtcggaagggcgacgccagggtggaagtcgtggacggcgacgtgctggtcatcagcggccagcgcgccaggagaaggaggagggtggcggccaggacgagcggtggcaccgggtggagcgcaggggcggcgggttcgagaggaggttccgtctgccggggggcgtgagggtggacgggatgagcgcgtccatggaggacggcgtgctgacggtcaccgtgcccgacaggaagaggccaagaagccgcaggtcaaggccgtggagatccaaggctgctgagaccacaagggtcatggttggttagtccaa

SEQ ID NO: 75735 - DNA, 392 bp, Triticum aestivum
  Clone ID: PAT_TA_75735
caagggcggcgccagcgccaccggaaggtgctgcgtgacaacatccagggcatcaccaagccggcgatccggcgtctggcgcggcgcggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatgcacgtcgtctacgcgctcaagcgacagggccgcaccctctacggattcggcggctgatctgatcccgcgtgttcctccggttgttcggggttgccgactgtgatgtactgtgatgcgcattgtttcagattaatcaatggattcgctgttgctgtccaaaaaaaaaaaaaaaa

SEQ ID NO: 75736 - DNA, 442 bp, Triticum aestivum
  unsure (1)..(442): unsure at all n locations
  Clone ID: PAT_TA_75736
ctcataatcaggccaatatcaggttcaatgctcctccaccactgcgcggctcgacggaaacatcacacgcccgcagcgcatcccgggcggcccgcatcagctttagatcggccatccatgtctgccatccgtcgttcgcatgggcttcacccgccggcggctgcccacgacccctcacctcgagccggatggcgcaccaccagcaaccttgccgccgcctgttgtacaaccctcatcccaccttcctacgctctggtctgtagtgcggctagccngtcggcatagcgtgctgttggagatgaagaagagggtctatttgtaccaggagcagtcnattggtcgatctctttgtgtctattatatgtcaatcttccaatagtgttttaattaaagagagaggaatgaatgaagcagaagattgattaagttcagcaaaggcatc

SEQ ID NO: 75737 - DNA, 109 bp, Triticum aestivum
  Clone ID: PAT_TA_75737
cgaaacctaataaccgaccaggagaggagagatccggcgagatgttcgctccagaacacgccgcctgaccgccggcctccaggagcgttcccttcatcccactcgctcc

SEQ ID NO: 75738 - DNA, 231 bp, Triticum aestivum
  Clone ID: PAT_TA_75738
taagcgaggcggcaaggcgcctgtcccggcgaagaagaaaacggagaaggtgaccaacccgctattcgagaaaaggccgaagcaattcggcatcggcggcgccctcccgcccaagaaggacctccaccgcttcgttaagtggcccaaggttgtgcgcatccagcgccagcgccgcatcctcaagcagcgcctcaaggtgcccccggcactccaccagtccacccgcaccct

SEQ ID NO: 75739 - DNA, 510 bp, Triticum aestivum
  Clone ID: PAT_TA_75739
tggcacaggagacggatcatcgccggcagcacatcccagtgcgcatgccggttggtgtactggacgatgttgtgctgcggccccatgtagctgccgtccggcgtcaccgagtagcttgtgcttggccccggcccggtcaccgagtagcttgtgcttggccccggcgcggcaccgaagggccgtagtggtagtcatgtggctgcccggctggcggcggcgtctcctccttgaaagcaggggcgtcttcatcttcttgagctgcttgcttcccattgctcggtctgctcatcttgtagaggcggtacgaggccatctcctccgcctgcaaacacacaaaggcgtgatgaggaaacaacaggagaaagcaggctcaactctgaaattatcaagatacatactcgcaattattcatgcatgcattgccaatctagatctgtatagtacgtggtgtccatcacagcttgaaatgtccattaatttgtgaacacttcttaaaaattaaaaaaaaaa

SEQ ID NO: 75740 - DNA, 549 bp, Triticum aestivum
  unsure (1)..(549): unsure at all n locations
  Clone ID: PAT_TA_75740
gcgcgcacggcgcgtactccctctcgcggccactacgagccagccaccgagtggccaggccctcggcgctccgctgggttccctacgccgtggcgcttccaccgtccgggctctccaggcagcgacccacgaggacctccgccgccgcgtgcagcagctttcgcgtgcaatgagctgcacgttcttctgtgacgctgcggccgatcagcgcatgatgccgccattctcggctagccgtcggttccctgaaaatgaggtgttcatctgtcccgacctcgcgcccctcagggacgcgctgctggcagtgaaccaggcgatgacacaggtggcagcgaaggatgcaagcgaggaggcgtgcagctgctagtacaccgccntcgcctggttgatgcggctgctggccgacagagtgtatgttcgcccgccggtgctgttcgaccagtgggagttcgagaataacttccttcttagctgggagtagctttattagagggttgcatctcaatagctgctgttaattagtcttcttttggtaacgtaccagtgctc

SEQ ID NO: 75741 - DNA, 115 bp, Triticum aestivum
  Clone ID: PAT_TA_75741
acgcattgtcagtcagaggagactgttctggagccgctaccccccaacctcctgtgcctgagctgggacgcatggactagactcgtgaagcagacgcaaccgttatacctgacat

SEQ ID NO: 75742 - DNA, 570 bp, Triticum aestivum
  unsure (1)..(570): unsure at all n locations
  Clone ID: PAT_TA_75742
gccgccgacgagctgaagcgtgcacgtggcggcggcggcggccttgggcattccgtggaccggctgagtgcactgccggacgacatcctgcacgccgtcctttcgcgcctcaatgcccggcaggtcgtgcggacgtgcgtgctgtccacgaggtggaggcatctctggcgctccgtgccctgcctccgcatcgaccagcgggagttccatgccgccgacggctcccttgccgagcggcagcagttcaagaacttcacccacatcctgctgcaccgccatgacgtcgcgctcctagaagattttcgtctcctcgtgcaccatggtagtgatatgcctcactatgacgacngctgggtccgccgcggcataagtcaagatgagacatggccatgtcggctcaaaaaattgcaccttaccaacgtgtttttggattgttatttcttgaggcacatcaattcgcggtgccctgctctggaggacatgaaactggaaaactgcagctacttgctcaccgatgatactagcatctcctccccctcgctaaagaaattggttatcatcgggttccgc

SEQ ID NO: 75743 - DNA, 439 bp, Triticum aestivum
  Clone ID: PAT_TA_75743
tccgccgccgcccgccgccgccgcggccgccaccaccaagcctcacgtccaatctctggccgtatctgccaaactccaaaacccccaaacatggcactgaattcagctacaatggcgcattctctccggtgctgcccagccggggccgcgatccgtcgatcgttatccacgcgcgccggcagtttcctcggatgccctaattatagcagcggtagaataaccttgaagattgctcgcgcttcccctgccgcctccgcccccgccccggaacccttgccggcgttgccgcctttgccgtggtgggcggaggacatgcttgcggaggacgacgattacttccccctcacggacgtggatcccgccggacagggaccggaagagctgagtgctatattgggcgcactcgtggcctccccgctcgaatccacttccctcgcgc

SEQ ID NO: 75744 - DNA, 174 bp, Triticum aestivum
  Clone ID: PAT_TA_75744
gcggctcgtccgccgcttcccgccgcatggcctacttaaccgagcccgccacgtccgtctccgccagcatgggccacgggcaggggatcgccgaacgggtcagggtccgcgagcttgatatggcctggcgctgccgtctggcctctgttgttgttacagatcccggcgcggggc

SEQ ID NO: 75745 - DNA, 438 bp, Triticum aestivum
  Clone ID: PAT_TA_75745
gcacagaggccttctacttcgctcggggccatgccgagcagtggccgcatctccccgccgcgccggagggccacgcccacggcgtcccttgcgaggtcacggccgtcgactacttcacggacggcgaggaaccctgcgcccggatcacgctcctgcctcgcccccacaaccctccgcctgcggccatcgacatccccgcgccgggcaggtttgtcttctacgccaagcagatacagcagggcgactggcaaaggtcctattttcaagtgcccaaggagtgcgagcggctgttcccgccgcaccaggccgcgggggacaagcaggacctgctgctgcgcgacatcagcggcaactcgtggaacatggagcacacgcatcggggcgcgacgcgttctctgtcaagggactggcaggatcttgtgcaccagaagggtgtcc

SEQ ID NO: 75746 - DNA, 472 bp, Triticum aestivum
  unsure (1)..(472): unsure at all n locations
  Clone ID: PAT_TA_75746
tcggccatcttcatgccacgttctcatttgcacggcagcgacacgagcggtgcctgtaggagctacttcgccctcgactcccgccagtctgggaccgagtctgtctatagctgccggccggagatngagggcgccaccggcttcacgccgctctcaccgacgagctgcgtgacgcagaggaccgcgtcggcgcctcggacggcctgagctaccttgactccaagaagcactggggggttctgtgtcgatatcgaggctgaggcatccatgttcttgggctcgagcttgcctaaccagccgtcgcctagagagcccatccgacccgactatagctcgcgtgcggactcttgcacgccaagccaccggtgccccgtccaagacgaggcgaagagacactccagttccctatcgctccatgaaaaaaaagttgccgccattagtcactcgggagtcgggagggtgtcggctgcta

SEQ ID NO: 75747 - DNA, 480 bp, Triticum aestivum
  Clone ID: PAT_TA_75747
acggcgaccggatccctactacttcacgatcgacctctactcgcgcaccaagggcatccccacaggcgagtccctcaagtcctgccctttcaccgtgggaggccaccgctggctcgtcctctactaccccaatggcgaccaggcggagaacgccggctacatatccctccgcctcatcctcgccgaagatacctcctggacggtcagggcgcagcaccagttccgcttcgccggccaggcggacaatcaggcgctgccgttcgaggcggagccgctgaacaacttcgccggcctggcgagctgggggaactcccagttcatccgaggggaggccctggagaaatcgaagcatctcaggggggactccttcgccgtccggtgcgacctcatcgtcgtcagcgacttccgcgcggtggagacgcctgagcctgccgctccggcattcgtcaccgtgccgccctccgacctgcacctgcacct

SEQ ID NO: 75748 - DNA, 445 bp, Triticum aestivum
  unsure (1)..(445): unsure at all n locations
  Clone ID: PAT_TA_75748
agctggccaccaaaggccgcccgcaatgtccgccccggccacaggcggcgccgagaagccccaccgcttccgccccggcaccgtcgacctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgaggcctacctngtgggcctcttcgaggacaccaacctctgcgccatccacgccaagcgcgtcaccatcatgcccaaggacatccagctcgcccgccgcatccgtggagagagggcctaagctctgttcgtcgtcgtctgttagtcgtcctcttagcctgatgtgttcatcggtggaaatgtgcgtgctagtgtttgttcgtgtcgtggt

SEQ ID NO: 75749 - DNA, 176 bp, Triticum aestivum
  Clone ID: PAT_TA_75749
cacggtcatccccgccgtgcccccctggttccagcggatgagttcgggagtgagaagcccgctggcctccccctgcctcttctcgacgtcgcgatgaacgcccgcaagccctactaaagaagaacgtaagcctctcttttcctggtgattgggccgtcacttcatgcactcattag

SEQ ID NO: 75750 - DNA, 245 bp, Triticum aestivum
  Clone ID: PAT_TA_75750
acggcgtgcacatggtggagcggcggccctcgacggctgcggcatctccgaccttgctgcgacggcgcctccctacgcgctgcaggacctagacgcccaagaattgcgctgcagattcgaccccccgcacgaccacgaccacgactacgcccacgggatctcctcgccgcgccggcttgcatgtctctccatctcctcccgtgcgtttgtgcgacctcgtgcatggaggctgcattagcagacgc

SEQ ID NO: 75751 - DNA, 237 bp, Triticum aestivum
  Clone ID: PAT_TA_75751
cctacggctgggcaccgcttgaatcgacctccagcatgggggcaatgcctgctaccgcgttgttccaagacggcgccgccacacgcccgtagtgcctccatggtcccctgcgtcgggttcgccagccggtctcctccgaccatgcatctgcatcagattcgtccagccgcgactgccctccacgccccgtcgcagcatcaccgagaacttgcttctaccgccgtgcagcccctcctc

SEQ ID NO: 75752 - DNA, 131 bp, Triticum aestivum
  Clone ID: PAT_TA_75752
accgagctactaggaggcggcgggacaagcgcgctcccgaaagctagagcggggcataggcggcggatctccgtattcgtcacgctcaaggtggtcgatcaggagcagcgcctggtccgccgcaccatcag

SEQ ID NO: 75753 - DNA, 208 bp, Triticum aestivum
  Clone ID: PAT_TA_75753
cggtggcggagctctaccacgccacgcggccgcttaagcgcgcggacgccggcagcaagcggaggagggaggagatcccgggaatcgataggaaggagggatcagatcgatcagcccactgggctaactgcgcatttgtgtaaatatgtcgttatgtacggtgtttacctttacttctctatttacctttttcgcctgtgcgagtggc

SEQ ID NO: 75754 - DNA, 470 bp, Triticum aestivum
  unsure (1)..(470): unsure at all n locations
  Clone ID: PAT_TA_75754
cctagcgagcacctggccgaggaggaagaggaaggtgagatggctcgcggcacggcgcgcacgcggctgcgctgccaagggcaagaagaaggggtccgtctccttcgtgatcgactgcaccaagcccgtggaggacaagatcatggagatcgcgtcgctagagaagttcctccaggagcgcatcaaggtcgccggcggcnaggccgggaatctcggcgactccgtcaccgtcacgcgcgacaagagcaaggtcaccgtcacctccgacggcgccttctccaagaggtacctcaagtacttaacaaagaagtacttgaagaagcacaacgtgcgggactggcttcgtgtgatcgcagcccacaaggagcgcaacgtgtaccagctccggtacttccacatcgctgagaacgagggccaggaggaggattagagtgcattgttatattgtagtgcttgttgagttttgatac

SEQ ID NO: 75755 - DNA, 406 bp, Triticum aestivum
  Clone ID: PAT_TA_75755
agggggatccggatgagttcaagagattcactgatcaaaaactggaggaaaggatcaagcactggagcggtaatcggaccctgtccgtacctgacggcggcgagaagatgcgtaagttcctatgcaggatgaagaaagagcttgatcgccgccgcgctgccgggccgaggaaggttgacacgggtcggagacagtcagcgcagacacccagtggggatgatccctacaccttcaaggaaagtgaccatatcaactgcagcaggttttctgataaatggcattgccatggtaagggcgaagcagcattcgctgatgagctaggccattttaacacaatgcaacgtgcttcccaagtggaagatcggaaaagagtaacgaacacagtgaatcatcaaccaaaaaggcg

SEQ ID NO: 75756 - DNA, 289 bp, Triticum aestivum
  Clone ID: PAT_TA_75756
atagcagtacttgactgtgtttcagcaatggagcagcagggtacatatccggtgcgtctgatatgggggcctccctgcgctccgaccaacactgcggtggtggaggtggcttctcggatcctcagcctcatcgaggaatcctccgccggcggtggaaatggctgctttctgagtgatgttgtgctgttcggaaactaggaccggatgaacgtcgaccaggacctcacgaagatcttcctggagaagcgtgttcgccgcctccagaagtgcttgatgccaagttcagggt

SEQ ID NO: 75757 - DNA, 227 bp, Triticum aestivum
  Clone ID: PAT_TA_75757
gaaaccagcaccatctccggcccctgcaccttcatctacttccataggggccacggaggagacatgggcgcagaccgggggccccgccgtgaccggcgaggagtattacatcaaggtagagggcaagctgttcgtcacgctacgccaggccgacgacagcctctcgtgcggcctgtgtggcgtgcacggctgcgacaagcgcggcatgatcagtcacctctacacca

SEQ ID NO: 75758 - DNA, 447 bp, Triticum aestivum
  Clone ID: PAT_TA_75758
gtgaactgcgcctccaccagtgttgcgcgacgggttgctgccgccatcgctcctccggcgctggccatgctcccttgtagcagagtgcggcgctgcttctccacacagccgtgtcggcaaggcggcggcaagaccgagaaggtgggcggcgatgcgagctctcgtcccgtgtaagccatgggaggacgaggtcgatgcggtcgtcggcgcgtcctccgctgcgggaggccatgagcgaaacgaaggaggcgtcgtcagctgcgtgcccgacctcgccacggacgccagcgaggcctacctccccttcacctctgaccggcaggttgctgccatggaaccatgttgacctgagctatgtgccaccatggtatcctgctctttagtttgtttgatccaattggtatcggttcgagtgtgtgatggaatggagatgaaagatcgtgacga

SEQ ID NO: 75759 - DNA, 126 bp, Triticum aestivum
  Clone ID: PAT_TA_75759
cgccggctcgcctcctcgccgcagcgctcccgaatcgaacgatgtacctcaaggtgttgtttgcatgggaggagtcaacgtcgccagtgccatagtcgtgcgccccactcaaatctgcaagggagc

SEQ ID NO: 75760 - DNA, 571 bp, Triticum aestivum
  unsure (1)..(571): unsure at all n locations
  Clone ID: PAT_TA_75760
aacagcagcgagcactgggatcagtaacgatccaacgtggacaggcagaacacctgcgagtaatacaatgactccatgcatagcatacgggatactggattctagcttttcgtcaacgggtggcgtgcggccggcgaggctacctgacaagaggggtggaggtgagagccagaggtcgcagtgatcggtccaggtccagccacagttaaggaggcggaagccgtggcagagggtccatccccgtacgcgccgctctgcggcgtcacctgcaccgacgctcccatctaactgtgttcacccctttgtcggcggcaggtgcgacgggcggaggcggtgacggcnagtggagtttgtatgggttgtgaaccagaagctatcctcaggcatccccgagcttgattgccgcctcggcgatggcatgccatgatcgatgatgcttgtgtctttcggacgctgtggtggtacgggacggtggtgaccagaggcccagagcagagccgtgaaaccaagtcatctttcttttcatgatctgtggtctctcatgtatcggtctgaattatctgcgctttca

SEQ ID NO: 75761 - DNA, 105 bp, Triticum aestivum
  Clone ID: PAT_TA_75761
tccgaccatggatcacagcccaaggcacaaaaaccagttgctgtccatggtaccaatacggaacctgtcgaacaatgctcagttccacagcccaggacaaaagtt

SEQ ID NO: 75762 - DNA, 247 bp, Triticum aestivum
  Clone ID: PAT_TA_75762
agcgctgacgggatcatccgttattctgaggacgtggggattataaacgatgatgaaccttgccgtcaaacatcatgtctgtccatgtatacagtacaagcaggcttgtatagcaccaagttagttggtttctccgttcgttgtgcccgtctgccttattcacccgtccatgtttattatattgacactgtgatccatcttatgttgaacctatcgtatgtgttcacctggctctggtaaattcgac

SEQ ID NO: 75763 - DNA, 296 bp, Triticum aestivum
  Clone ID: PAT_TA_75763
tcgagtgtgtggcgcggtactccgtccgctcatgggaaggcctaccacaataagctgggcgtaacaaggcgtcgttcgccggcaccggctccgggaagggcaaggccacgggcagcgggaatggtaagcgcgcgggcggggccggaccgggaggcgcgaaggcagcaggtggtgcgggcgctgtgggctggggagactcgtcgaccttctctgccaccggccatagcaccatccagactgtcagctggcaaacttaccggtcagtaaccattacgcgttcttccaaggcggccacc

SEQ ID NO: 75764 - DNA, 438 bp, Triticum aestivum
  Clone ID: PAT_TA_75764
gatctacgcttctcatccgcttattcttcataatcgatccaccggaatcaagctcagatgtgcacaacctcatcatcatcctgagatggagctcgatgctgcgcatggacaccacagacgcacacacgcacatccgcatcacctccatggtgccccgcttcagctttgcgcaaccacaacgccgcgcctggacggcatcgaccgacgcccacagcgcctccatggctccccgctttagctcggccatgacgtgtacctagacggcgccgcaggacgcccgtggtgcctccctgctgcacccgagatggttgtgtcctgccacaaggccgcgcctggacgatgccgtcgcatgccctcagcgcgtcaccggcagccagtgccttccttgtgccctgtgttggctttgtccgaccggctacttccgattgtccgcatcgg

SEQ ID NO: 75765 - DNA, 117 bp, Triticum aestivum
  Clone ID: PAT_TA_75765
gttcacggcctcggcttcaagccctggataaaagagcgggcagccgtgacattcacgccgggaaacgactgggcaaagatcgcctgctcccgcaagcaggccaccggctgcggcgac

SEQ ID NO: 75766 - DNA, 391 bp, Triticum aestivum
  unsure (1)..(391): unsure at all n locations
  Clone ID: PAT_TA_75766
tgtcccccgatcggtcatgcggccgtgcctccgtttccaccggagggttgctcgctaggtcatttccccagcgagtggggcgccgcggagagccgtgtctctngccggatactggacggctgctcctcgcgcgcacgtcagggatggacgccctgtcgagagcactacaccgtgctggtatggtggccattgccttcggcgactggagcggtcagctgacgtcggctgcaatggttgctgtcctgaagaaaaagtgtggctgtagctttgtgaagtaatgtactcatggctatagttgcggtgtgcaaatttagatcacatgagatgtgttgtgctctgaactatggattgaagttgactcagctgtgatgtttgctatggtttgaacatg

SEQ ID NO: 75767 - DNA, 212 bp, Triticum aestivum
  Clone ID: PAT_TA_75767
gcttcagccccaacaccctcttcttcctccagaccaccgtcgggactcgggagatggccgcagccgtgcacttcaatcacggacgagcgtctggccgttctcctcgaggagatcttcctccggctgcctaccccagctgaccacgtccgcgcctccgttgccttgcgccaagtcgactctctccgccagctcctcgccgaccgctccttcct

SEQ ID NO: 75768 - DNA, 270 bp, Triticum aestivum
  Clone ID: PAT_TA_75768
ggcggctgagagagtgaggtttgatggacagagacaacatcggggatcagataacaccgagaggtcgcggatgggaaaagcgcggcatcggtgatggcggatccggaggacgcccagataagaagaaacgtaactgcggtcgcggacgctcggaggggtagtagtgaagggtgtcgtcgcgccgcttgcgaccgtgtcgggaccatctggagatcgggagcagccaccggtcgctgcgagtaagcgtgcaccaccgtcgccgtgagcagc

SEQ ID NO: 75769 - DNA, 602 bp, Triticum aestivum
  Clone ID: PAT_TA_75769
tcggcacgagggcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctcactgagagtggtaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggt

SEQ ID NO: 75770 - DNA, 712 bp, Triticum aestivum
  Clone ID: PAT_TA_75770
attcggcacgagggctcgacatgctcaacccttccgaggaggaggtctttgccatctgcggtgcattccgtgttcaccctctgacgcgcgaggatattacaacccaggagacccgcgagaaagttgagcttttcaagtcctactacttcctgtgctttaggtccttctactctcttgacaaggagagtgaggattacctcgagcccatcaatatctacgctgtggtgttcagggaaggcctcctcacgttctcgttctgccagaaccctcacgcagccaacgtgcgcaagcgtattggtcgtctgcgtgactacgtcaacctctccgccgactggatctgttacgctctcatcgacgagattgtcgactccttcgcaccggtcctgcacgacgtcgagaatgagtccgaggccatcgaagacggcatcttcaccgctcgcttcgaagactcgcgcgccatcatgcagcagcttggctcctgccgcaagcgcgtcatgacactgctgcgtcttcttggcggcaaagccgacgtgatcaagggcttcgccaagaagtgtaacgaatcgtacgccatggcgccccgcggcgacgtcggtctgtacctttccgacgtccaggatcacgtggtgacgatgatgtccaacctgacgcacttcgagaagatgttggctcgcgcgcacaccaatcacctgtctcaggtccagcttgccca

SEQ ID NO: 75771 - DNA, 444 bp, Triticum aestivum
  Clone ID: PAT_TA_75771
gaggcttgatgtgccgccgccaccatctcccgtcgcggccgccgcgacgctaccccatcttcgacagcgaccgccgccctgcccaagacccccccggcaccctggatcccgccaccgcccgcagcccagccggcgacgccgccatctccctgcaccggatcaatgcccacatctacacttgtacacttttttcagttgacaccgtaggtattttttcagtacacgttgtcgggttttttcagttcaatagaatccaatagaaaaaaattgcggctgggcgaggattcattagttcatggagcaaaaagttgtacggtgttgattcagcttctgtactttttcttgtttcagacatttggtacctcttgtcaactagatatgttaatacatgtgcccatgtgccaaaagaggttgagctgcctgtccaaaaaaaaaaaaaaaaaa

SEQ ID NO: 75772 - DNA, 640 bp, Triticum aestivum
  Clone ID: PAT_TA_75772
gaattcggcacgaggccccaatctcccgtcgcagccctcgaatctcccccgagcatcgaccatgtcggcctactgcggcaagtacaaggatgagctcatcaagaacgctgcctacattggcacccctggcaagggtatcctcgctgctgatgagtccaccggcaccatcggcaagcgcttcgccagcatcaacgaccagcatgtcctccttgagggcaccctcctgaagcccaacatggtcacccctggatccgacgccaagaaggtggcccctgaggtgattgctgagtacaccgtccgcaccctccagaggaccgtccctgctgccgtccccgccattgtcttcctctccggtggacagagtgaggaggaggcgaccctgaacctgaacgccatgaacaagctccagaccaagaagccctggaacctgtccttctccttcgggcgtgccctccagcagagcaccctcaaggcctggtccggcaagacggagaacgaggagaaggccaggacggcgttccctggtgaggtgcaaggccaactccgaggccacccttggcacctacaagggcgacgccactccttggcgagggcgcctctgagagcctccacgtcaaggactacaagtactgatctatct

SEQ ID NO: 75773 - DNA, 798 bp, Triticum aestivum
  Clone ID: PAT_TA_75773
gagggtggaaccaggctctgccttgttgctcaggtttatgctcctcttgcgaagcttaacattgaagagaggacactgtatgtgcttgtttgcccggcgccaaaatgcagccctaacccccaaagttggaaggtcctaagggttcagaagtgccatactggtatgcaatcaaatgataatggggatgggtcagtccaaaatatagaaaaggtttgctcaaatgagccaactccttcatgttctgcgggaaaacataacgaagaagcaaacaagagttccaacagcaatgatgatgattttgattttgatgccttggctgcagcactcgagcaggctgcaacagtggcatccaacacaaagaagaaaaacaaatcaaagcgtgctaataatgtccctagaaaatgcgttgtagtgaaagagaaagtaaatgacctcagtataccagttcttccttgtttctatatctattacgatacggagcaatcgaggggaaaaaccagtgtaggttgtagtagctatgaaaaacttttggcagaagagataatggacatgggtaatgatgaagaagaaaaatgggaaggagaaaagtatgaatatgataaagctcctggggccgacagaactttcttaaaatttaagaaacggttggatgcatatcctcaacaatgctttaggtattcttgtgctggtagtccactgttggctacaactaactcacaagatgttggcacatgtaaagctttgtggttcacgataccaatatgaacttcaactgatgtccccattatcatattttct

SEQ ID NO: 75774 - DNA, 668 bp, Triticum aestivum
  Clone ID: PAT_TA_75774
tcggcacgaggcgtttacttgttgtaaacgtcctcgctcccctcgccttccccttgcccgtctccgcctcaatctccggcggcgtgcgcgagcgcgctcgatcccctcctcctctccagccccagtttttagatggacaaccatacttcatcaccgccccatgaagtaacaatggacatctcatcggcatccgggagcaaaatgtgcagaggtgcttcttgcgacttcgccgactccaccaacacctccaaagacgcaaaggagaggtctgcgtccatgaggaagctcctgatcgccgtgatcctctgcgttatattcatggcggttgaggtggttggaggcatcaaggcaaacagccttgcgatcttgactgatgcggcccatctcctctcggacgtcgccgccttcgccatatctctcttctccctgtgggcagctggttgggaagcgacgcctcggcagtcatacggatttttccgtatagagattcttggggcactggtttctattcagctcatatggctcctcgccggcatactcgtctacgaagctatcatgaggctcgtcaatggaagcgggggcgaggtgcagggatccctcatgttcgcggtatcagcttttggtctgttcgttaacattgtgatggcagtgctgcttggtcatgacca

SEQ ID NO: 75775 - DNA, 698 bp, Triticum aestivum
  Clone ID: PAT_TA_75775
tcggcacgagggtcatcttgacgagcttattgatggtgtacgcttggttggtaggcatgatggtgatgtgacagatttgtccatatctcagtggatgactacccgactcgcttcaggatcaaatgatggcacggtaaagatttgggacgatcgcaagttagcgcctctatcgattctaaagccacatgatggtcaagctgtttactcagttgcctttcttacagcacctgagcgcccgcatcatataaatctcatcactgctggtcctctaaaccgagaaattaaaatttgggcttctactaatgaagaaggttggttgttgccaagcgactctgagacttggaattgcacccagaccctggaacttgttagttctctggaacctaaagtcgaggaggcatttttcaaccaagttgcagtgctgcctcaagcaagcattatcttacttgcgaatgcgaagaagaatgctatttacgctgtgcatgttgagtatggctcagaccccgcttctacccgcttggattatatcgcagattttacagtcgcgatgcctattttaagtcttactggcacacatgtaagccaacctgatggtgagcaggtagttcaagtctattgtgtccaaacaatggccatccagcagtatgggctggagttatcactttgttcacctcctacttctgatactacctcatttg

SEQ ID NO: 75776 - DNA, 661 bp, Triticum aestivum
  Clone ID: PAT_TA_75776
cggcacgaggtgatgtctaaactgaatctcaagtgcaattgggagctgtgaaagggggtgtggatcatgagcattttgccagtgatctatgcactactccctttgttggtactcgggtcacgaggaaagctagctgcgctagcatcaggaggcgtaacaagttacaaccctacaggaggctgggtgcaaccctcacatggcacgctccacggttgcccaaagagctgtggaaatgtgagcatcggctaccccttcggcatcggatccaggtgttcccggggggccgacttcaacctcacctacaacgacaccgcgcgttcccctagactgtatttgcgtgatggcatcacccaggtgattagctttgaagaatcttttctggtagtaactccatcacggcctccttctcgcataccatgcctatgcaacctggtgtcagtgtctacaacttgtctttgaaactgccaatccaactgtgttgctgccaagaaaaacaggacagactatgcatgtatcagtgagcatgccgagtgctttgacggaagccatggctacaactgcatgtgcagcattggctatacaggcaacccctactttccagatggttgctccaagctcgacaacagagggtataatccaattccgagcagggctgattgca

SEQ ID NO: 75777 - DNA, 689 bp, Triticum aestivum
  Clone ID: PAT_TA_75777
attcggcacgaggactttcactctctgtatgtctatgacaccgaaagtgctgctccaattctaatacatgctggtctacattatgccgccattacggatattgcatggtctcctgatgcgaagtacttgtcattgtcatcacgagatggttactgcactattattgagtttgagaatgaggaactagggcagccacatgccctctcaggaaaaaaggaagttacagagggaaatgtcacatgcagaaataccaagccaccaacagtagatagcatggaagttgatgtcagtacccgcaaaattaagaagtcaggcagccccgtgggtacagtgacacctccaccagtgttggccgaaaatagcacattgagaatgaaggaaggaaatgtggcctgtgaacatgcaaagccaaaggcagacagcatggacgttgatgttggtgccagcaaagctaagacggaagccagtcctatgtctgtagaggtgacatcgccaccagtgtcagcccagaagagtgcatcgagtaagcctactaagaagcgaattactcctattgcaattaactaagtagcagaagtagttagaatcatgatatcctttgtattgacaacaagtactggaaactacaaattaggttactctgtaaagaaatgtagcctgctgctgttttcaccttctgctgtagtccc

SEQ ID NO: 75778 - DNA, 700 bp, Triticum aestivum
  Clone ID: PAT_TA_75778
gcacgaggcaaggcacaaacgatgacgcgtcaatatcaagatgttcgatggtcagtcgctggttatattggaagataattatgctccattactcatcaaaaaatctcaaaaaatcaaaagaccgcctttaattaatagggggacatatgtccgaacggttataattgacaatcttttaaaatcctttttaaaaacatttgatggctcgcaagtggtttcttttggttccggtagcgatacaagatatttgcgcttgaaggatcaactatccaattcaaattgcaaatactttgaaattgatttccctgaagtaactgctaaaaaatcaatgttcttaaacaagaacaaatggttgagtgatactgcccgtttcacaggatgcgacgtggattctccgcaatattcattgatttcagccgatttgcgagattttaagaatgttgtgtcgaaatttcaagatcgggcattcgatttgagtaaacctacatttttcttgtccgaatgtacgttgatctacattgatcctgttatttctaatgagatactcagttggatttctagctcaatgattggttttgtttatttggaatcatgatgcttcaaaatctaaaggctagaaatttggaactgccaggaattcatgcgtttccgactcttgacagccaaaaggagagatttttatctgcttgttttgatcatg

SEQ ID NO: 75779 - DNA, 761 bp, Triticum aestivum
  Clone ID: PAT_TA_75779
ggcacgagggtcttctgggcgagctttgaagatctcgccaacgacctcaagtcgtgcttcctctactttgctgctttctccaagaacataggattctatgccgacgaggtcgtgcggatgtggatcggcgagggcttcatcaaaccgcaaaagggcaagaccatagaggagttgggccacggctacctcaaggaactggtcttgagatgccttgttgacatcctggagatggttgacggtgacattaagataatcaaggtccacccaagactccatgtgttcctgcagtcagaggttcgcgaggccggctttgttgagcttcacgacacgaatgatgtgtttgtgtcaccatcagttcgccgcctctctttccgcagttttgatagaaaaaaagtcaagttcaccaagaagctccctaagctacgctccttcatttgccgcgtggaggagagtgagccagaacagaggaatgatcgtttctatgatctcaactttctgcgtggatccaagttcctccgtctaatctatgtgaatgggttgaggctctgtgaattgccccatgacatcggaaaaatgattcatttgcggtacctatatgttcgctgcaaggacctcaaggagctcccgcgcagcattaaggggctgctcaacttgcagactctggacataagggagactctagtcgacaagattgacccaggcttctggaagataaagacactccgacatgtgctcgcagagcagctcacgcttccaaaaac

SEQ ID NO: 75780 - DNA, 574 bp, Triticum aestivum
  Clone ID: PAT_TA_75780
gaggccgtcatcggggtcggggtggggacaactgaaaggatagtgtatcccggggatgacttcgacgcgacgccgtctgtggtcgccggagacggcgacggggtggtgaacctggcgagcgccatggcggtggagacgccgtggagccgccgtggtggggattttaggatggtcaaggtgctcaacatgtctcataatgcccttgtggtggatgatcgagcgcttgagatcatcatgcgagagattcaacgggctgattaggtaatcggttttgctacaactcagctcagttgtagttatggtctcattcacctggacagccgttggatcaaaagcattctgacattcgtgtgttgttgtgtccttgttcaatcgttcaccgtgcagcggtcttgttaatgggcctttttcgcgagcttttgctcgttggttcgatgctaccagctgctttatccctgggtcgtcatgtttgatttgaccagcctgatggtctttctttcattcatgtaaatattctgacggttcaataaaaagtttcggagtttgtaaaaaaaaaaaaaaaaaaaaaaaaaaa

SEQ ID NO: 75781 - DNA, 660 bp, Triticum aestivum
  Clone ID: PAT_TA_75781
attcggccgaggcggcgctcgtggagctgctgctggacgagcccgagcggcgggtctgcgagctcgcgctggccgtgctggaccggctgtgcacgtgcgccgaggggcgcgccgagctggtggcgcacgcggcgggcgtggccgtggtgggcaagaaggtgctgcgggtgtcggaggcggccagcgagcgggcggtgcgcgtgctgaggtccgtcgcacggcaacgcggcgacgccggccgtgctgcaggagatggcgcaggccggcgtcgtgggcaagctgtgcctggcgctgcggtccgagctgtgcggggtgaagaccaaagagaaggcgcacgaggtgctcaagctgcactccaggatctggaggagctcaccgtgcttgtctcccaagttcttggcgctctacccttcgtgacgatcaatgccttccgactcccgtcccgttcatcagaatgctcagctgttgattcattctttccctgtgttgttgttaccttttcttttttaaaaaaaattggatctggagggcactggttcgtgcctacaaaagagaaatacatcgacaccgagcttttttggttgcctacttattctgtggacgatgatcccatttctttcatcagagataaatgattttgccaaaaaaaaaaaaaaaaaa

SEQ ID NO: 75782 - DNA, 520 bp, Triticum aestivum
  Clone ID: PAT_TA_75782
gaggctcgtgtccacaaactacgaccgcaaatggatcgccaagtaccgccacgccctctccatgctctccatctacccggtcatggacttggacgccgacaacgaggtgcgctgcttcccgtcggtgcatgtgggaacggagagccataaggagctagggattgactcggctctctccggcaagggctacacgacgatgggttttcgcggcctgctccggtcggcttactctctgaagcgtgagtgggtgacccccataaagagtggaaggcctcgtctcgtcatggtgctgcggaggaactcgagggcgctgacgaacgaggcggaagttatagcagctgccactgaggttggcttcgaggtggtagccgcggggccggaggttgtgcgcgacctgggcaagttcgcggggacggtgaactcgtgcgacgtgctggtgggcgtgcacggcgcggggctgagcaacatggtgttcctcccgcgcaacggcacggtggtgcagatcgtcccttggggcgag

SEQ ID NO: 75783 - DNA, 748 bp, Triticum aestivum
  Clone ID: PAT_TA_75783
tcggcacgaggagagagagagagaactcgagtgcacaggagttcgttatctgtcccgttcggtactgcgctgtgattcggtgcattgaatgctcgcaacaggcccgtggtcgaccaggaatttggaaattgagatatacgtagaggtgcagacctgactggtgggcaatagctctgacggacgttgggccgccgtcgactgatcggaggagagccatggctcgggacgtcggtgccgtcccgatccatggttcagaattgttgctttttcggtagtatcgatagtgatcgagtaaatgcagggatgggtagatgcaagcaactgtctcctaccttacgagactagatctttcttctcttgaggtcggtgatcgggaggaggcgagtgcggctgccggagaagatggacttcttgatgcaaccgattaacagtagtgttttgctgtaggaggtgaacgacagtgacaaacccatggagcccctctggtacccagtgatggcgcagcttcgcggccagatctgtgagacggaagtggcggcgcagccccttgtcgagatcgaccccaagcctcagagcaaatccataaagcacatcgaccccaagcctcagagcaaatccatagagcagatcgaccccaagagtccaggatggacgcgtaggggaagcatatagtggagaacacaagatcctgtcgtggcgaatgccctgctctcataagacttttgtgttcgaaagacaacgggtggta

SEQ ID NO: 75784 - DNA, 695 bp, Triticum aestivum
  Clone ID: PAT_TA_75784
gatggccaccagcaccaacatgaagggcgtggctcttctcctcgctcttgcagcgacgctcctgtcctactgcagtgcctctgcctcctcgccggttgcagatgcagctccggctccggctccctacgctgatggtgcatccccgccttacggcgccttcctgctggccccggctgcctatgctgaggcaccaacgacggcgcaccatgcacctgcactggggaagcatcaccacgatgccaagtccccggccgagccaccggcattccgcaacgcgtctgagcacgggaagcgtcaccaccatgatagctcgccggtggaggcaccggcgccataccacagcaatgcgtccgagcacaagcaccatggtcacctcggccacggcaatgcatctgagcataagcaccacggtcacctcgggcactaccaccagcaccacgaagctccacccccggctcacagtgcaccaccgcctcacttgccgcctcctgcttatcactcaccaccgccgcctgctcaccatttgtcaccccctgctcacccttcgccgccgcccccggcacaccacttgccaccccctgctcacccttcgccgccgcccccggcacaccacttgccaccccctgctcacccttcgccgccgcccccggcacaccacttgccaccccctgctcaccattcgccacctccccctg

SEQ ID NO: 75785 - DNA, 752 bp, Triticum aestivum
  Clone ID: PAT_TA_75785
cggcacgagggtcccgtagcgtagcactacctttcacaccgcccgtcgtggacggagcacacacacatacaaatcgaccgatgggcctggatgagaagagcgtggccatcgtgggcgccggcgtgagcggcctggcggcgtgcaagcacctgctggagcgcggctgccggccggtggtctttgatgcgggcgacgccgtcgggggcgtgtggccgaacgccatggaggggaccaggctccaggcgccacggcacatgtatcgctactccgacttcccctggccggactccgtgacggagatgttccccaaccagcgccaggtcgccgactacctccacgcctacgcgcgccgcttcggcgtgctcgactgcgtcaggctcggccaccgcgtgaccagcatggagtacgtcggcgtggcagaggaggaggtggtggctgtgggaggagtgggccggctgcggccaggcgttcggctccagcgacagggagtggcgcctcacggtggccgacgacgaaggtcacatagaggtacacatggtagactttgtgattctttgtacgggaaggtttagcaattatcccaacatacccaatttccctcctggtagaggcccagaagcatttgatgggaaagtgatccactccatggactactccaaaatgggtagtgagaaagctcaggagatgatcaaggacaagtgtgtgactgtcgttggctatggaaattcagcccttgacattgctaatgaatg

SEQ ID NO: 75786 - DNA, 651 bp, Triticum aestivum
  Clone ID: PAT_TA_75786
tcggcacgaggagggttccggctcctaggggagccgggcaatagttatgacttattgcttaatttcaaaaggtggccttccaactgtttatataatccttgctgctaataaaaataagataagttgggctaagcccctaactagacgtgcccatttggccttctccggctataagtgacgccagtcataacagtagtcataataacttccatgacctcgtgattgcttgttaaattcctttgaatttaattttttattttgccctgaaaatgcttcaggccagctatttcccgccgtaggttcctacagcaaatacagttgtcctaacaggatcatcctcatttcctttgtgctactatgtccttcccatggcaagatatgcaccacttttaccttttctctgcacaagttcagtcttctccccttgctcactccagtcccgatttcttgcttctaggaagtggactctaggtgttctgacatagatattcctaggaataactaagaaacttttggttaatcagctgctaatactgtaaaaccagaaatagttcaggttcttttaattgtgaaaccatctcttcttattggttgtaaccataaattaaattctgatatcaaggaactgcgtaggatgaagtatctgctact

SEQ ID NO: 75787 - DNA, 595 bp, Triticum aestivum
  Clone ID: PAT_TA_75787
tcggcacgaggggaaaaaaaaactacaagatgcaaacaggtcttgatcagcggttggcgctctgaatcagctcaacatatatgctcgcctagagggagctgatcggtgcggaaagttgttgaccagcctataacaaaatgccgcggctcctcctgcttctcttcctttgcgtctcggtgttggccgctgcacctgcacaggcctatcaagacaagtgcgacatcaaagccgccgttggcaacgattcagacaccggcaaaaatgaggcgcccgggatcgacgatctgttctatgttatggacatcgacatcgagctcgagcaggccaccggcttggaattgggtttgtctcagggtgatgctatcgaaatggaccaacctattcctagtaccagcgccgccttccaatcaccggatttaatcaactgccgggcgatcaactggacgattgaggagcgccgtcgtgcttgcctggcccgcattgtcagtcatgtttactccagggagaagaaagctatccccctaagtcccgacacaggcttccgcctccacggggagccgctcgaggacggcgactacgtctatgctgccatcta

SEQ ID NO: 75788 - DNA, 729 bp, Triticum aestivum
  Clone ID: PAT_TA_75788
tcggcacgaggacggtccagtgatcaatagtgtcactgtcactgtcaggaccactgaccccactcacgttcccgcacttggctccatcaccatgacgagtggatccagttccgcatcctcatcctcttccacgggatccgcctccacgcttcaacattacatgtctcaattggatgtagcgctgtcgtctcatgactcgacttccgcctccaccacctccacctccacctccacctccactgttgcttctgctcaagctcatgtgacacgccatgtgactcaaccgacatatgatcggggcatgtttgagctggccatacgcaacctcatgcaaatatggtgcaccaaacacgatcacagcaccaaccccaacgccaacaccaacatcacaccagcaccgtggactccatccagtcgcacggccatgttatttgatgtcacatgctgggcagccaaacagaaatatttggatgaatcggcccctttccaattactcgaagatatctttgacgtgctgcccttgtcccaatgtgatgctttcctggcttttttttcgaacccgaacctcagtactcacgtccattcatgcattttctgtggaacaaacctcccgacctaagcttgcgttattacgtgtatattccacattatcgcgacggttatcgcgaacaacacatacagctatggcaggggaattgcttatgttgttagctaatatcatgccgctcg

SEQ ID NO: 75789 - DNA, 630 bp, Triticum aestivum
  Clone ID: PAT_TA_75789
ggcacgaggcacgtgtcggcggcggcgccgatcgacaaggtcctcaagggggacgccaagactcgggctctacaccacgagcttcatgctcaagttcgcgctcggccaggtgatgggctcgtaccgcaagcgcaccaagcggcttttcgagcggctcaacccgtgggtgccggacatgtacgtgaaccgtaaggacatcatcagcatggggcatattgagtacttcgagcagcggcagcaggtggccaagggcttctcccgcgtcgccaaaaccgggtcgagactgtcgtaccgtgatatgttccactccatgttcggcgccaagacgctcaagccccacctgctgccgtcggcgaggctcaactccagcaccgacagtgacgcgcacagccttcggcagtggtggaagccggatagtcgactgtcgttgagcaccaagacctacagctacccacacggctaatgcttgcttggtgccgctggtcggatctcggctgtaataaaaaccaggagtactcaactacagggtacatgcatgcggcatcaggtttttcgtcccatagtcccaaatcaggacagtaggttttcctgaagcacatgtgtatccagtcattgttactttttcttttt

SEQ ID NO: 75790 - DNA, 628 bp, Triticum aestivum
  Clone ID: PAT_TA_75790
tcggcacgaggccatggctgagctcgagcccgggcgcggcggagctttgttgagcacggtggcgaccaggccatggccgagctcgagctcgagcgtctcgttctcccatggctcctgcgcgtgccgcccctgggttctgaaaagcaactgtttgttcccttcgtcgagtcttcgaccgtcctgcgaactgttgcgtcgagatgttgcaaggcttatggactctgttgttggttggtctgtgttgttgttttttatcgtcttcaggcaagccatgttctctcggtctgttcggttctgagctttgcatcctgctgcgtctcttcgtcacctagggcatcctctcgagcttcctcgagttggatttgcagaccaaggacacacattctggagagctccttggtcatcagctggtccatcacatgagagtggatgtttcagaatggtgcgggcaggttgagcagcaatagatgttttttaagttctagattgttactaccgagaatggaattggagaagagatagcttttggtgttgtccttttacctcacgtatctgacagacgacagaaaactatcagtttagttggcaaaacaaaaaagttcagatcagttgtgaggatatatgatga

SEQ ID NO: 75791 - DNA, 500 bp, Triticum aestivum
  Clone ID: PAT_TA_75791
cggcacgaggcagtggccaacgctgcaggtggtagtgaagggcccgaccccagggaggttgagatttatcttgaggaaattcttgcgttgacacaacttggtgaagactataccgagtttatggtgaacaagatccgtggactgagggatgtcaagcctgaactcggtccgcaagcaatgaaagccttccgtaatggtagctttaataaaatggaaaaggatttgactgggtattatgtgatcttggaggagttcttcatggtggagaacataaggaaggccatccagattgatgagccagtgcctgatggtctcacgacctcaatggtcgacgatgtgttctttctactgcagagctgctgccggcgggcagctttcactgcaagcatcaactcactacttgctgtgcttggtggggcaacaagcctactaagcaatgagttccaggaggcactacagtggagaatgagggagccaaacttgggcgcaaagctcttctt

SEQ ID NO: 75792 - DNA, 629 bp, Triticum aestivum
  Clone ID: PAT_TA_75792
attcggacgaggctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacctc

SEQ ID NO: 75793 - DNA, 580 bp, Triticum aestivum
  Clone ID: PAT_TA_75793
attcggcacgagggtcgctctgaccagaagagttcagaaggtcagggatgaaatagaacaactaatggatgatgatggagatatggctgagatgtatcttaccgagaaaaagatgaggatggaatcatcatctgtgtttggtgatcagtcattggcaaccttcaacgcggcagccgctgggacttcagtttcagctcctgtgtctccagtctcttcacccacagaatcacggaagttggagaaaacctacagcttgtgtagaggtagacatgatagtgtaaagagctcagataactcagtgactgaacatattgaggagcttgaaatgttactggaagcatattttgtagtcatcgacagcactcttaacaagctgacctcgctgaaggagtatattgatgacaccgaagattttatcaacattcagctggacaacgtccggaatcagctgatccagtttgagcttctgctaacaactgcaacatttgtcgtcgccattttcggagtggtcgcgggggtattcgggatgaacttcgagaccgacgttttcagcatccagaatgcattccagtgggtgctg

SEQ ID NO: 75794 - DNA, 531 bp, Triticum aestivum
  Clone ID: PAT_TA_75794
attcggcacgaggcttggctgctctgcgtgctggcgttgactcggtgggcttccgccggcgtctctccccggcgagtcgagtgtgggtgggtggcgccccccttcttctccgacggatctgggcgtcctcctcgcgttcgactttgggttggctcctggcggctctctcagcaatccggtggctgcagctcgtcagatctgccggctgcgaccggatccggctcttccacggtggtgggaggccgtgccggcttggtctccgggctggtggctgtatgtggctgggcagtgcggctggggctgcggcttcgttcctttcggctcggtagctggccctggcaggtttcgggatggtgtggcagtcctcccccggctccggtgttgcgaggagggtctgtggctgtgtggtggtgcagcgcgaggtgggtgccagatctgctggttctcgcaggcttcgaggtttgaggtggccctgcgtggcggtggcgcgaccgctgcgtcacgtgtgtgcgggtcagcggaggtgctgtc

SEQ ID NO: 75795 - DNA, 503 bp, Triticum aestivum
  Clone ID: PAT_TA_75795
cggcacgagggggacgttgaggaggaggctgagagcgacggcgagaagaaggccgccgtggccgcggcggccaagggcaaggcgtggggtacggggacgaagaagacccgcggccccggcaagaactcggctctgagccgcaagaaggcggcggcagctgcggaagaagcggcttcggcggcggctgagaagaaggacaacggggactccgacggggcggccgccggtgggctgcccaagaagcggatcgccgtggacttcctgaagcggctgaaccagggcaagtcgtcgcccccgaagaagagagggtcgccgctgacgaagcggaagcggtcggcgccggcgccggagggaggaggaggagcagcagcccaaggccaggagggggccaggcaggaagaacaccggccgcggtggctccaaggcaggagccaagtctagcgcgacgaagaaaagtgtcgggcggccacagaaacggggcgctgctccggcgactccgccgc

SEQ ID NO: 75796 - DNA, 566 bp, Triticum aestivum
  Clone ID: PAT_TA_75796
attcggcacgaggggaaaactcaactcctttaacctacccttttacggtccatcacttaccgaagtcaagatggtgatcaagcaaagtggactattcgacataaatcacatcgaattgttcgaatccaactgggatcctcgcgacaactcggaaagcaatgaagtgcacgaccccctccgaagcggcatgaatgtgtccaagagtttgagggcagtgatggagccccttttcacaagtcattttggtgaatctgtgctcgacatactcttcaacaaattcgcgtacaatgtcgcggaacaccttgcgagggagaagacaaagtattccatcattgttctgtccttgaaaagaaaataatggaggtctacattgattgtgtatcttgacttgttttatctctctatgaacttaatcatctaccaggtcttgtttagttgttgactctgtcccgaaatgggggttttcaagttttgtcgtcctcggctgtgttcaccttggatgtagactcttttgtgtttgtatctcccatataaattgggaagaatcaacaggacgatactccctc

SEQ ID NO: 75797 - DNA, 711 bp, Triticum aestivum
  Clone ID: PAT_TA_75797
tcggcacgaggatgagttatatgcacaaactaacattttattcattgcctacattgcaatttggaatatcaacttgccagattggtaagtaatatttatgctgtttgcaatggggtgttaccttttcaagtaaacaatatgaacactgaaaccaaattaacggtttagtcattaatgatgtgtctgaatgatatacttggatacctcatgttttctcagatttcagtttacaagcaactgtttggtcgttcagtggtcaggggacaaccccaatagccttgcaggtatttggggtaactgacgtccctgaaccatccctggatggaaacatccttcctaatccagttgaccccagcacctacatggttatgctttgctacaaaaatggatctctaactcgagaagacattcgcgatcgttatgctgagaaatcatgggatgtgttcaacaacttgcttgagcaaacagaccccttaaatggagggaaactaggattttactacaaggagcacgagatcctgccaccacttccagtcgggtttcaccgctacattgttgacactttaaccagtggaccattagctgagaccaaggaacgtcagaaggacgagtttgatcctccgtcagagtttccaccggtggtttaacaaggagttattcaggtgcgcgcgttaatagaaggccagttcatgtccatgaggggacatgctg

SEQ ID NO: 75798 - DNA, 646 bp, Triticum aestivum
  Clone ID: PAT_TA_75798
tcggcacgagggtcgcgttctctgacggcatgatgaggggcttccgctccgtgctcgctcgcgctgcggcgcggacgcgggcggagctccagggcacgcgcggccgccgactgtcccactgcgccgcggcgccggcgaggccttccttcggcatcgccttcgacatcgatggggtcatcctgcgcggccgtagccctatcgggggctcgccgcaggccatccgacgcctttactccgacgatggtaccctgaagattccttttctcttcttaaccaatggaggtggtgttccagagcataaacgggccctagaattaagtgagcttttgggagttaacatctctccagcacaggttgtgcatggccattctccttacagagatctggtaaagcgttttgaagatgatcttattgttgctgttggaaaaggagagcctgcatcagtgatggctgagtatgggtttagaaaggttctgtccatagatgactattcatcacattttaaggaaattgaccccctagctcctttcaagaaatggaaagtgggacaaccaaactgtaaagactttatgtctgagaaaatgcatccaccatatgatgtttaccaggagagagttaaaggagtgtttgttgtcagtgaccctgt

SEQ ID NO: 75799 - DNA, 672 bp, Triticum aestivum
  Clone ID: PAT_TA_75799
tcggcacgaggccactccaatcctcgacaaggtgaaccggagtgcggatggaggtggctgtcggcgcggcgagctcgctccttggcaagttgctcacgaagctgtctgaagacctggtggccgcgtatgtccacagccttgagctcggccacaactcccagcagatcaaaacaaaactgttgcacacacaagggctgctgcaagtggccgaggggagggacgtgagcaacgtcaccgccctgcaggccttgttggaggagctgagcaagaaggccgacgaggcggaggactcgctggatgagctccactacttcaagatccaggaccagctcgacggcaccaactatgcggcgccggatctcggcgatagcctccgcggccatgctcgccatggtggccatgctgctcgccacaccatcggaagcgtggtagcttttgttccgcacatacttctgaaatgatgtattacacctttcatgtgccagctgcatggtaaatacaaagactaaggcgacagctgatcgatggacctatagatgaatgtatctatttttatttacctttttttaacataatctcatcaggacaggaagcaggcttgtgaataattggtcctttttttttcaataaatcagatcgattctgcaaatttgcctctagttctgcttttaa

SEQ ID NO: 75800 - DNA, 534 bp, Triticum aestivum
  Clone ID: PAT_TA_75800
attcggacgaggcgacaacaccacccgtcctggccagccccggctgctcctcgacgagcgcggcatattcgaggtcagtgacatcctcccggaagaacggttggtgagcgtgctgagaccccctatctttggggacgccgccaggaacatcagcacctccggcgccgtcatgagggggtcgtggggcggcgggggcctccgcgacgacctcggccagtactccatggccattctgcctgggcctggcgccgcgtccccaaacctgctggtggtcacggggtgcaacgtccaggcgacgctgctcaccagagcgcgtggcaaggccaacgtcgccaccggctgcaccacctactgccccctggacgctcccctcagcgcgcaagatgtcgacgacgacccccaggtcggctactgcagcgtccccatcacgacgcaccagacctactacgacgtggagctcaaacggctcggcaacggcagcgccaccatcaaccacaatgtgccagtctacgtgctcatagcacgtggtgactg

SEQ ID NO: 75801 - DNA, 414 bp, Triticum aestivum
  Clone ID: PAT_TA_75801
tcggcacgaggccaaggcccaatcgcccgtgccctgctgcagcattagcccaccaaatccgctggcccaaggcccgcgagatgcagggcctgatgactccgttccagatgacgcgcttgagctcaagtgggagttcgacgaggactcacgccgttactatatgtctttccctgatgatcagtagtggtgcccagttggcgcgatcgggatcgtgtggcatgttgggttgatcttttattttggcaccgtagtcggaccatgagtgattggatgatgtaatattatttatgtactttgtttgacgtggcgagtgtaagccaactatgtaccttccccttttattatctatattacatgggataaaaaaaaaaaaaaaaaaaaaaaaaaaaaaaaaaaaaaaaaaaaaaaaaaaaa

SEQ ID NO: 75802 - DNA, 632 bp, Triticum aestivum
  Clone ID: PAT_TA_75802
cagcgatggcgagcccatgggacagctcctcgagcggtctctgggccgctctggggcaagcctccaccatggcgcagctggtcggtgtggacgcgctcgggctggtctccatggtcgtgcaggccgccctggcggcgcgccgccaccgggacgcctgcatgctgctcgcgcagcacgtggaactcatcggcggcctgctgcgggagctggagctcgccgagttgatgcggcgggaggccaccagtcggccgctggagcagctccgcggcgcgtctgcggcggtgctacgcactcgtgaccgcgtgccaggactgcggctacctccgccgcctggtgctgggcgcacggatggccgacgagctccgcgccgcgcagcacgagatcgacatgttcatccgcctcatcccgctcatctccctcgtcgacaattctacaaacagtcgtcgtgtccaggtagccatgttctgagattttgggggaaacaccgatttagagggacacccttgattataattcgactgaactgatccgactgtaccagtgatcatgagcataattgcctctgaattggcgtccaattgcaattttctactgcccaaataaagaacttgatatgaactcgatcttaattt

SEQ ID NO: 75803 - DNA, 366 bp, Triticum aestivum
  Clone ID: PAT_TA_75803
tcggcacgaggctacgacgacactcccaaatgcatcagcgtcggatgccatccaggatcttgcaatggaaaccacagtggtcaagcattcggagctccaagcagcaacgctttatccaattcaacacatccaggattaaactcttacattgcagaacttgggaacctcttgctcggtgaccctggtgaccatgacaactccgcagatactgcaaactctagtgcaacagcaggcgcacctccaaaagctgaccatgggctctcgaaaaagcgcaagaagacctcggatgtttgggattacttcaccaagatatttgcacgcgacatcaacgggaaggtgctgacattcgcggcgtgcaaccactgc

SEQ ID NO: 75804 - DNA, 468 bp, Triticum aestivum
  Clone ID: PAT_TA_75804
tcggcacgaggactcccacgagtatgtactcccacccccgatggataagataaacagctgagaaccaacgtaaaaatggcagaaaaataatcggtatataaggtgggtccatgtggtgacctggaagggaggaacggccatcttgacccgctagcaaataggaatctgtttaagagttgttatttcggaaggaagtatatcacctttccttaggagtatatcacgtttcaaacagagtgcttgcgtttggaaggagaattagagatccttggtgccgattgaattggtcctatacgtagcaacttggaagattgcatgggtttgttcgtgtccatctatgtactgtagtatattctgtagtatattcagtactgtagtttcacttctgaaggagtatgtacctcaataatctcaaaaggtgtacactccattttccttggaacaggtaaatacctgtttttttcgggg

SEQ ID NO: 75805 - DNA, 628 bp, Triticum aestivum
  Clone ID: PAT_TA_75805
tcggcacgaggccgcagcgaggtctggtacagcgagcgccccgcctccaccgacaccgtcggccacccgcacgtggcgaggggctcggcggaggtgtacagtcagctctacccgtacccgggcctcctcaactacacctccggcgtcattcaccacgtccgactcgtgggcctgacgccgtccacccgctactactaccgctgcggtgacagctccctcaaggacggcctcagcgacgagcgctctttccggacactgcccgcgccggcgccggacgcgtaccctcgccgcgtcgcggtggttggggaccttgggctcaccggcaactccacctccaccgtcgaccacctcgccaggaacgacccgtccatgatcttgatggtcggcgacatgacgtatgccaaccagtaccgcaccaccggcggcagaggcgtcccctgcttctcctgttccttcccagatgccccgattcgggagtcctaccagccgcgatgggacggctggggaagattcatggagccgcttgcgtcgagggtgacaatgatggtgaccgaagggaaccatgagattgagccgcaggggcacgcgcggagcggtgaccttcgcctcctacttggcgcgcttcgct

SEQ ID NO: 75806 - DNA, 663 bp, Triticum aestivum
  Clone ID: PAT_TA_75806
tcggcacgaggagagagagagagagagagagagagagagagagagagagagagagagagagagagagagagagagagagagagagcatcatcagggccacgcggacgcagaacgtgcttggtgagaagggccgcaggatcagggagctcacctccgtcgtccagaagcgcttcaacttcccggagaacggcgttgagctttacgccgagaaggtcgtcaaccgtggcctctgcgccatcgcccaggccgagtcactccgctacaagctcctcggaggccttgccgtccgcagggcttgctatggtgttcttcgctttgttatggagagtggtgctaagggttgtgaggtcattgtgagtggcaagctcacggtccagagagccaagtcgatgaagttcaaggacggctacatgatctcatctggtcagcccgtcaacgagtacattgatgctgcagttaggcacgttcttctcagacagggcgttcttggtatcgaggtgaagattatgcttgactgggaccccaagggcaagcttggccctaccactccgctgcctgacctcgacaccatccaccccccgaaggaggaggacgagctgcgccccccggctttggttgaggtctaaagtcccagtagagcaagcagaccctgaaacgtcacat

SEQ ID NO: 75807 - DNA, 490 bp, Triticum aestivum
  Clone ID: PAT_TA_75807
attcggccgaggtttttttttattactaacaatttcacactttcataatctcttccactctattatgtgtacacgtatatgatgacagagtacaatcatgctccacaaaggggagaagaccgagaccaagaacattgtccatggtgaatggtttcaaaacgaagttcgatttaagaaaaggaaaaaaggcgccacctcttcttctatgaacagagcgagtgaaaatggcggctaacgccatggatgatggatccctcctctaccctttggtcccctgcgccgccatgccgcggccgtggtgccacgagtgcccgccgagccccctggcgaaccgctgcagcgggctcagccgcgcgcacccgacgatgccctccgccgcggccgccgcgccgctcttgtcgccgccctgcttcttgagcttgtccatgctgacggctctggcgttgaacttggccgccgccgtcggcggtggtgcgtttgccttcttgag

SEQ ID NO: 75808 - DNA, 622 bp, Triticum aestivum
  Clone ID: PAT_TA_75808
ggcacgaggacggcggctactgcggcaactactaccacgacttcaacgacaacatcatcccgctcttcatcaccacgcgccacctgggcggcgaggtgcagctgctggtgaagcagaagcaggcgtggtggttcggcaagtacggcgagatcgtgggcgggctgacgcggcacgaggcgctggacctcgacggcgacgcgcgcgtgcactgctaccgccgcgccttcgtggggctgcgcagccacaaggacctgagcatcgacccgcgccgcgcgcccaacaacgtgtccatggtggacttcaagcgcttcctcatgtggcggtacgcgctgccccgggagcacgcgatccggacggacgacgaggtggtcggcgggcggaggccgcggctgctgatcatcacgcggcggtcgcggcggcggttcatgaacctggaggagatcgtggccgcggcggaggagctcggcttcgaggtgacggcctcggaacctgatgtcgccgcccaagaagcagggcggcgaggcggccctggtggacgacggcgggcaggcgcggatggcggacgcgtcggcgacggtgaacgcgttcgacgtgatgctggcggtgcacgggtccgggctga

SEQ ID NO: 75809 - DNA, 723 bp, Triticum aestivum
  unsure (1)..(723): unsure at all n locations
  Clone ID: PAT_TA_75809
cggcacgaggtggcgattcgtccgtcggtctgtcgattagatgcgtgcccgctcaatccgctggatcgtcagcctcgatctgttgcgtgacgtgattcgttaggatcgtctagtcgcgggctatctaggcgaggtattttgttgttcctcttagcgcgtgtgtgttgatgcaggctaaacggtcttgctaggtcccaatcgactgacattttctcaaggttccatcgattcagaaaagtgcaactcgtcactactttttttttctgcgcgtggagagcgtcgtttctagcgtagccagtgatctgttgtatgcgcagatggatttgtgaacctgtgggattcatctggtgggatatgccttgcttgttaatgtagtttagcagcctgatgtctacagatcgctatctgctaattctaattttgataaccacattaatttttaattctttgttccaggatgagttttatgctagtttatttatttttgccagctttgaaataacttgnttgtgttggtgtaatggaacaaatatgttaaggttaccacccaatcattacttgactgatgctttatgttctaggttactttggaggaatatatatgagtcagtagtgaagttactcagtgcttcgaggcaataaacctgttttgttttaccttgtttatttttatgctgccaacttattgcagtatgtggtgaacaaaaacatgtttaaactcta

SEQ ID NO: 75810 - DNA, 572 bp, Triticum aestivum
  Clone ID: PAT_TA_75810
tcggcacgaggtatcaatcaagtttgtgtattttattttcaccggcaatgctgcatccttttgagttgcaatggttgtatggttcagatagacaatttatcatttttcttttcttgaccaagtttatgcttttattgatcaacaattattttgaaccacaaacctattactctttggagtggccaaatgtgtatctttgaatctccaagtgccaccggggtgctatatatatttcattggttcatggatcattaggaggcaaataatggtagaaataattagcttgcaagttctgtattgccagaggagtcataattcgtttagggaagcaaaaccatgcatgataatcagggggaacatgcaacatacgtagccgagggcttctctgtaggtaatcaagggatcctaattcagcattgctcctccatgttagaattaatcattattgaggaaatcgttaactggtagctgctcggttgggtggcgagtggaggattaataggctaatacaaattaatcggccatttaatcaattaattggatgatttatcagtttacttccggtgacctta

SEQ ID NO: 75811 - DNA, 248 bp, Triticum aestivum
  Clone ID: PAT_TA_75811
ggcacgagggttaaggagaccacagcagcggccaagtcaaggagactacacgagaaaacacggatccagatcatggacgccaactgccggaccgaccttgccgccggcgttgacccaccccccatagctaccggaggcgattggcgaacccagctccagcccagagggcgcagcaggatcgtcaatattataatggaagctatgaagaattttctgcgagtatctaagccagaggagctgaaccaact

SEQ ID NO: 75812 - DNA, 664 bp, Triticum aestivum
  unsure (1)..(664): unsure at all n locations
  Clone ID: PAT_TA_75812
attcggcacgagggtttgctccgtgatcttggatggttgatgcgtgccgacatggattccatgatgacgcgggtgaaggtcaggtttcatgcatcctatgcttaattcatccgcctgcttgtcgcgagggtaaataggatgcagtattgacatcatttcctcattgtggaatggaccaggtaggtgaattcatatatgtttgattcggtttgtgtcgctgtgtgcatgcaacgcaggaatttttatactctatgattcagttcctcacttgccgaaacatcaaaattcctgggtcgcgatgagttccacctacaaactggcacaagagaatcacagttttcttcaatcaccattggggtagaggatttccacctgaatatgtcaagtgtcaggcgcaaggagaggtattgctgccaaagatcaaagtccgctacaacgttcgagatggttacaaaggaggcgtgcgagacatcacggaacatctttgcgttcatggaatctcaaaattttcaatgaattgatagggcaatcgatacccangatgccgttgtcacggccatttggggtatgcggtgtcccaaatctgcggcacggagttggagctcgtgatgccaaagtcaatccagacaggcgttgcaacaatggcacatgttgttagcgtgat

SEQ ID NO: 75813 - DNA, 541 bp, Triticum aestivum
  Clone ID: PAT_TA_75813
agctaaaacttttcaatcgacaactttattgtagtcttttatacctgaccctggtttgtgtcagatgccttatttcagaattattgggctaacccaaggggtatattttccctcagaaagagcattttttgacatatttagactactacattctctagttattattactatgaagaaaatagttgaaatttactgagtgatttgtatatgtacttattgctggctctgtcacttctatgttagttaattattctggtaagtttctccattgtcctcaaaaggtttgggttttgctaaacccgagctcttagtaggataccagttgattattcatatatttaatcgttttatcacctttgttagtgaatactacctctagcctagtttgtatattgcttgataatttgtttatttaaatacttgttgttttctatctctaggcaatttcttcgtaaatagtgctagatgtgtaactcatattttgatcccatcattttcctgtatatcaaagtcagagctgcttgtatatttaatttgggca

SEQ ID NO: 75814 - DNA, 749 bp, Triticum aestivum
  unsure (1)..(749): unsure at all n locations
  Clone ID: PAT_TA_75814
ttcggcacgagggccatgtaccgaggctactgggcactaggtgtgtccaactacatctcactggaagagaccactactatgggggaggaggagggggaggatctcaaaccatctcctctcaaacgccttcgcactgttcatagtattgctagaaagaacagggccatgcaccttcttgagctgcaaggcacgctggagagattggaggatgtcgtcgccggcatgatggagtttgtcgttctcttgggcggatgcgaccgtatgctgcgtcgaccgtacgatgcgtaccttttcagtgacaagatcatgttcggacgccacaccgagaagcagaagctcctgaacttcatgctgcagcaccggccctcctggcggtgtgccggctgttctcccgatcatcggcgctccagtggtcggaaagaggactctggtcgcccatgtatgcaaggacgagagggtccgctcacacttctcttcgattctgcatctgaatggagattccttgggtagaatcgcacaacatggtggtctcatgccaggaaatatnactggtggttgtcgagcttgtttcatacatccagcgaggaggattgggccaagttctattcaacagtagcaacaagcatggacaacggaagcaaggtgatcatcatcagctgccttagaaattcagagcgactcggaacagttgagccaatcttcctcaacaccctgccatacgaggagttcagctacctattcaagacact

SEQ ID NO: 75815 - DNA, 765 bp, Triticum aestivum
  unsure (1)..(765): unsure at all n locations
  Clone ID: PAT_TA_75815
gaggcttcttcttcctcctcggcgccgtcccctccacagctgcccccgtccccgcgccgcgccgtccaccccctcctccggaccagcagccgccctccctccgcagccagggggttcccggcttcgccctcgccctccccccgattccccgccggccggccccggcgcccgggcaagaacggccggcagcgccgccagcgcagggttcattgccgtcgcccgattccagattcgcgtgatctgcgcgaatccgaagtgaaggtatcctcgagtaatcaataagatggataagaagaaagatgccgatgacgtagaacctggaccagctccttctcggcctgtggacagatttggctttataaaaacagaacaaagcaactctccctgagggggttctgaaaagcagacccacacatgaagcgtggaaagagaggaaaggaggataagaaagtggaggaagatgataggtactggtggtagtgactggaagcattatgttagaaggaatcctcatgtggttaagagaagaataaggaaaggaattcctgattgtctcagaggacttgtttggcagttgatttcaggcagcagggacctcttgctaatgaatcctgnggtttatgagactttggtcatatacgagacatcaacatcagaattggaaattattcgtgatatatcgcgtacatttccttctcatattttcttccaacagagacatggcccaggtcaaagatctctatacaacgttttaaaagcatactc

SEQ ID NO: 75816 - DNA, 670 bp, Triticum aestivum
  Clone ID: PAT_TA_75816
ttcggcacgaggagatgctgctcgccgtgcgcgccatcacctgcagctggttggatattagttatgaaggttgtccctggatttttgctctatcgaggactgcatgagcttggtcaatatgcattcttggaaattctctgggagccagccataaagaaggaattcctattgtatcctgtggcattcttagttaggtactaaatataaccagatgaactgtttttgcaaacgtcagagtgctaattacacgagttcaaagattaagctgagtccgatctatttttttgtcaatttagtttgaagaaggtgtactacttgaccatgcagaataaggtgtcacgatgatttgatgagcttgaccacgtcatccctgccagtgccgattagctcagccttggtggcggcgggctcctggaccacctcaagcaggcgcctgctgcagcggccgacatgtgaggggcaaattatatttcaatgatacaaatggctgatgttagttttggtatatatgtggtcaagaaggttgtcaagtagtgatggcctcagatttgttatgggggcagttttttttaatagagcgcttcttgcgcacaagcactggaaccatcggtctatgacatacatgattctctataacttctaccagaatgctttctttgtgttaatgctc

SEQ ID NO: 75817 - DNA, 638 bp, Triticum aestivum
  Clone ID: PAT_TA_75817
ggcacgagggttcgttggaggtcgcctcagctccagccatgggagagaaggtagctactttgatcattgaagccaacctcgaatgcgagaaatgctacaagaagattcagaaagtgctatgtaaactccaagagaaggaaaagatcaggaccatcaatttcgacacgaagaagaacacggtgaccatctccggtccgtttgacccggtgaagctgtcgaagagagctgcgatgcaaggcctgcaaggcgatcaaggatatcaagatcgtcgaagagaagaagcccgacgccaagaagccggaagagaaaaagccggaggagaagaagcccgaggagaagaagccggccgccgatggctgcaagtgctgctgcaagaagcccgacgagaagaagccggatgagaagaagaagcccgacgagaagaagccggaggaaaagaagaaacccgacgagaagaagccagacgataagaagtcggaggagaagccgaagcccaaggtggagcccaaaccagccgcgccgtcgacgacggtgaacctgcagttcacgcagatctgcaacctctgctacccgtggccgtgcagcgacccgagccactaggggaggcgtgcaccagtacccgcatccccagccgcagt

SEQ ID NO: 75818 - DNA, 706 bp, Triticum aestivum
  Clone ID: PAT_TA_75818
gaggctcctcctcatcatcatcatcttcatcatcatcttcatcatcctcatcatcaagtgaaggtacactcttactcaaatgtgtcatcgatgtctcacacttactcaaaaaaatgttcactgacatgtatctcttacctcattctgtcaacgaatacatgatgttgatcgaacatatcactactcgtctcatcgaaaaatgtcaagagaaatatagtgcattgacaaaaaatatatatgctgctcaacggttgaatgacacgaagatatatgcagagttgagtagagacccgttgtatgtagctatgagatcagtatcgatgggtaataataacaataataataataataataataataataatatgatgaacaatatgatgaacaacaatgaatggaaagcagatgaaggtgtattagaatcacatttcagtgaatcgaaccctatctatcatcctatgtttcaacgtgatttcacactacgtcgtgatcaacttatcttcgatacacgtgtgttgggacagatagcattgatgtgtgaaagtttagaatggatgagtgatttgatatatcagatgacggacccgttttatactagtaatgtgatgaatagtaataataaacgaacgatgaatatcacgagaaatggtggtatcagtatgagaaatggtaatgcacgtgtagcaatacgtaatacatttcgtgc

SEQ ID NO: 75819 - DNA, 589 bp, Triticum aestivum
  Clone ID: PAT_TA_75819
gaggcggaatccaccgcagcccaacaggcgccactgtcgctgcccgtccgggccctgaggccgcaggactccggtgcggcgggacacggcaacggcgagtcgcgtgcgcagccgcgcgcccacgataccgtgctcccttcgccgatcccgtggaggtcacggtccgggaggttcgacgcaccactgactccgagcagcccctctccgtcgccgaagaagctgtcgcccgcgtcgtccatgtccgacgagacactggccaaggctagcgaggagcacgccaccgtccccaagcggaggagcacgtataagtcttccatttcctccctaccgcccccgccgcctccgccaccgccgccgttccttgtccacggttaccaccctgcggctgaccgccggaccactgcggcgaagagcttcaaggaggagctgcaggatcacagcacaagaggcagaggagatcacgatcattactcgcagcagagtttcaacagttcttctacttacaccaactcctcgccggcgactccaagaagctctttcgacggctcctcctcatcgccgtcagtcggtagatcagtgagaacaatca

SEQ ID NO: 75820 - DNA, 731 bp, Triticum aestivum
  Clone ID: PAT_TA_75820
tcggcacgaggctcaccccaagaagcctgagtaccctggctcctcaccacgagaagcccaagcccaagcctcaccccaagcctcactacgagaagcccaagactcccaagtaccaggctcccaagccccaccacgagaagcctaagcctaagcctcaccccaagcctacttatgaggctcccaagcctgtgaagcccaagtacaccaagcccaaggcccccaagcctcacaagcctgagtacactaagcccaaggctcccaagcctcaccccaagcccgcctacgaggcccccaagcctgctcctaagcctcacaagcccgagtacaccaagcccaaggctcccaagccccacaagcctgagtacactgctcctaagcctcaccacgagaagcccaagcccgctcccaagcctacctacaaggcccccaagcccgctcctaagcctcacaagcctgagtacaccaagcccaagactgagaagcccaagcctgctcctaagcccgagtacaaggctcccacctaccaggctcctcactactagattcgctctgagaaaatgaaggacagaagctgtttgtgctgtggttattgagtgggtgactcgtgctgattcacgatcatggtatacgacctgtgcggaaacgcatagcgagaggatggcgctggacttctgacttatgagagattctggaggaatggcagacatgtgtttggatggatggacttttga

SEQ ID NO: 75821 - DNA, 639 bp, Triticum aestivum
  Clone ID: PAT_TA_75821
gcacgaggctgtaacttgctggtagttctgttatgtcatgagctaaactgctgacttggtttcttccattttatgaattagcggtgcaccaaactcttgtgaagtctgaaaaatggaaaatgtttgtccaataggtgcctgatgcaaactacgcacactacacgagctacaacccacgtatgggtgcaactgtggttttctgtccgtccctattgcactaccatattgttttggatttcggcctggcaccctggcactgcaccctgttgcaatacaaacaaatatgtgtacaatttgtagtcatttcatggcagtgtaagtagatcttgcatgtttaaaagagttacattttgcttcctgtttgattcttaaatgatatgttttgggtgtctatcagcgcatgttcttaatgaacttggctttgcttggtggtttagcttatccttgcctttttttgtgttagtacaacatctgattcagtataattgcagtattttgtgttaaactgttaccagctagatttctgggagcaccaaatcatgattttatttcacgcaagcatgaaacctgttgtctgatgctaattttgttttggcactagcaaaatattgcaactttggtaaattcgacagggtcata

SEQ ID NO: 75822 - DNA, 672 bp, Triticum aestivum
  Clone ID: PAT_TA_75822
ggcacgaggcatcagtcttacttgtggtgtacctagcccaaattctgccagaattgaagttcctatatctcgtgatcctaacaaccggatacgtatggttgctgctcctggatcaggccacagatatgcgaagcatgctgctagtaggtataaagtaagagaggtcttttgtgctggtgggtctgcactggtagagtggagattggagacagggcgcactcaccagatccgggcacatgcgaaatatctagggaaccccctacttggtgatgaaacatatggaggtaccaaaagcatggcattgtcacttttgagacccagaactccttcaaaatatcacggtgatcttacaaatctggtatcaaagatagacaggccatgtctccatgctgcattgctcggattcaagcatccccactctggaaaggtacttgagttctcatgtccccctccagatgattttactgaggtacttgatgagttgcgtcgtgttacaccgacaagtgaaggccaagatagcgacagtgctgctcaagtgtgattaatgcaaatggagaacacagaaaatgctgctttggatatgcgatgtttgacctgaaggtgtttggacttgtgcatctctgagtgaatggccaactgacagagtggtcttcaagcttttcgtcatgttca

SEQ ID NO: 75823 - DNA, 680 bp, Triticum aestivum
  Clone ID: PAT_TA_75823
attcggcacgagggtaccacgaggtcgccgtgaagatgctgcacccggtcagggacgaccagctgcaggtgttctcggcgaggttcgacgaggtgtttggcaaatgccagggcctgggcaatgtctgcttcctacatggcatctcgacgcagaatgggaggctttgcatagtgatgaagttctatgaaggatccgtcggggacaagatggctcggcttaaaggtggaaggctccctttgtcagatgttttaagatatggcgctgatttggcacgtggtgtgctggacctacactccaggggaatatttgttcttaatctcaagccttgtaattttctccttgatgatcatgaccatgctgtgttgggggattttgggattccatccttgctgtttgggctgtcgctgccaaacccagagcttatccaaagacttgggactccaaattacatggccccagagcaatggcaaccaaacatcagaggtccaattagttacgagacagattcatggggctttgcctgcagcattcttgagatgttcagtggcgttcagccttggcgtggcaaatcaccagacgagatttatcagttggttgtcctgaagaaagagaaaccgatattcccgtacaatttacctgcagaggttgagaatgtcctttctagctgctttgagtacgac

SEQ ID NO: 75824 - DNA, 581 bp, Triticum aestivum
  Clone ID: PAT_TA_75824
actgaagaaacaccttccgccggcaatgaacaacagttgagctagagagcgatgtgattgctcctcatgacctttctcttcttcaacctgcagcattcttacacagcaagcttattcagcgtgggaacaagctcaaaccccagtgcaaggtacgttggcacaactggccggatactcaagacacctgggaagatgcattcgcattacatgctagttttcctgctctggcggcttggggtcaagccgcgcctgaaggggtggggagtgattatgtggtggcccagcccaggcagacggcccaaggcctcaaggcgcaaccaccagctggcccgagactggcagaggaacaagtcgtcgtgaaggggataaaagaggggaggcgctggagggaggacagagaagaagatgattagcaaatagctttcctttccaattcctgtatcgagatccaatctggtgtacctcttgtatgaatccttgatcgacactagtgtgtgcataacactcctcacccctgtggcaatgacctccatcgtcacctgataatatcttattaaacggtaaaaaaaaaaaaaaaaaaa

SEQ ID NO: 75825 - DNA, 689 bp, Triticum aestivum
  Clone ID: PAT_TA_75825
attcggcacgaggcaaaattaaatacagctgctggtattggtttagctccttccattcgatttgtcaatgtcactggttataatgtctcagctaatcctgctgctattgctgctaatggattgattcaacatttggtatccttctttggggcagataatgcattacaatgtaaattttataaaaacgggggaattccaacatatgcacgaaatgctgatatgaaagcagtacatgcaggaatgaatattactgcgacggtctggtctgaatttgtgaattcttttcgtgatacattattatcatttggggtagcacctgcagatattacagcaactattataccatatatgcaatcatttttgttaggttctaccaatcaaatttgtaatgatccttcatgtaattgtgcccctgttgtgaatggaatcacctataccaaagtcaatggtacatgtacagcttctggtactgtggctcctactactgcagcacccactactgctgctccgagtggaactcctactacacctgctcctgctggtaacggaactacttcccctcccactggcactggtaaaaatggtgctactatggtctccgcctctgtgccctccatgggtggctgctgtggcagccttgttattggcagtcctttaaaaactccgtactacttccatacacaacctgt

SEQ ID NO: 75826 - DNA, 753 bp, Triticum aestivum
  Clone ID: PAT_TA_75826
attcggcacgaggctcttccctaccctctagagacgttgccgacggcaacacgacacttgcccggctgcagcgccaccagaagtggcctccgaggagccggtttgatccgcctatgaggtagaaaggttggacggtgccatgcatccacccgcagatgtctacctccgggtgacctccgcctcacgaagctcatcgtcttgatccgcctgctcctaatccggatgataccgtgcctctgacccttctagccaccttaattatgtgttcccatctgtcagtttgatgttgatttcttctcttccttcccgatcttgcgctctgtatgttcccatctgtccgttctatggtgaacccgatctgctggtttaaggagtttcgatctgctgagtaaccaatcttcagtttctggatccattcatggtgtgtcacgcaccggcaacgcttaatacaggcgtgactttgtattttcttctgtacaagcgtctgcaaccttcctactccagcaacagaacctctagcagcatggttcagtggctaggtggtgttcatactgatttggtcaactaatttgggtaaatcttggaggctggttttggcatattgatttgggatttctttacttcaatctctgatggctgcaggacagtctattactacgacatttgaggaattcttcagttttgaatctctggtggacacgacttttaattttcttcaaaattctctatttggtgatctgattccagcatgct

SEQ ID NO: 75827 - DNA, 800 bp, Triticum aestivum
  Clone ID: PAT_TA_75827
tcggcacgagggtcgggtatgccgaaaagagccttctctttcgaagttccgtgttctgcgagtacttgatattgagaatggcgaggagatggagagcaactgttttgagcatctgaggaagcttttccagttgaagtatttgcgactccacgttagaagtatttctgcactccctgagcagttaggagaactacagcatttgaagactctggatatgggatggacaaagatcacaaaaatgcccaaaagcattgttcagctgcaacatttgacatgtttgcgcgtcagtaatttggaattacctgaaggaattgggaatctgcaagctctgcaggagctatcagatatcaaagtcaaccggtacagcatggcgtcgtgtttgctggagctgggcagtctgactaaactgaaaatccttgggctacgctggtatattgtcagtacacacagtaacaaagatacttttttggataacttggtatcctcgctgcgcaaattgggcagattcagccttcgatctatatgcattcgtagttatcatggctattcaatggagttcttactggactcctggttcccctccccttatctcatgcaaaagtttcagatgggcacgtactacaactttcccagagttcctcccttggattgtgtcactggacaagctcacatacctagatatcaatatcgatccagtagacgaggaaacactagagatccttggagagctacctgctttgctggttctctggctgatgtcgaaatcagctgctcccaaacagcggcttatcataagcagc

SEQ ID NO: 75828 - DNA, 481 bp, Triticum aestivum
  Clone ID: PAT_TA_75828
ggcacgaggccaatctcccatcacaaaaccaatcctcctccgcgccccgatccccaagagcatcacctgcaagcaatggacgtctcaggcaccggagctggcgccaagggcaagaagggcgcggccgggcgcaaggccggcggccccaggaagaagtcggtgacgcgctccgtcaaggccgggctccagttccccgtcggccgcatcgggcgctacctcaagaagggccgctacgcccagcgcgtcggcaccggcgcccccgtctacctcgccgccgtcctcgagtacctcgccgccgagctgctggagctcgccggaaacgccgccaaggacaacaagaagagccgcatcatcccgcgccacctgctgctcgctgtcaggaacgacgaggagctcggaaagctgctggccggcgtcaccatcgcgcacggtggcgtgatccccaagatcaacccggtgctcctccccaagaggaccgcgg

SEQ ID NO: 75829 - DNA, 691 bp, Triticum aestivum
  Clone ID: PAT_TA_75829
cggcacgaggcttcttggtaacaaatggactgaaatagcaaaggttgtctcaggcagaactgataatgcagtgaagaatcgattttctacgttatgcaaaaggcgggccaaggatgacgaactattcgaggaaaatggcacagtatgctccaatgcaagtgcaaagagggtactgacacagtctggtggcgtcacatgtgctgcacctggctcctcaccacctattaagaacatgagctcttgcaaacctgatttcaaggagaacatagcaccaaatatgaagtcatttgcacagcaaaagagcatacaacaggattctcggcaaccccttgctagcatttgtccagacaatcagagtgtgaatattgtaaaaacccagagtcttgtcactaaaacctcaacaaagcaattacatggcgaagaacagagctgtgtgaagcatgagggtaattttttgaaaaggaatgatccaaaacttgctactttacttcagcaagctgacttgctttcttccctagcaacaaaagtaaatactgaaaatacaagccaaagcatggatgaagcctggcagaaactacagcatcatttggttaagaaagatgataatgacatgtcagagagcagtatgtctggaacagcttcactcctagacgatctcgacgatttaattgttgatccctatgagaatgaa

SEQ ID NO: 75830 - DNA, 737 bp, Triticum aestivum
  Clone ID: PAT_TA_75830
cggcacgaggcagacaagcaaagcgagggagatgaggttgctcatgctactccatggcgcggcgctcttgctgcttcttgcggccgttgcgcatgctcaacagacaatgaggaccgacccggctgacgcggcggcgctgcatgctgtgttcgccaaactcggccagaaggcggggccgcaatggaacatcagcggcgatccctgcactggcgctgccatagacaacaccaacatcgacaacaacgacatcttcagggccgccatcaagtgcgaagtctgcaccggcgggcaacacctccgtctgccgcatcactaggctgaaaatatacgccctggatgcggtgggccccataccagaagagttgcggaacctcacagccctgatcgatctgtatgaactctcaacttgcacacctgaaatgaaatggtcctaacttatagtctattgtcctaacttgaaaccgacagtctgtatataattccaattgcacaccaaatttactcgtctatctgattcaatgttctttcagggatttagggcaaaattacttgacagggcctttaccatctttcatcggggatgtgccagttgttaataacaagaagatctggaagatgaagatacctcttaagaataaaatctttgcatgatatcttcgtcgcggagtcattcttactaaagataaccttattaagaggaattggcatggaagcccgcaatgtgtattttgtcacca

SEQ ID NO: 75831 - DNA, 702 bp, Triticum aestivum
  Clone ID: PAT_TA_75831
ttcggcacgaggcccctcatcttagctccccccctttcccctcccccttcgcccacccagcaagcactcaccactcccttgcatcccagcttgcttgccgcacacccagatcggccaagaaacggggcggcatcggtggatcggtccgttgatatgggagatcatcagctgatgtactctgctccggccatgcacaacggcggcggcggtggcggagctgtctcacacggcatgtggtggaataccaacacaaccgcggtgccggcggcggcgtgctccacggagctcgcagggttcaacacctggccggccgctcagctggctgctggcggtggctacgacatggcggccacggacggcggcaaggccaagagctgcaccaccacggcctcctccgagtcgcccgggaacaacagctccgtaaccttccaagaaacagctagcatcagcgacccggcagccggcttcaccgactggaatagcccttacatgagcaacggcggcgctggtaacatgcatgggttcctccaagttggccaccatgacatgagctcaagaacggaccagcagagccacatgaacgcgtcgagcctgatgaatgacccatcaccgaataacctagacctagcgctgcaaggccaccaccaccaccagcaccagcaggccggcgatcaccaccgccagcagcagctgttgtccagc

SEQ ID NO: 75832 - DNA, 601 bp, Triticum aestivum
  Clone ID: PAT_TA_75832
attcggcacgaggctcacgcgcaccctccaaatcccagcgccgccacactcccccgacccagcgccggctgtccctcacctccccgtcgcctctcctctcactcgtctttcttcctcacagccggccatcccgccgcgcacacatccaggcaaagaacgatgagcggtcatcccgtcgcggacacatctgagagaccatagctgcttgctgcgggcagcggctaaggaggagtggagcagtggctcgtggctggccggcggcggccttccggcctcacctgctagcggcagctcctccttcctatgcctcttaacgatctgttatttctgaaggcgctcaaagtgcaacctcgcgaactcggccgtcatggtgtagctgcagaccatagctattgacagatagttgtttctagcagtggtgcctgatctgatttttcctggacgttggtgtgtgtgtgtgtgttgcgtgatatgatttttctgctctctgattatgatagattctcgttctttgatcttgtgtatctgtattgcaacgtctatatgtacctcttagttgatataatcaagtgttcactagcaaaaaaaaaaaaaaaaaaaa

SEQ ID NO: 75833 - DNA, 720 bp, Triticum aestivum
  Clone ID: PAT_TA_75833
cggcacgaggctcagatggagagtaatatacccagacggataaactggtactgctaaattggaatttattagtactacaagttcatcttgtgatatttgaattttctgttctagcaatgttgttgttgggggtcaaaatcctttttctgcttcttgtgaacactcgcttctcagtagcataaggtaagtggtaatggtatgagctatcaggcacccgttctcagtagcataacgtaagctctaataaaactcttctgcgcgggaaagacagttcggtatttttaaaaggcaagaaaccccaagaacgcggcacgtgcccatcctcacgtggggagcggacgctgcacgtgctagtgagggggatttttttaatgcgagacccaggctttgaacctgggtcgaccgccccactacaggaggcgttaccaccgcactatcaacacgtttgttgatgcacgtgctaatgataggagctatcgaataacccgttgtccaagttacaccgtcacaaatactctgcaatcgcactgtgcgaaaatcctatgggaaaataattctgaccaaatatggtaatgcaatataattatatggcagacaaagaaaacaacctcagataaagaatgtaatgctgaatttctaccattctttatgatgtaggacaacaaaattagaaactatagattagcctattgcttttctgaagctatctcagtttttttt

SEQ ID NO: 75834 - DNA, 728 bp, Triticum aestivum
  Clone ID: PAT_TA_75834
tcggcacgagggcatcttcccgaagatcatgcgattgtgagaggtagactgatatggagatggatatccgaaggtcttgtttacagtgataaacaagaaactagcttatatgagctcggtaatagttacttcactgagctagtaaatagaagtatggtccagccaataggcattgatgttgaaggaaatgtagaaggttgccgtgtacatgacatggtgcttgaccttatatgctcattatcaagtgaagaaaactttgtcacaatactagatgacaccagaagaaaaatacctaactcagagatcaaggttcgcagattgtccattcaaaataccaagatagatgtggataccactaggatggaacatatgagatctcttaccattttcacaagtgatgttgttgggaaagtgttggatatttcaagttttcaagttctgcgcgtgttggatttagaaggttgtaaaaatgtctcagatgttgggtatgtcgggaatctgttacatttgaggtacttggggctaaaagatactcatgttaaggaccttcccatggaaatagggaagctgcagtttttgcttaccttggacttaagaggttctaatataaaagtactgccatcgagtgttgttcaactaagacgtctaatgtgcctgtatgttgattatgatatgaagctgtcatctgggataggtaacctgacatccctagaagtgctagatgacct

SEQ ID NO: 75835 - DNA, 620 bp, Triticum aestivum
  Clone ID: PAT_TA_75835
tcggcacgaggggcatggttatgaatatgctatttccaatcattatgatcggcactgcgtatgggaggaagtggcacaaaataaaaagctgaacaagttcaaccatacaataattgatcaacagtttgaattttaccaagctgacggactgacaaggttcaactcatcggatccccacaagctgctaccaagctatgtccctgaaggttctttcatcgtgagggaacacacatcgatgtccaacttattctcttgtctgtggttcaatgaggttgatcgcttcacacctcgtgaccagctcagctttgcatatacatacttgaagcttagaagaatgaatcctaagaagtcgtttcgcctcaatatgtttaaggattgtgagaggcgatcaatggcaaaactatttcatcatcgatcggaagagagacatagcagtggacagctaacaagataacaaagatattttcaaagggtgggtttagagagaaagcagagatagcacaaggattatacctttggtacagctcacgaagttcaaccactgtcaacatctatgtcgggccagggagtcgatgctgaatggatggccgcaagcgatcgcatgtacatcatgatcctgc

SEQ ID NO: 75836 - DNA, 791 bp, Triticum aestivum
  Clone ID: PAT_TA_75836
attcggcacgaggtctggtgtcagccagaagggagacatcttgatcaatggccggaggcagaagctatcctacggaacatcggcgtacgtgacgcaggacgacgtgctgatgacgacgttgacggtgcgggaggccgtgcgctactcggcgtcgctgcagctgccgagcggcatgtcggcggcggcgaagcgggagcgggcggaagagacgctgcgggagatggggctggagggcgcggcggacacgcgcatcggcgggtggatgcacaaggggatcagcggcggccagcggcgccgggtcagcatctgcatggagatcctcacccggccggcgctgctgttcctggacgagcccaccagcggcctcgacagcgccgcctccttccacgtcgtcagccggatcgccaggctcgcccgccgggagggcatgaccgtcgtcgccgccgtgcaccagcccagcactgaggtctacggcctcttccacgggctctgcctcctcgcctacggcaagaccgtcttcttcggtcccgccgccgagaccaaccagttcttcgctttgagcgggtttccttgcccgtcactgatgaacccttccgaccacttcctgaggaccatcaacaaggacttcgacaatggcatcgaggaaggcctcggcgggaagaagacgaccaccgccgagaacatcgacgcgctggtggtctcctacaaatcctccgtgtacatggacaaggtgactcggcagatcgctgacatacgcggcactgtgagtagcccggccggactccacgtac

SEQ ID NO: 75837 - DNA, 710 bp, Triticum aestivum
  Clone ID: PAT_TA_75837
tcggcacgaggcacacaaacacacagacacgcgtgccccgttcctggagctagctagcagccgcctatatcaatctccagttatttcccaacacccactatgagtgaaccagtggatggacgtacagggcaggcgccactagccgtggtgattgtgtatgcatttgactgcaccacctcgaccccggactggtacaaggtagacaatgtcttttggttggtgcaagagaagctcacccacatcatgggtagcagcctcggctacacatacgtcatgtcaacccctaatacttacacgtcggatatgaaattagttgactccgctgagataaacggaaatggctacaaaagtagcccgtcctggaaaaggatcgcctgtgtcaaatacatgacaggactccatgaagcacatagactaatcaaagaacatgggaacatgaatgcaatcatcttgttcttttctgatgggttggtcaacaagggcgacttctttgacggagctgaggacttcctctccagtgtgcccgtctacacgtttaccctcggcggagatgcatataaccagggtcttcgcaccattgcagcaaattccccaggcgggatgttcagccccctccctgttccggacttgccaagcctatctgtgcccttctcccaactcttggataacatccttaatgataccacgatgcacagtgagaagaatcctag

SEQ ID NO: 75838 - DNA, 629 bp, Triticum aestivum
  Clone ID: PAT_TA_75838
tcggcacgaggctacgactgcagcatcgggcgacccttaattttatggagtattacttaatttttgcaagttgcaacgaatcatttctcccatctatgttgcttgctactctgcaaatatatctcaaatacttggacgtatggcaagcaacaacaaacagactttgttgtttttagtctaatgcgatatttgttgggcgtcaccgaggaatgccagcaaaggcgtgaagaaatacttgtaatcagtgtgacatgtcgtgtgagatgaaggtggcaaaccatcacttgaagccaagcatgtggtggatccgccatggatgatggatggaccgatgagtgtagaagtttgagctgcgaaactttgtgcgatcgagctcttggtgcaattaagcatatggcttttgtgatgtgtcatgtaggcagtgattgactatatttctttccctcttaaatttgttgtaataaggttaccctttacagaagaaagattgaaccgccttttggtttaggtagaagcaccctttgatgttttccaattctttgtattcattctattatgtgctataatagttaattgcatatatatgtactatgtttggatattctcacgcaaaaaaaaaaaaaaaaaaa

SEQ ID NO: 75839 - DNA, 628 bp, Triticum aestivum
  Clone ID: PAT_TA_75839
cggcacgaggctacaactcacagagagacctggcaagctagctagatcacgatggcttcctttccctcggctgctcgtctcctgctcctcgtcgcagcagctctggtgttgagctccgtgtccgccgccgctggtgctggtggctcgccgccgctggccaagggcctgtcgttcgagttctaccgcgccaggtgcccgcaggcggaggccatcgtcttcgccttcctcaaggacgccatccgcaaggacgtcggcctcgccgccgcgctcctccgcatccacttccacgactgcttcgtgcagggctgcgatggctccgtgctccttgacaggaccaacggcgtcgacagcgagaaggtgtctcccccgaacgttacgctgcgtccgtcggcgttcaaggccatcaacgccatccgccgtcctccagaaggcgtgcggcgggcccgtcgtatcgtgcgccgacatcgccgcgctcgccgcccgcgactccgtccagctagctggcgggccaaggtacgccgtcccgctagggcgccgcgatgggcttgcccccgcgtccctggacaccatcttgggcgcgctcccgccgccgacctccaaggtccctgtgctcctcagcttcctcgcc

SEQ ID NO: 75840 - DNA, 415 bp, Triticum aestivum
  Clone ID: PAT_TA_75840
gaggctggttctggctcagctactgctaataacaattggtatggacaaggtagtaatgcatatgctggtggaaacggtgttggcaatggcggtggaacaaatggtggaactggtggaggcggaggtgctggatctgggtatggcgatgcctatccctagtttcctttacgcgaggaatctaaaagtatggagcccaatctggtgtgtcaaatagatgtcttcaaactttttcatttattttttatcgtcttacatattatcaaataagggcttcattgttacggtgaacaatgttgtagtgtttgtgatatataccaagaatgtaacatgtcaatgtatcactatgtacatatgtatcaagtaatcagtgtttgtgccaactgagttgcgatgagaaaaaaaaaaaaaaaaaaaa

SEQ ID NO: 75841 - DNA, 761 bp, Triticum aestivum
  Clone ID: PAT_TA_75841
gaggcctcgtgccgaatcggcacgaggctctaatatactttattcaataaaattgttgatgctctttcatatatatatttgcaggcaatattgagttccttccaagtcaccgaggaaccaggcatggaagctttcagactgaatttattgcttaaaatgttttgttggccacaaatgattatgctaaatcacatttacgatgcacagtttatgcagccaaattcatcccaaaagagaaatgggttgtcgccggtgatggcaatggctgcattcttgtgtacagttacgaagaacaccaagatgtgacgagctttgatgctcatcgtactagcatcacgtgtttggctgtgcatccgacacggccttttgtgctgtcatcgtcgtatgacgatcatctgattaagatttgggattgggagaaggactgggagtgcactcgaacatttgaggggcacaacagggtggcgcaaatgacgtttaacttggacaacaccagcagtttcgccagtgcttcatcggatggcacggtcaagatatggagtgttgattctgatgatggtaaaatcatcacactggatgggctctgcgttgactacttcacgcgccgtgatcggcagcatctgatcaccggcactaaggacggcactgcacagatctggaacttggagatggaagctggatgtgttgaaaggctagaagggcacagaggacgtatcactatcgtccatttgcaccccgagcttccgctgctgatacaggct

SEQ ID NO: 75842 - DNA, 601 bp, Triticum aestivum
  Clone ID: PAT_TA_75842
tcggcacgaggcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactttgaaaaaaaaaaaaaaaaaaaa

SEQ ID NO: 75843 - DNA, 159 bp, Triticum aestivum
  Clone ID: PAT_TA_75843
attcggacgagggcatagtccacaaaattacatgtttaattacagacactaagagtagaaacacaagaagattatgaagcgctcctcatcttcttcttccatggcagtagccgtggcaatcctggctatcatgttcatatacttcagccttccttgctc

SEQ ID NO: 75844 - DNA, 762 bp, Triticum aestivum
  Clone ID: PAT_TA_75844
tggtcctagagtttgtgccttcttagtcgaacctatccagggtgaagctggtatcattgttccagaagctggttatttgatgaaagcgtttaatttatgcaagaaacacaatgttctattcattgctgatgaaatccaaactgggttatgcagaaccgggaaattattggctgtcgattatgatggcgttaaaccggacattttaatcttgggtaaagctttatccggtggtatgtaccctgtttccgctgttttggctaataaacctgttatggaatgtattcaacctggtacacatggtagtacctacggcggtaacccactgggttgtgccgtagctattgctgctctaaaagtcttgaaggaagagaagttggctgaaaacgcatacaatcttggagttaaatttcgtcaagccttgattgacattaaaagcccgcttatcactactgttaggggtcgaggcttattaaatgccattgttattgatgataccaaaatggataaaactgcttggcacgtttgcttgatgatgaagaaatatggtttattggctaaaccgactcatcaaaacatcatcagacttgccccgccattatgtattactgaagagcaattcaatggatggtgtcaaaatcattgataaagttttgaaggaaattgtttcaatgaacgtaaaagatatccctggtcacgaattatgagttattagtttttattttagaatttttagaatttttggacgcttaaaaaaaaaaaaaa

SEQ ID NO: 75845 - DNA, 699 bp, Triticum aestivum
  Clone ID: PAT_TA_75845
cggcacgaggggtgaccaggcggaccatctggcggtgggcacgatgtcctcgcgcggatctgactgccgccaccaccgttgcctcctcaacgccacctcgacctcgagctcctcctcgacgcggttgttcccgacgagctcctccctgacggccccctcctctcctgcacctcgagcactacggcgaggacaacggcatccacctcgccgctagatcaagatcgcatccaccacctcgacttctctccaaaggtaccaaggattgtttagagactacattgttgttttctagcttggagaagcaacatcaacttgggatgcagattcaccagtatatgtacatgcgtctcatggggggggagctcttgcacgggtgtaagaccattttgcttctgtcagttatagattttagagtgatgatttgcttaaattcgtttccatgcataaaatcaacatctaatggagtattagcaaattattttacctttgttattgtaattgggagctatgaataccatatcaatagatttagtatattttgattgcatagtttcttttctgctattttctgcagcttagattcagctgagactttacagaactagggaactaatccatagagctatcctttcctttgctttgtttttcctatagaacagagtaagcatgatatgagtagtgtatacggaacacatcgct

SEQ ID NO: 75846 - DNA, 633 bp, Triticum aestivum
  Clone ID: PAT_TA_75846
tcggcacgaggaggatgagcaagaacggcggcaaggtgtcgaagctggagagcctgcggctgagcctgtcgagggcgcggggcggcggcggcgggcagtcatcgacgacggcgcggccgggcggcggcggcgggggcgggaatgatgcagtcagcgcgtccccgcggcggctgtcgtcgtcttcgtcgtccaccgcgtcgccgccgagctcgtgcgtgtcgtcggagggcagcccggacgcggcggccggggcgcccatggtcctggcgggctgcccgcggtgcatgatgtacgtgatgctgtcccgggaggacccgcggtgcccccgctgccacagcgccgtgctgctcgacttcaacgacgaccagcagcagcgccgcccgcgccagcgccggtgaaaccgccgccgacctcagctcgttccttcatgtcgtctcctagcttcgccattcctgatcgagttaattttattgacttctcggagagaattaattaaacagagaatcgttggctcgcgagccgatcaaaagaaattatttcatagacctgttcttccatgccgcgtgcaccgtcggtcgatggagttgggtctaggtaataatttcgtgtggttagcgcgtcttttgcaatttt

SEQ ID NO: 75847 - DNA, 793 bp, Triticum aestivum
  Clone ID: PAT_TA_75847
ggcacgaggaatccttcttggctactgtgcttaacatctatttagtcgccagttaaattccaggtaaaatcagtgcaatttagttcaagttctaattaaagaaagctacttgacaagctaacaagtatggatcaatctcaaagtaacactaatgctaattcctccgacacacctccaaaaacaccaaacaagccatccacccccaccagttttcacccacaacaacctcaccccacctatgaaaaaatcgaccctatctctccaattggtattccatttagcgtcgctagtctcaatacatcagatttagacgctgataccgttgcctatgctacacaagctgctgctgccgcgtatcaagaagcaatcgcatctagaactgcgaaaatggctgttggagccagagaaacacctcctagacttcgtacttatgttagttcaactccaccaactccaacatcacctactcgttcattaatgtcaccatttggagatcatttggcatcgccattctttggaaaaaccactagcacaacattgccaaatggcgggtcttttgttgcacaaagtccaaactccactcgtagtaaagtaaatgctccaatccgttctcccggaattattaatcgtgtgcgtgcagactctactgaaagcggaatctctaatgctgaggaaccttttctttcccgatcaccgaatggaacaagcggcgatagtgttggttcggacgagcatgagcctccattaactcctaatggctccagcataattaaaaagctaaatttgtataaaa

SEQ ID NO: 75848 - DNA, 702 bp, Triticum aestivum
  Clone ID: PAT_TA_75848
cggcacgagggccgccctgaagaaaattcgtggtggcgcagctgcgcctaagtgaaacccgtttgccggcgaagatggaagctgaactgtgcgttctacgctccaacaagtgggagctgctgcggaatctgcagataaagtacgaagcccatgaattatctgacttgatccattggagaaccgacagagtgatccctttcgaaaactatctgtgctgggttagttacttcagtggaggcaccctgttctgtgacgtgtctgaaaaaaagcctaaaatctcccaccatcggctgcctattcatggccgatgtcgcggtgcagatctacaccgcttgcgtgatatgaactgctctttgtgcaccaccgattctggcggtaagctcatgttcattaatgttgccccggaggatcatgagatagttggcccaatgcttcctggtacggattttattgtcacttgccatacttggaggacacaagacatggtgtgggaagaggcgttcgtcatcacatctcatgaaatatggggtttcgatgcctctctctcatacaatgctctgatgtttcctcttgtgagtgcggccaagtcaaatgagctatactttctattgcccgagaaaggggagcgtgcaattgacaaggtttcggtgattgctgttgatactattactaagcatgtgaagattcatcagtacattgaag

SEQ ID NO: 75849 - DNA, 798 bp, Triticum aestivum
  Clone ID: PAT_TA_75849
attcggccgagggttcaggtggatgaccccgccggcgccttctccgtcaccgcgtacgatgccaaccactgccctggggcagttatgttcttgtttgagggtgaattcggtagcatactgcacacgggcgactgccgacttacaccagattgtgctcagaacttgccactgaaatacatagcaaagaaagggaaagaaaatgtttgtcggttagacttcgtgttcctggactgcacattttccaaatgcttcctcaaactaccaagcaaggagttggcaatccagcaggttatagcttgtatatggaagcatccggatgcaccttttgtatatcttgcttgtgaccttcttggtcacgaagagatcctagttgaggtgtccaggacatttggatcgaaaatttatgttgacacgagaaggaattcagattgttttaaagctctgtcactcacagcccctgagatcatcactgatgatccatcttgtcgctttcagatagttggattccaccatttgtatgataatgcaagtaaaaagcttgaaggggcaagggctagtcttcagccggagcctttatttatccgcccctcaacgcagtggtatgcctgtggtcgaaaccagaaacccagcctaacagaagctcagcaggatgattttgggatctggcatgtctgtttctccattcactcttcccgtgacgagttggagcaggcgatgcaacttcttcgacctcaatgggtcatctcaacaactcccccatgctttgccatggagctgagctatgtgaagaaacattgt

SEQ ID NO: 75850 - DNA, 654 bp, Triticum aestivum
  Clone ID: PAT_TA_75850
gaggggcccaccatgccggaggtgctgcagatcgtgtccaagaaggcgccgccgccggaggtgccgctgttcaagccgaccttcgtgtggccgccggaagggggagcggcgcacttcagcctgagcgacatcgagatgacgacgagcagcgggggcagctacgtcggcacaggcactggttcgtcgacgcgcgcgacgcaggagacatcctacgacagcttccggcagccgccctcggcaccaaacaacagccaggagtacttccccgctctgtcctccggccggtgacgaagttaacatatgtaaactgtaaaactggccatgagcgaaaggtaatcatagtaaatgtaaatacatgtagatattacgtgcttagtagtacggtgttcttcattagtttgttcaagctagggaatgagaggtacgtgttgctctggcaaggaggagatcttaccttgcaaagccatatggcaaggttcactgcagatcgacgagtccaagtgaagcccaagtgtctactctaatgtgtatcagctagctagtcctatgattttcagaagtgaggctagtgttgttaatatgctttggttagtttgttttggtttcttgagtaacaaagatccaaaaaaatgtttgtgataaaaaaaaaaaaaa

SEQ ID NO: 75851 - DNA, 655 bp, Triticum aestivum
  Clone ID: PAT_TA_75851
gaggcttgggtccatgacagatttgatgagatgcatccacgtggttatcataatggcaatatgagaaatccaaggggccgctctggagggcgtgttggtggacctggcggtaggactcgtggtgttggccgtggtaatttcagaggcaacaggtctcgagcgcataatcatgatggtaaccagaactacagctatgttccaaagggatctctagtttcccttgataatacaaaaaatgctggaccagtcctgcgtgagcacaggaagaacagagctcctaaatcgtctcatgctcgcaatgatgatgttgataactttgatgtggttccaaaagaatctcacacttataatgacggttccagaagtcgtaaggccacaccaagcgtaattcgtggcagaggctctagacgttaccaaccacgtcgcagtactactgagatatcttcagagcaaaatgataaatcacagaaacctgaaaatgctttatcaaatgcaaatttggggaaacaccaacctcagaattcaaattcttggcctgagcaaggttttcctaataagcaatcctttgcatcaaacttgaattcagcctcgccgccattttacccttcaaggccgtcccaccaggaacaactgattggtcaaagggggaatgcac

SEQ ID NO: 75852 - DNA, 661 bp, Triticum aestivum
  Clone ID: PAT_TA_75852
attcggcacgaggcgcaaggaaccccaaatctccaaccatcatatctgaagttctcaacaccataagccgagcgcccggggacaaaaccatgactatcctctccaaggatgctcctgcggagatctcccaccccgcccaccccgagcacaagctgaagctgatggccaccggcgccgcggagttccagtgcaacgtctgcaaggagctaggcgccggggaccggtacacatgccgaccctgtgacttcgacctccacagcgactgcgccctggcagaggccacgctggtgcacccattgctcaagggcagagagttccagctccgcctcgagcacccgcgccacagcgacgccggcggcaggacatgcggcgcctgcggcgggaaggtgctcgggctgcactaccactgcgccgccaagaagggcatggacctccacccgtgctgcgcggcactgctgctggtgatccctcaggaggagctcacgctggagcttcggaaggaggcgtctcaccggtgcagcagctgccgggaaagaagcaggagcagggcctggttctaccgttccacctgcaagaccgtgtacctgcacgtcgcctgcgtcaaagagattgctcgccggaaccgtggcgccggcgccggcgagagcactgatccattcgc

SEQ ID NO: 75853 - DNA, 778 bp, Triticum aestivum
  Clone ID: PAT_TA_75853
tttcggtaccaatggagttaatgggtttccagcactgaaagagctcgtattcgaagacatgagtaatttcaaaaggtgggcttctgtacaagatggtgaatttcttccatccctcacagaacttgtagtggtggactgccccaaaataacagagttcccactactcccatcaatgctagtgaagctcaaagtttctgaaacggggttcactattcttccagaagtccatattccaaactcccagtttccatcgtcgttagaatgcttacagattcatcagtgcccaaatctcacatccttacaagaaggactgcttagccagcaattattggctctccagcagttaaccatcactcaatgtttagacctaattgacctgccagttgaaggattcagatccctgtctgctcttaagagtcttcacatctatgactgcccaaggctggcaccatcaggacagcatagcttgctgccctccaaccttgaagacttgcgcatcagctcatgctccaaccttatcaaccctcttcttcaagagcttaatcagctctcctcgttgacacatctcaccaccgctgattgtgctagccttcagtcttttccagtaaagctccctgccactctgcaaaaactggagatcctcgattgcattaatctgatctacttgcctgctggtctagaagatgcatcgtgcctaacaaccataaccatcttgaaatgtcctctcataccatgcttgccagggcgccttacagggtcattgaaagaactgtacatc

SEQ ID NO: 75854 - DNA, 646 bp, Triticum aestivum
  Clone ID: PAT_TA_75854
agaaaagaaagcgagagaagcgctccaagtcgtgactcgtcggccatggcgcagccgtcggcggcggcgaggaagccctcggcagcgccaaccgtcgtcctgacacttgtcctggccctcgcctccgcgagcctcctcttcctcctagtccacctgtccccttcgtcgccatccgcgcacccgcacccccaccgccgcctccgcctgcgtggtgcccacctcaggcacggaggcgccaccccgcaccagatcccgttcgaccccgtcatcgccgacctcgagcaccgcctggacgaccgcgagtgggagcgcctggctgccgcggggctgcacgcgccgggcatggagtctgcccccgtcccagaggacctcgcagactatgaggacgagtacatcaatgacgccgcgcggttcaacatgacgctgcgcgtggcggcgctcttccccaagatcgacgtggaccccgccgacgacgccgtgacgggcgccgagctggccgcgtggaatctcgcgtccgctgcggcgggaggtgctgcaccgcaccgcccgggagctcgacctgcacgaccgcgaccacgacggccgcgtcgccttctccgagtacgagaggcccagctggggcttggcggttcgacgataataactc

SEQ ID NO: 75855 - DNA, 767 bp, Triticum aestivum
  Clone ID: PAT_TA_75855
tcggcacgaggatgactcctaatctgcctgaacacctacaaaaagaaggatgacaagggcaaggagctcgaggcactgggctgggatatccacttctggcttggagagaccacctctcaagatgaagccggaactgcggcctacaagaccgtggagttggatgacttcttgcaccaggcccccgtgcaacaccgcgaagtgtgcggcttcgaatcctctctctttttgtcctacttcgagaagaccggaggcgtctgcctgttggagggaggtatcgagtctggcttcaaccacgtcaagcctgagaccttcactcctcgcttgttgcacttgaagggacgcaccaacatccgcgtcacccaagtccccatcgaagtcaagagcttcaacgaaggcgatgtcttcgtgcttgacactggcttgaacttgtaccaattccaaggcaagggagccggaaagaacgagaagggacgcgccggccaattgtgccgtgccatcgatgatgagcgcaagggcaaaccccaagtgcacgtgttttctcagagcgaccgcaacgtcaaggagttctgggatgaggtcgccaagttcgactcctcctcctccagctggcccaacggagttcccgccatctcccctgatgatggcaaggacgaagagtgggagaaggctaccgagcaaaagttgttccaattgtctgatgcttctggatcgttgactttcactgaggttgtccccgcagtgaagggcaagtaccaacgtggcatgct

SEQ ID NO: 75856 - DNA, 678 bp, Triticum aestivum
  Clone ID: PAT_TA_75856
cggcacgaggcgtcggaagcagctttgtgttcacagcaggccggattgcatcgtcgaggtgtccccgtatgtggtggtcgccgcagagtccaaggtggatgtgtacaggaggaggaatggggtgcacttgcagaccgttccgatcgcgaggagaggcacgggtgttctgaccgtggcgagcgatgatgatggaagcagcggggaggtcgttgtggtcgctacggcttataaggtaaagtaggtatgttgttgactcagccatcaatggaacttgtccccaaatttataaatacacggtgttgccttctatgagtagctttgcgctgcatactgtgaaaattaatgccattttgttaatcttagggagagatgccaagtagttgcagagttattgagtggacatgcttagatgggcctggaagacaggaagaagatttaacttgaaatggtcatgaattggaactaattgtgtgtagaacagcaacaacttacactagttttgtagcctccagtaagtttatgagcaaacagaattttccttctcttttagaaatatgcaggcagctccctgatcagtgtttgttgttggttgctgtaaagaactagttactagtgcacaaatgagtctgagacatgccaagctaagctactcaccatttgaactttttgcgccatcct

SEQ ID NO: 75857 - DNA, 719 bp, Triticum aestivum
  unsure (1)..(719): unsure at all n locations
  Clone ID: PAT_TA_75857
attcggcacgaggttggtaaaccagtcgtgtccttctgtgaaactgtacgtggtgaatcttcacaagaatgtttatctaaatcacccaacaaacacaatcgtttaaccatgactgctgaacctttgggcgaagatttctgcaaaggtgttgataacaatgacattaaccctgaagaagatatgaaaacacgtgcacgtaaattagctgatgattatggttgggatgttggttttgcacgtaaaatctgggccttcggttgtccacctgatggaaaagccaatgttatggttgataacaccaaaggggttgcttatctcaatgaaatcaaggattcagttgttggtgccttcttccaagctacagctggtggtgtttattgtgaagaagctatgcgtggtattcgtttcaacttaaatgatgtgacattacacgctgatgctattcaccgtggtgctggtcaattgatgcccaccaccaaacgttgtttatatgcctgtcaaatggtatctaaaccagctttgatggaacctatgtacttatgtgatatcactgtccctgtctccgccngtctctggtgtgtacaacaccttgaacgctcgtcgtggtgccgttgaaggaaaagaagatcgtgctggtacaccattatgtcaaattaaggcttatttacccgtcttggaatcattcggtttcacccaattattacgtcaaaacacttccg

SEQ ID NO: 75858 - DNA, 684 bp, Triticum aestivum
  Clone ID: PAT_TA_75858
cggcgcctctccgggcatctacttcctcacaggccgtatggcccacgagcagttccggttgcagaggaaccccgtcgctggctccggcccgcaccatctccgcccgtcgccgttcccagcacacgaccgtccccaaaacactacctccttcccgtctttttcctgcaatgctccagcccgcaggcgagtagtgcggcagcgccccctgtgcctatcatctccaccccgctcggcctccatctacacggcggcatgagttatgcggttcagctcgggcgcacgcatgatgcggttcggtgcctgtgcacttgaagtctctaatgcagttccataaagtctcaatgcagtagaaaacgcccctggaagagcagtatttccagttgtggcgtggtttggtcaatgacacagcaacaatgctcttgaagagcagcatctacccgtgtgcagttcataaaaagtttagagcaaaaacggctgtgttcgacccctcgaggtgcagtgcaatacggcttgcatgcagtaccagcgtagcgtgcatgcaatcacctcctccctggcattcctggacgcctgccggccgacatctacaccaaagttggagacgagcttcaccggtctttgttgtgcagttaagtatgtatgcatgtgtacttcggtattgtgcatgtacagttgcagctcact

SEQ ID NO: 75859 - DNA, 710 bp, Triticum aestivum
  Clone ID: PAT_TA_75859
tcggcacgaggaatgcggccatcaaaccccttgtcaatattccgcttgaaagagcacacccaaatcggggtcaatcaagtcgtcaaccagaggtcgcagctggtcctgcccagcctgcacaactctttccggtgccgtcgatgatgtttaatcacccaccaattggtgatgaaccactgaaaaatgagctgcacaggttacggttacacattgactcacttgataaaatctatgaattaaagcaatcacagcttcagacagagtgcagccaagaaattgagaagataaaacaaaagtatgatttgttacttgaggaacgggattctgttcaccttgagcaaatgaagacacttgatggtttattggagaaagttgtcttccaccaatcactagctgccgatttccgagcgaaattcatatcatcatctgcagcacaagcaaaagcctatagccgtccaattcatcagacaccccaggcttctcagcaagcacccatgaggccgccaggtgtgacatcgatttcgccgccagttgcgtggtcatcagctggtcgaccagtagtgccgggaggtgcacagccatcacaggtggatcgaccatcaacgccggcatcatcacaggtgcctcgtccgccattgccatctacaccagtagtccggcctcccataaaccctggcaaccttgtcagaacaacaggtgctcccatgcct

SEQ ID NO: 75860 - DNA, 727 bp, Triticum aestivum
  unsure (1)..(727): unsure at all n locations
  Clone ID: PAT_TA_75860
ggcacgaggggggaggggagtgtataaaaaaacaaaaaaatgcctttcatactttaatgtgtgtgtttactgtttgtttctcattcaagatcaacttattttctccaacaaaaaaaattagtaaatatatttactactatgctctttagtttgcttaattatttataaaaatatcttgtgtccattttagcaaaaaaaaagatcaaaaaaagattgtgtttactttctagcgtctagaggcatgttggcccaagagaaaaaaaatccaaaaatatgtataggtgctaggttttataccatttgctagtcttttttcgttttgttttctgttggtgggtggattttgagggtgagnggaaagtttgggggaactccgcctatgctattaattttaagcttacgcttaatgttattcatagccggtcccaagcccggaaaaaggaggaggatccaaccttatatagcttgaaatttatatgcaaaatttcatgattttcgtaatattttcagcttcctatctattctgcctgttgttcatttctccgcatggccaccgatccaccggacggggacgacctgccgcacagctgcagcgatgctctgttcgaatatgccgaacaggtgaagaatttggggagcactttgtccgagctgttctctgaacctcttgggctcaaaccgagctacctggcagagtagtgcaaccaaccactattatcatttcctg

SEQ ID NO: 75861 - DNA, 717 bp, Triticum aestivum
  Clone ID: PAT_TA_75861
attcggcacgaggggagcaacgaggagcaccgccgttgcatcgcggcttgccttgtgaaagctacttacatcatggaggaggaccggccaaagtgcagggtgtatgacatggggttggcgccgccgtggtggcagagcttccacttcgagctgcgggatctgctcaagtgcggcaccgagaacgcggacgagttcatcttcggcgccgtattcgagtactgcccccccgcggggtggcagcgccacccgtcggccccaaactacgttttcgccctgcgcggcaccatgcctcggcacccaaagtccgcccacgacctgtacaacgacatcaaggtcttcctcagcgacctgccatgctgcagacggacccagaaggcgcgtcaggcggtggccaacatgctcatccgtaagggcacggagcgctgtgtgttgtggctggcggggcactcgctgggcgcgtcgctggcgctggaggtggggcgggacatggcggagcagcaccaggcgtacctgccgaccttcctcttcaacccgcccaacgtgtcaccgatgccggccttcaacctcctcaacccgtcggaggtggcgaagaaggacgtgttcacggggagctacctcgtgaaggcggcgctcggggccacggtcatgaggtcatactgcacccgcatggagaaagtgttccagcgcctctccccgtgggtgccggagctgtacgtg

SEQ ID NO: 75862 - DNA, 783 bp, Triticum aestivum
  Clone ID: PAT_TA_75862
attcggcacgaggggaccaccgctccggcggcccgttgtttctggccgccgtccgcctcgttggccctctttttggcttgcctctggtctcaagcaaacttcccctcctcctctcgtcgcgccactccacgcatcctgcagcgccgaggaaggtggaccagcgacggccggatcccggaggaaaatatggcagtgggatgcaagacgaagctaatcggcggcggtgggtgaggcggcgggaggcgacggcgacgggcaaatcggtcaacgatagatacggttcggttccgtccggccttccgcgccaaggcccgcggcgaggagttctcctgcaagacgcaaaaacatcaaggacacggtccaccgggaggtcgagatcatgcaacacctctcgggccaccacggcgtcgtcacgctcaaggccgtctgtggcggctgcatatcgaggcggcggctgcagatcgaagcagctgaaagggatgagatgactcggagtcaggggctacatatccctgctatccttgattttgtgtccaatattatgaggtgatttgcttactaaatcccatatgtgctaaattgtaatgcttctaaacatttgttctgtcttacgtgcctgctagcttttactggaaatcatatcatgcgttctgtatttgcctttgaaattgatgtatctcacaggctagcttatatcatggtcatactgctactgtcaatactactgcataaacaacttgttagagtagctttttattaatctacttttctgcccaaatttac

SEQ ID NO: 75863 - DNA, 685 bp, Triticum aestivum
  Clone ID: PAT_TA_75863
agggagataggtaccagtggccttccagctctctcctgccacctccatgccgcagttccacggcctccacggctactcctcccctagctccatggtgatgatgtccaacccgtccataaaggcaaagttgaacagaagaatggtggttaaggcttatgtacatggcgcgggtcagcgggtcacggcgatccccaaggtggacctctctaggctagatccgggtgcgccggggtgggaggatgcctaggcttcgatgaccacatccatggtgaggcatggctgtgtggttgtctcgcatggcagcgtgctcagcccattgcccgagctattcgctctcccggtcgaggccaagcagcggaacgtctccaaatggggcccttccagcagctaccttggaaaggttcccggccttcttcgggagtacctacgtgtcgaggaggccactgatgacgcccgcatccgtgaattcacaaacctcctatggccacagggcaactctgctttttggttagtagttctattttcagttacgctattttttccgcttgtctttctggccttttaccatcactttaacaaaatttgaacataaaatgtcggcgcaaccaactttagtatcaaattttccagcacttcatcccataatgttagacgtctagcttgcgaaaacgtcttatatatatta

SEQ ID NO: 75864 - DNA, 710 bp, Triticum aestivum
  Clone ID: PAT_TA_75864
tcggcacgagggcgcagcgtccctaattaacttgattggtggggctggtcgtgtggaaaaggaatcagccaacggatctcatggggcggtggtcgaaggatttgggcacaactctgctgggtagtttggtggtggtgctatgtgcggcgaggaaacaagcatggctgtcggcggcactgccgtgtcaacacagatgccattgaccggggcggcgttgaagcacatttcgatggagatcaggacgctgttattcaagatcgaacaaaaagtggcgatggaggctctgctcaatcgactggcaaagtggctccccaagcccctggatggactaagagatggcggagagagctgcggccctaaggccttctatgggtggccgggcatcgagcatgacccagatgaacaagcaggcatctgtgattgcagaccaagcagagagtggcgatgcaacttccgctcaatctactggcaaaatggatccacaggtgtcgggatggaccaaaagggttaaagttgggaaacacgtgtcggacgccttgcccagtaaagagttggcgccctacaataaagtttgatctatccgacgagcacggggaaactcctgccgacgccaaagaggacggtgaccacaacatagagcccatagagggttgtggcagagcttgatcctgacgccgaccatctgcttggcaaggcagagcagcttgttc

SEQ ID NO: 75865 - DNA, 574 bp, Triticum aestivum
  Clone ID: PAT_TA_75865
ttcggcacgaggttccaacttccaagaagcagcctaggtagcttagtttaggaggaagccagcacagcagcaggtgaccggctgcaagaatgggagggagcatgtcgtgcttcggcggcagcggccgggactacgacgaggcgtacgagcagccgcggcggtcgtcgaggaaggtgcggccgagcgacgaggacgggctgtggtacgtcggggagcgggacgtcgataggaaggccacggagttcatcgccaggttccacgcctccgcaagctacgtcgaggctacctaggctcgcttgatcttctgctgcttccgccggtgatctccgggtccggctacgtacctcaggcgccccgaggtggctggccagtccgcttggttaatcggccattgagttgttatcctgctgctctctttctctagttctattagtcttggttattatctacattaatctttgtgattaagagtgtgtaatttaaatatgtatgtattccataaataagagcaaggctggagggaggcatgagcttatgtacgtgaaaatatggagagatattggtctttgttgtt

SEQ ID NO: 75866 - DNA, 563 bp, Triticum aestivum
  Clone ID: PAT_TA_75866
cgtttccaggacgagctccgtggcaagctcggtgagctctacaaggccaagaaggacgatgtctccgtcttcggtttcaagacacactttggtggcggcaagagcaccggctttgccctcatctacgacagcgccgaggccatgaagaagttcgagccccgctacaggctagtacgatacggcatggccaccaaggtcgagaaggccagcaggcagcagcgcaagcagcgcaagaataggatgaaggagttccggggcacagccaaggccaagggtggcgcgaagaaggacaagaaataagcgggtgcactctgatgatgactacgaaggtcatggccggggtcgagtggcggtttctctggaactactgttccgcctgcttcttcatcatggtggatacggagttgtttctgcaggcatcggcatgtttatctacgatcgcctgaaaaactcttgcggatgggaacgacaagacggatggcgtttgagatcaattgtctgctaaccatcaatgcatatcatggactttacgatcctccaattcaaaaaaaaaaaaaaaaaaa

SEQ ID NO: 75867 - DNA, 768 bp, Triticum aestivum
  Clone ID: PAT_TA_75867
tcggcacgaggatttgttagtcaagattggcacctatggctccaactgtacaccaccaagggtatccgaatcccgcggggtttccgggaaagcgccctactcccgtcatattgctgcttgtggcaatcacgtgccttgccgagataggctgtctccccaatgtgaacactgcagcgactcagactcagactcagactccatgcacggaagcgatttcgttatccccatttagcgtgcgtatcttatacaatgatacagcaattgatattcccgcaggacaagcaccaccaaaagtcatgcctgatgagttgaaactttattatactcgttgtgggaaaataccaattgccgacatgtatattgacgataccaacaatggtgttgggacgcattatcaatatccgcgaaaccaaattcgaacatttattaaggaagccaaagctatgaaaaaaggtggacggactggaaaatatgcatggttatatgccgcattgaaagcacatcccattaaacagcaacatgtggtgctatttggatctatggagccatggtttgaagccatctgtttagcacatggggcagcatcagtcaccgtgattgaatacaaccgtctcacttatgattatcccaagatacgaacgtacacaccagcagaacatgctcagattcaaccacctcccatctattcagtcgcttttgctatgtcagcatttgatcatgatggattgggaccgatatggagatccattacatcctgatcaagattta

SEQ ID NO: 75868 - DNA, 708 bp, Triticum aestivum
  Clone ID: PAT_TA_75868
ctgtcctggaagaaaggacatcctccttgcctccaactccagttctgccgcccagcccaggaagaagcaggcggccggcaacctctccgcaccctcgtcgcgcgcctcctctcctctcaggaaagatgcccgtgtcaagcgtcgcaaaaccttcgtcagctaaaccaaatccattcgattccgactcagactctgaatttacctcgaggcctgcaagagcatcatcttccaactcagttgatcctggtaccaatggccgatgcaagaatggcttccgcgattcaggcgggttcgacaaccaatccgtgcaagagctggagagctatgttgcatacaaggccgaggagaccactcagaaagtgaacgtctgccttcggctcgctgaaaacatcaaggaggatgctaccaacactctgatcgccttgcacaagcagggtgaacagatgaataggacccatgaaactgctgcgaacattgatcaggaccttagcaggagtgagacacttctgggaagccttggagggttcttctcaaaaacctggaagcccaagaaaaccaggcaaataaagggaccagcagttatctcgagagatgatcccttcaaaagaagggctaaccacctagagcagagagaaaaattaggattgtcttcaagccccagagggaagtcgaatcctcagacgtattctgatcctaccaacgccatgg

SEQ ID NO: 75869 - DNA, 673 bp, Triticum aestivum
  Clone ID: PAT_TA_75869
ttcggcacgaggtgcaggttggtgttacaagaaagggcagctgctgctggtgtacgagtacatgcccaacggcagcctcgaccagcacctcttccggcgcggcggcgcccaggagcagcgggcggcgccgctcagctgggcgagccgctacggcatcgtcgccgacgttgcctctggcctgcactacgtgcaccacgagtatggccgcacggtgctccaccgcgacatcaaggccagcaacgtcatgctggacgcgtccttctcggcgcgcctcggggacttcggcctcgcccgcgtcatcgacttcgaccggagctccttcaccgacatcggcgtcgccggcacgcgcggttacatcgcgccggagtactccgtggggcacaaggccacgagccagacggacgtgttcgccttcggcgcgctcgtgctggaggtcgtcacgggccgcaccgcgctgcgcgacgacgcgacctgcccgctgctggttgacttcgtgtggcggatgcacggccgcggcgcgctggtcggggccgtggaccaggatctcggcacggcagggtacgactccgacgaggccaacaggctgctgctcctcggactcgcgtgcagcagccccaaccccggggacaggcccaccatgccggaggtgctgcagatcgtgtccaagaaggcg

SEQ ID NO: 75870 - DNA, 766 bp, Triticum aestivum
  Clone ID: PAT_TA_75870
attcggcacgaggccgggcttggttgatgattcccagggttgccggtctcgatctgtgctgtccaatgattctgttattagagttgaaggcgtctgtgattgcggtgcaagccagacctaagggacgaccaacagaacatgcttgagaagacgatggcacccatcatgcagtcgttccatgggatcgtgacctgcattgagatttctgtgctctgcgcttcgccagaccgagatcaaaaagacccccattgtatcaatttacattggtaacactttattatgtcaaatcgttgagtgttcacaatgacactggaatgcttaaaatattcgcgtagttgctcagccccacgtaatattccaagagcgcatattttttgtatttttgattgttcgttagagttctagatactatgctcgagtagagtaggtttactataacagattgtttaggaaccacaggtgcagaaggtcttctaccatctgcggtgtgagggttttgaagcagatattcattctatgcgaccacgacagggatggtatgtattctttttgtacttgagactcttagatttccagtggagttttggtttctcccgctgagatcgtacacttgatgtttatactatgcattcaatctattcccacacctaaggtctgttagtgtggaatcttattttcctgtagtgtgattactatatgcacttatttgcgtgttttctcacttttatttgtataatcggcattctgcataagtagggcagcaaga

SEQ ID NO: 75871 - DNA, 267 bp, Triticum aestivum
  Clone ID: PAT_TA_75871
ttttttttttttttaggcgaaagtgtcttacctcatcgagaggggacgccgtgcatgtttataggcaggggcgcacctccctggatagcgcatacagttgggagattacaacttgagggagaagaaagatagagataagagtatatggttacatatctttagtctatatgagaatctatcatatcttgtatgagtgtccaatatgcctttttttgtgtcaaacaatgttaagcttagtgtttcttcgacacctctttagtctataca

SEQ ID NO: 75872 - DNA, 702 bp, Triticum aestivum
  Clone ID: PAT_TA_75872
tcggcacgaggcaggacttggctggtctgagcgctacaaaataatcagaggtgtttgtgagggtctagcatatcttcgcttggaaatagagaatccaataatgcatctggacttgaaacctgagaatatattgctaaataagaatatggtagcgaaaatcgcagattttggaatatcaaagctcttcggtgaagagaacacaaaaaagacaatgagtgtcataggtacaatgggatattggccaccagaatacataaagcatcaaataatatcaaaagagtttgacatatttagtttgggtgtaatcattgtaaaaataatggtcggacaggagaactacaattatattgtcgagactccagcccggaaatctatcaagtttgtacatgaaagttggaaaaataggctaagtaaaacgatatcgggtcacaaacttgaagcatattgcaatcaggtgaaaagatgcattaagatagcactagattgcttgaagtcaaaccgacaagaaaggcctactataaaacatattgttgcctgtttgaaagagaaggacacaatgttctatgaagatgatggagattcgtccactcttccttcagatatcaacgatatcaccattaactctacaccttgttcagctttggagttggtggagcacaacactctcgccatcatggataccgtgcatactctgaacgaaac

SEQ ID NO: 75873 - DNA, 666 bp, Triticum aestivum
  Clone ID: PAT_TA_75873
ttttttttttttttttatataaatagtccagatctcgttcatgttgacagaaattagcaatgctcacagctacatacgaaatcggccagagacaattttctagcttctttctatttttacagtgtcacatgctgaatttccaaagattgaacttcttaataatgacaatccttcatgtctatgtaggagctttatggtcgatctagacaataaattgctccgatgctggcgagaaatcttccattcgagcttccatcgcccctccgccgcacagatctggccatctccactcactcccctcataggcggcaactgcttgatatgttaagacactcattgtcgtccccacccactcccctcataggaacattgaaccgtaaaaatattatcagcgtattaggcttgcatcatgagttatatcttcgcttctatgaacacatcaagacatagagcttttgtgtttggtaagaaaattaagcagatatgaaggtaaaatgaaatcatcaatataattcccgcatagactactacatggaataacatggaaccgaggataaagtttaatttagtactccctccgtttctcaatataaggtgtattatttttttttaaagtcaaacttctctaagtttgaccaagtttatagacaaaaataccaatatcta

SEQ ID NO: 75874 - DNA, 749 bp, Triticum aestivum
  Clone ID: PAT_TA_75874
tcggcacgagggtcagaggtggctggttcatggcgggactcagttgcccaatatttcaggagcttgggaggtatctcaagtacctggctctaagctggtgcgatcttgaggaaaaagaccctctgccggtgctggcatgtcacgtaccggcgctcacttatctcagccttaacagggtgagcagtgaaggcatattggttctttctgctgggtgctttccgctgctcaagacgctcgtcttaaagcgcatgcctgatgtgaagcagttggtgattgaagagggtgccatgccgttggttgatgggatctacatcacgacactcttggggatgaatgctgtccctgatggcattgatacccttggatccttgaccaagttgtggatgctggatctgcacagggagttcaaggctgactggactcagaagcagatggatgacaagatgaagcatgtttcagacctccgcgtttagcctacctcctttccttccatcggtaatactcaattaagaagccacactaacgtcgatcttatagtacgttgtaagtgtgcatgtttttaattgtcagcagctttgatttgtttgcaactgcatgcattgttggaatttattcttctttccaaccagcgctagctagacctctcttctgtaataagtccttaaacacgggcatggcatttgatccatcacgaacttaaattgagtttgtttcattatatgagcttattatcactgcttggtttttgc

SEQ ID NO: 75875 - DNA, 657 bp, Triticum aestivum
  Clone ID: PAT_TA_75875
aagagaaaaccgcaacaccccgttaaacctccacggtgactgcatacgccggcgctgctgcctcgcacaacttcgagggggagctgtccgcggcgagcgaagttcggcatctccttctcgccgctccgtggcggcgatgccacctcgggctatcagcataaaggtggcgagggaagaagatttgtcctcacacattggaaacgatggcttctattttgatctcgtcgacttcgacagggtgagggctttccagatcccggataacacgactatgtcccgattgaaggaggaaattgcagtagagttcagcatcccatctcaatttcagcgcctctggttgttttgtaaaaggcaaaacgggacatggcgtcctgttaggccattctctaccgaagaaaacaatctatctatgactagccttcataaactattgtcaaggaccttcttgttcctgaatcctgattgtgtgaagctgtttttggaggtgctcaatgattcttccccacaaaatctgagcaacgatgatggattagtgtttttagagctttatgacccagaacaaacgcagatacgatatattggaatgctgtttgtaaaagcttcatcaaggccttcagatattcttccgagactaagaagtctagctggtttttgtgc

SEQ ID NO: 75876 - DNA, 687 bp, Triticum aestivum
  Clone ID: PAT_TA_75876
ttttttttttttttttttggtcgtctcgtcccataatattcttcatccaagcaactaaccggaatagtactgcgacaattaactcttaccaatttaattttctggttcgcagtaatccaagcaagaacaaaggatctgggtgggagaggtcacacgagaacaaataatttcacctcgctaaataggactataatgcccttttcaagaggcatgttctaatctccacgccttgagctgcatcgaagcacactacgcttcagaaacactgtttgaagaactgctcacagcaaacaatttgagttccttaggcagagccaacagccgaaataacaacctttagcgtcacctcgtcaacccctttagccgacttcttgtcaagcatgtcctgagtgatatcctcacgcatgatgccctcattcacagcggcgcaccgcatgaagaactcatccttgaacgctgtagaattgggtgccttctgctgtgcttgcaatgttaccatgacgttgcacttggattgtggtggcacaatacctttcttaggctctacgtcatacagcaatacgcctgtcattacaatatcgaaggcaacataatcattggatacgttggtcagctgaagggagcatggtatctgcttgtttatctcgaaggggaaattcagctccagcatgtcaagctcaagcagct

SEQ ID NO: 75877 - DNA, 679 bp, Triticum aestivum
  Clone ID: PAT_TA_75877
tatgttttgcaagaagaggacatgttgtatctttttaccgagcttagaggcactttcagagttttagaactgggattcacttttgatcaacctgagcacaagtgtttggggggggggggggggaaatagtttacatgttttctaccaacaagcaaggaataacacgtgaattttttctggtttattagttcccactagagcatctattattctgtcgaggaagaagtaaagaataattggtgtattttttgtgattgccaactgatgagactatctgggaaagaatagttctcgatgtaattcttcatgtgcctaccacattgacattctgttcggctatttttttggttgtgtcgaatatagttttcaagcaagtcctgcacatcaaccgaaaataatatagttttcaagcaagtcctgctatttttttccggttgcgtcgaatatctaccatttttagagaagtaaaagtcaggcaaatgacatcttaggcacacattagtaggtggtagtgagtattttaggatgatcaggattatggaaatagactttccaaaaatctgtttgtccacaataataggcaagtcacacattaaactatagcaagtctcttgcagttgtcaggcaaatcctgatttttggagttgtcgcaagtcacacgtaaaatactttgcaaggc

SEQ ID NO: 75878 - DNA, 756 bp, Triticum aestivum
  Clone ID: PAT_TA_75878
gattcggcacgagggaaggaccggccaaaggcggcgggttggacgggggctaggggaaccaggagcaccccagcgggcgcgggggcggaaggcggcgagcggggaggcggggaaccacagcggtggcggaaggaggcgatcggggacgtgggggcaggcaggaaacagcagtagcggctggtcgggaagagcagcggtgatcacagatcgtgaacgcgcaactgcaatggctccgatttgtgggagccaagagttcttggatgatctgacaatcaaagtctctcgctcagttgtacttgttatgtcattcgaaacccgtgggactcaccgtcaatttatggatatgccaccgatggaaggagaagagcgagatcgttatattcaacaaaacatgcgaactacccattataaatcatgcactggttttatcattggagctagtaaaagagttatctttatagctgtccatcattcgcaaatcaacacagctgcttttgatactttcagtgttcgtttccatgataataatgagaaggctgctaaaatctttatcaaaaaaacaaagtcagtcacgatattgtcagtagaacagcctgatcacccttatcatccagtgctccgcagtagaaagaggattggcagggacgatgtcctcattctatcaaatgtgcacttgggttgcttgaattcgtaccagagttctgttattaacccaacaactgaagctattgccaatcctgctgattccgacagcat

SEQ ID NO: 75879 - DNA, 647 bp, Triticum aestivum
  Clone ID: PAT_TA_75879
ttcggcacgaggcacaagtccacctcgaacggactgatcactgatggagtgggcgtacagcggcggcggccactcgtcgtcgggaacgaaatctccggcggccggcggccgggaggagggctcgtacatgacggtgtcgtcggcgccgcccaagcggcgggcggggaggaccaaggtcagggagacgaggcacccggtgtacaagggggtgcgcagcaggaaccccggccggtgggtctgcgaggtgcgcgagccgcacgggaagcagcggctgtggctcggcaccttcgacaccgccgagatggcggcgcgcgcgcacgacgtcgccgccctcgcgctccgcggccgcgccgcgtgcctcaacttcgcggactcgccgcgcacgctccgggtgccgccgcagggggccggccacgaggagatacgccgcgcggcggtcgaggcggccgagctgttccgcccggagcctgggcagcgcaatgcagctactaccgaggcgccggctgcttcaccggcagacgcggggaacgcggagctcgttgcaaactctccttaccacctcatggatggtttagaattcgaaatgcagggctatcttgacatggcgcacggcatgctgatcgagccaccgccaatggcggggccgt

SEQ ID NO: 75880 - DNA, 780 bp, Triticum aestivum
  Clone ID: PAT_TA_75880
gaggcgtcttcgtactcgcctctctccgcgcaaccgagccttcgccctcgtcctccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctctgccttgatcgtatcaggaagctttcagacaactgcactggtctgcagggattccttgtcttcaacgctgttggaggtggaactggctctggccttggttcgcttctcctggagcgtctctctgttgactatggaaagaagtccaagcttgggttcacagtttacccatctccccaggtctccacttctgttgttgagccatacaacagtgtcctgtccacccactcactccttgagcacaccgatgtctctatccttcttgacaatgaggccatctatgacatctgccgccgctcccttgacattgagcgccccacatacaccaac

SEQ ID NO: 75881 - DNA, 734 bp, Triticum aestivum
  Clone ID: PAT_TA_75881
ttcggcacgaggctccatcagacccttcttccccactatttggtcgttgctccgtgggcatccggaaggcctagctatacctagggtcgagaaccatgtccagtcaggggcaaaaaacgttcaagatcctgtgccgcaccgatgaggactactgcatcaccgtccgctgggatgacgacggcggcatcgcggtcgtcatggcgccaacaaacccccgcgaccagcagcagcactggtacaaggacacgaggttcagctctacggaggacgaggacgggttcccggcgttcgcgctcgtcaacaaggccaccgggttcgccgtcaagcactcgtccgggcagtctgagcccgtaactctggtgccgtacgagtacgacccagaggcggtgcacgaatcggtgctgtggacggagagcgacgacgtgggcgacggtttccgctgcatacgcatggtcaacaacatccacctcaacttcgacgcgttggatggggtgacggaactccaggacggcacccccgtcgtgctgtgggagtggctcgagggggcgaaccagtcctggaagatcctgccgtggggcaccgacggtggcctccatcctgcgctgtcctctgagtgcaccatgcgcatcttctgcagcgccggcgaggagtacagcatcgccgcaagggaaacggcgcggtgtgcctcgcgcctgcggaccccaacgacgacctgcagcactgggtgaaggaca

SEQ ID NO: 75882 - DNA, 736 bp, Triticum aestivum
  Clone ID: PAT_TA_75882
gattcggcacgaggcatggtgttgacaatgacaatcaagcctcgtggattcacccgacaggatcagaatctccggtgagcttcaacaatgatgagcagccaagtccagtgtctgttcttgaatcttccttggatgctgaagaagtttactcaggagatttcgagaaaattagtgccgatcttcaaggactgcgaatgcaacttcagcttctcaagacggagaccacagacgatgcagacgacaccgatcatcttacagcgagcgacgacgaggttgcctcggcagatgagccacttgctgaaatggagatactaccccatgctttcgtggatgaggaagaacgagatttctcgtatgtgcttgatatgctcaccttattgggcattgatgacgctttccaggacaggctactcgacgtgcgctgcttttcggaatatcctgctggccctgatatatacgatatacttgagaacaagtacagcagcctcattctatggccggcgtcggagaggatgctcctgtttgagctcacaaacaccgtgattgcagatctgatagcctctctggtgcatcatgggtcaaaggggttgctgcgaaggttctcatccaggtgggatcaggaggggtttgtcgttgatgtgtggcagagggtgttcgagatacggcaagagatggacggtaaccagggcgacccgctgatgatggacttcgagcggcatggctctgaggatggcgt

SEQ ID NO: 75883 - DNA, 665 bp, Triticum aestivum
  Clone ID: PAT_TA_75883
ttttttttttttttgccactgatgatttatttcacataagaaatgaaaaataacaagaattcgagacacataattatatctaaacttaacaatgagctttactcaatagaagtttgtacagccggtcgtattatcttccaatcagaaccaaataaggttggttgcacaaacaaatgaagaaatagcttgaccaaagttctcctttagcaggtcctattatctaatttcctaaaaatgcagaatatatttctacacttgtaacatcaaaatgcaagtttcgttcaacaaaatcttctgatagcttctccatctacccttctttatgaaatccgcaaacacggtgtctagctaaaaacatagattatgaaatcaaaatcagagacacgggagtaaagaggtaaagagaaaggagcacataacagagatttgttgtgggctgactattgctgctgccgtaggattgtttggccccacaccattgcagctatatcatctcacgctgtttgttgacactgcatatacttcaatactttagctcgtcaaaaccaaataagcatggttgcaataaagacatattttaccaaagatctcctttagctggtcgtattatcttccaatcagaaccaaataaggttggttgcacaaacaaataaagaaatagctta

SEQ ID NO: 75884 - DNA, 681 bp, Triticum aestivum
  Clone ID: PAT_TA_75884
aatgttcgcatcatcaccaggagggttggaggtggctttggtggaaagggaatgaaaggatcccatgctgcatgtgcgtgtgcgcttgctgcattcaagcttaggcgccctgtccggatgtacctcgaccggaagatggacatgatcatggcgggagggcgtcacccgatgaaggcaaagtactccgtcgggttcaagtcggacggcacgctcacggcgctgcatgtcgatctcggcatcaacgccgggatatcaccggacttaagcccgttgatcccggcttacaccatcgcttctctgaagaagtacaactggggcgccctggcctttgacatcaagttgtgcaagacgaacatgtcgtccaagtcggtggtgcgggcgcctggcgacgtgcagggttccttcattgccgaggccatcatcgagcacgtggcgtccgtgctcgggtctgacaccaacgtcatccggagaaagaacctccacagcgtcgagagcctcacgaagttctacagcgactccgcgggagacgccccaacatacagcctcgtgggcatctttgacaagctggcctcgtcggcggagtaccaaagcagggcagaggctgttgagcggttcaatggcgggagcaggtggaagaagcgcggcatctcatgtgtgccgatcacctatgaggtgaccctc

SEQ ID NO: 75885 - DNA, 808 bp, Triticum aestivum
  Clone ID: PAT_TA_75885
attcggcacgaggctctcccgtgctcgccctccgcaccgccgcggcgccacctcctcctccgacctcctcgcggcggccgggatgttctactcgcaccagctcctcgcgcggaaggcgccgctcggccagatatggatggccgccacgctccacgccaagatcaaccgcaagcgcctcgacaagctcgacatcatcaaaatctgcgaggagatcctcaacccgtcggtgcccatggcgctcaggctttccgggatcctcatgggtggcgtggtgatcgtgtacgagaggaaggtgaagcttctctacgatgacgtgtcccgtctcctgattgagatcaacgaggcgtggaagatcaggccggccgtggaccacaccgtcctccccaagggcaaggctcaagccaagtatgaagcagtaacactgccagagaacgcgatggatatggaggtggagcagcccgtgcttttcacagatactgatactgccaggttccggggaatgcgcctggaggatttggatgaacagtatgtcaatgtcaacctggatgatgatgacatctctcgcgccgaccgtcatcatcaagctgaggcagtcaacattaccctggtcgataattttgagtctggtcttgctgaaactgacatcttcaatcgttttgagagatttgacatagcagatgatgacaccacagtccatattactctcgatgaacacccagaggctccaagtacactagttccctctccaccaaggccagaagaccctcctcaacacaggaacagtgtgctgccccatcctccatccgcg

SEQ ID NO: 75886 - DNA, 792 bp, Triticum aestivum
  Clone ID: PAT_TA_75886
aattcggcacgaggcttatttgaggtcaattatgtcgcgctgtcagtacgagaatagtaatgaaattggggtgttcgcgaagctcacgaatgccttctgtttggtgtctcccggtggttcacagaatttttacagtgtattcgagtcggagttggcagatcatatcccagtgattcagtcctctattgggggatgtcgaattgtggggagattgactgcaggcaacaagaagggtttactagttccttcgactaccacagatcaagagttgcaattgatccgcaactccttgaaagacgatattgttgtacgtagaatcgaagataaattaagtgcgttgggcaactgtatcgcatgcaatgatcacgtggccctcgttcatcctgatatcgaccaggagaccgaggagattattgcggatgtccttgacgtagaagtttttcggcaatccattgccaaaaacgtgttggtggggagctactgctgcttaacgaaccaaggcgcgctcgtgcacccacgcacaacagttgaggagcaaaaggagctctccgctctgttgcaagtgcccgtgacggctggcacggtgaaccggggtagcgaggtgattggcggtggattggtgtgcaacgattgggcggcattctgtggcttggacaccacctccacagaaattgccgttatcgaaagcatcttcaacctgcaggacctggaccgggccagcatcgtcaaggagatgagatcgagcttgatcgacactctctcttaaaaagcaagaagcatgaacttttcttt

SEQ ID NO: 75887 - DNA, 767 bp, Triticum aestivum
  Clone ID: PAT_TA_75887
gagggcgggacgagcggcggagcagacatttgatcgtatggttgcgtcaggtgtcaaacctgatcgcttagcctatttggttatgctgaacattatcacaaggtttggtgagacaaaaaaactgatggctctgtatcggacaatgatgaatgatggttatgtgccagatgacaccttgtatcaggttatgcttgctgcacttgcaaaaggaaatgaacatgaggagattgaaggagttatgcaagacatggtggttgtttgtcaaatggatcggcaactggtatatagtgtactcatcaaggcgggttgcatttttcagggtgctatgctgttaaagcaggcatgcctacaaggacacgagcctgacagtaagagtttactgtccactttggatgcttatgaaacaatgggaaagcatgcaaaaggcctctctttgcttcaatgcatcagagagcatgtccccagctcccataaattgatatctgaatgttccatcatgcttctgtgcaaaaaccagaagatcgctgctgcccttcaagagtacagcagtatgcagacattagtgtgtggatcttttggccaagattgtaacttgtatgagtgcctgattacatgccttgaggaggctgaattcttgcctgaagcttctcaggtgttctgtgcgtagagccttcccagaagatatacgagagtatgatctctacatactcgtaaattgggcttcccaggaactgctcaccaaatgatggatgaaggcatgaatctgt

SEQ ID NO: 75888 - DNA, 543 bp, Triticum aestivum
  Clone ID: PAT_TA_75888
agtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcagcgtcatcgtgcctatgcgtgtgtgtgtggccaacaatgcttataccagtatgtcgtctcttcgtcgctgtgttttctctctcgagaaaaagttggtgttgcttgttgttcagctatccggaatatcctccgtgaataaacagctgtaatgattgtgcgtggctgccaat

SEQ ID NO: 75889 - DNA, 604 bp, Triticum aestivum
  Clone ID: PAT_TA_75889
attcggcacgaggcagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcagcgtcatcgtgcctatgcgtgtgtgtgtggccaacaatgcttataccagtatgtcgtctcttcgtcgctgtgttttctctctcgagaaaaagttggtgttgcttgttgttcagctatccggaatatcctccgtgaataaacagctgtaatgattgtgcgtggctgccaataataaaaaaaaaaaaaaaaaa

SEQ ID NO: 75890 - DNA, 665 bp, Triticum aestivum
  Clone ID: PAT_TA_75890
ctttccccaccatcaccgtgccattgtcggcatcggcaacgtgctcctgcttgcctcgctgcccgagggcgcccatcgtcttggacgtcacgtcgagcagcacgccgcgcctcgggcgactacgtcattgtcatcagccacaactccgacaacggcaccaccaagatcaagtcagtactctgcatgacccagccagtctgcgctggctaaggcgcctgcatgctttcgcccttgccacgcagaggcaggtgcatgcaggtggggctggccggcctcacccaccagcgccggagcggctgctcgacgcgacgcgaggatgtacgccacacaccggtacatccgtacatgcgcatgagatctctccgccaagcgtcctccaccactttctcgcccggctcgacgcggttgggtgggcgtccgtgcgtgcgccggcgtacaccacgcgctgggccggtcccgggctgcgccaaggggctggtatccgaggtggaggggctgctcatgtggtgttcgatgaaatgccaacgagtgagggtgatgaggaagaagaagaccaagtcaagtgccacgtaggcatttttttcttccaactcagcctgatgtcatcaaaccacttatctccctctgtcagtgttttttgccatttttcagtgcggtgcattttg

SEQ ID NO: 75891 - DNA, 781 bp, Triticum aestivum
  Clone ID: PAT_TA_75891
gaggctcgataccgcacctcctgagttcgttttgcttccatggcggctcttgcccaagctcctagcccagcagaatccatcgatccaccgaccagagaccatcgccaaagtgtgacagccgctgacgggactggaagaggaatggtgtataacttggcttatttggagctccctaaatgcgcgtcttggagccttcctggtgggttgtgtgtgctgcatgagctggaagagttgggctctttctcgtctgacaagacttccgagatttctaagcctggccgtagtgatgaagagtttattatggtgggctcaacgtttcgcatggatgcacacaatttggtcaaaacgggttgtggctcagctaaatctgacctcagtgttgggttgattctctacaccttggtcacacgcgatcacaaaattataaataatgcaccccttggtaagcctcacagttctgaatgctcaaggagacttgaagtatacactaatgatgtaagcgtaaccgatagacaaaaaggagaaaaacatgacgggaatacattgaagagtactgacgctcgacttgccttgaagcggaagtcatgcaagaatgaccttgtgtccaaaggaaatcatgcacatcctgataatggttttgttactgattcatcgggtgaaactagtctcagcttgaatgctgcaactgaaactccaatgcattatcggccagagggaggactcgtccacagcggagcacctagccaccctgcagctgcacaggaatcaggcacaacaccac

SEQ ID NO: 75892 - DNA, 818 bp, Triticum aestivum
  Clone ID: PAT_TA_75892
tcggcacgaggaatttattgtcaaagttcaattttaaaatgtgtgcgcgccttatttatggtcaaagttcaattttaaaatgcgtgtgcactttatttattggaatggagggagtacatatcgagatttttatgagtgatttatttatttagttttgtgatcagtgagtgattataactggtcatttaaatagtcatgcatgcacacgaatcgctatgatagatctgatggcatccaaaggtggagccgctgctccatggttcacctgaacattagtgataagatatcccttagctttgggcttgcagccaatagtttagattattagccctcaatataaagaggacacattgagatgaattaatcaacctggaagtactacactctgtcgtccatctaccctgtccctcccaatccaaaaaggcttgcctgtttttagtgcataaacccttgtgatcatttcgcgaactttgtgtaactcttctacttctagtaaaaattctggtgtccttgcccgataataagcgctggcaggttggtgaagcataatgcgagaatgctatatgcttggaggttctcctccaagcagaatgaaggacgccatggaggcggctattccgaggcatattgtatatatatctggtgtcaccgtttgcatcgtatcaaaaatagccattcctgagattagccaccctgcctggggaggtttataaacaaaagaaccccctttcctagatcagcattgccaactggcgatatttatcctcgtgagccctggttcatgacaggagatggagaatctagtttcacgctcactg

SEQ ID NO: 75893 - DNA, 779 bp, Triticum aestivum
  Clone ID: PAT_TA_75893
ttcggcacgaggaccaattcaagttcttcgcagaactttgtcggaataaggttggagagaacgactctgtgatcattgttacacacgagccaaactggctccttgattggtattggaaggagattacaggcaagaatgtctcacatttgattcaggactacctgaatggaaggtgcaaacttcgtatggctggggatttgcatcattttatgaggcattctgctacaccatcagataaaccaacttttgttgaacacttacttgtcaatggatgtggtggtgcctttctgcacccaacacatgttttcaaaaactttgaaaggttctctggtactacctacgagtgcaaggctgcttatccctcctatgaggaatctagtgggattgcactgggcaacatattaaaattccgcaagaagaattggcagttcgacataattggtggttttatttacttcatactggtattctccatgttcccacagtgtaatcttgttcacatcttaaatgaggaaacatggtctgggcgtctgcaaagcttctcaagtacaatatggagtgctttgctttttatttttgaacactcttacgtctcctcagtaggaagtctaactttgttgatggcatcatattcatttgtaccatccaaactcacacggaaaaaaagagctattattggtggcctgcatgttttggcccatctgactgcagctctagttttaatgttgcctcatggagttgggcattgaaatatgtatacggaatcatttactggcaac

SEQ ID NO: 75894 - DNA, 710 bp, Triticum aestivum
  Clone ID: PAT_TA_75894
tcggcacgaggcttagacgttgaaaaattcgaggtactgatgttcatcacagataccgatgtggacgttgtcaatcagcagatatcaacattatcttttgacgaaggcgcgtccatcgaagatgaaatcaaggtaactcaggagatgctggggttcaaactgcaccgggttatgttgactgctgtcgtggtcatatctgaggataacgatcgagctttagtgacgaatgatataggcttcggaaaagaagtaactatgcatgtcagatccatagatgtgcatcccagggagccatgggtgctaatcactgaagatggaaaccgtattcacatttggaactggaagaccaatgggataatgggaattctacctgggaagtcatggtctaatctggaaggtggaaaggtgggccctgaagatgtggttgcaaaattcatcactcgaaagtcatgggttgtaatggggctcccaaatgggttcgtcgatgtgcgaatgtatcccacaatggacctagtcaaggaattcagagctcaccgtttaggtgtcactttattggctgttcactcaactcgtccgttcctgctgacctgtggttatcccccgtcgatgaagctttgggactggaaccgcaattggtcttgtaccggaatatttgacatctctatacccgtgacacaagtcatgtttaaccccaaggatagtagcatttt

SEQ ID NO: 75895 - DNA, 233 bp, Triticum aestivum
  Clone ID: PAT_TA_75895
attcggcacgagggaacacgcggaaggagatgctcctcacggctgtcgtccggatccgcgccgtcgagccgtgcccgatcttctcggacgatcctcgaggcggcggcggtgtagcggcacgacgggcggcggcagccctgtgtcagcgcgcagggagagatgcgcttcatggccggtgtccgcatccgcgccatcgagccatccggaggttctcagggtggtggcgcgctgcc

SEQ ID NO: 75896 - DNA, 690 bp, Triticum aestivum
  Clone ID: PAT_TA_75896
gaggagagcacctgggtccccgcctccagcgccgcgagcgccagcagcagctcgccgcgctcttccgcggtgcggcagccaacaacagcgccgccgcgaccgccgccgctgccgttgccaacaaacggccccgcgagctcgtccgctccctcggccgcttgccgtccgcgaccaccgcgatggtcgacgccaccacctcctcaggcgagggggacgggaggtttccgccggagctgagcctggaggccgtgttccggtgcgtgcggatagggccggtggacgagccggacgcggagttcgcgtaccagacagcggtgagcatcgggggccacacgttcaaggggatcctgcgcgaccatgggccggcggaagaggcggctgggcagctgccgccgtcgtcaggggagtaccacgagctgacaggagccgcgagggaggggtcatcgccggccgggagcagcgaggcggccggcgggcacggggcgacggtggcgacgtctgcggcggtgctcatggacccctacccgacgccgatcggcgccttcgcagcaggcacccagttcttccctcataaccctagaacctagcttcaattcctgccatgaattccttgcaagtttcatttactgccaaagatggcgaccgagttgcatttatccaagtcgagagcaaacaaaagcaaagccaagc

SEQ ID NO: 75897 - DNA, 759 bp, Triticum aestivum
  Clone ID: PAT_TA_75897
atgttggctagaaagtttgcttcaaaaacattatcaaaagctccctcttcccttctattctcccgcttaaattcaacaactccagcaacaaccagaatggaccctaaaaaacatgcgaataccctattgtcttactttccaggtgactctctagtcgctaaagcgggatccgttctcgtttcctcttccattgctgctttgttgatttcaaaggaaatttacattgttgatatggaattctttgaaatgggctgcatatttggtgcttattacctttggtacaagggcggtaaagaaggatttgctagttatatcagtgaacgcaaagaggccatccgttcagtcttaacctcagctcgtacatctcacttaaatgtagtccaagaacgtatttctcacatcagtaaaatggctaatgttgtcccagtaactgatgcattatacgacatgagtcgtgaaatcgctaccatggaagctgaaatttacgaattgaagcaaaaggttggtatgactcaggaagtcaaaggtgttttggacagctgggttagatacgaaaacagcttgagggaaaaggaacaaagcgatttggtcaagaaagttatggaaggagtttctagtcagatgaaggatcctaagatgtataatgaaattatggctcaaactcttgttgatgtcggaaagattgcgaaatccgcttaggatcatcttagatgaaataaagaggaaatatatttcccgttaaaaaaaaaaaaaaaaaaa

SEQ ID NO: 75898 - DNA, 438 bp, Triticum aestivum
  Clone ID: PAT_TA_75898
attcggacgaggcaccacacacgcacacctccggcccagataaagaacagctgccggccggccggcgtgccatggccatgtgacccagcatgcttgcggcggcgccggtgcattcgctgggacggatctgaggcggtggccgatcgatctgttccgcagtaccgccgggcaactccgagacgacaccacctctgcatgctgtcgagtcctgcagattcaggcatgcatgcagatgcaggagctagcaggtgcatgcatggctgctgctccagctagctgatttttcagtcccctacagggcaatttcgaacctttggcaaatgtcttcgacatcaacacaagcagtttctttcatggccggttggatcgactagctagttacttaggctatactacagatgaggattaattgatgtgtggaataaaaatactgtgagt

SEQ ID NO: 75899 - DNA, 639 bp, Triticum aestivum
  unsure (1)..(639): unsure at all n locations
  Clone ID: PAT_TA_75899
gattcggacgaggcgcgcttgttagctctccgctagctacctgctgcctgcctatacatacccgacgccaccgtcacacgcgcacgcatacacctaccggcccaagaaaagctcctctggccctcctctatctagccggcgaacaggagatcgatcggcgcatgcagggcgtcggtgaccagggaggaggcatggagatgagcttcgggggtgggggcggccgcggggagtgctcgtcgtcgtccgcggcnggcggtggcggtcgcggcggcgtcggcggccgaggcggaggagcggcagctgctcaagggggagatggcggtgcacccgctttgcgagcagctggtggcggcgcacgtcgggtgcctgcgcgtggccacccccatcgaccacctcccgctcatcgacgcgcagctcgcgcagtccagcggcctcctccactcctactccgcccaccaccgccccttcctctccccgcacgacaagcaggagctcgactccttcctcgcgcagtacctgatgctgctgtgctcgttcagggagcagctgcagcagcacgtccgggtgcacgccgtggaggccgtcatggcgtgccgggagatcgagcagtccctgcaggacctgactggtgcgtctttg

SEQ ID NO: 75900 - DNA, 656 bp, Triticum aestivum
  Clone ID: PAT_TA_75900
gctccacagagccgcatggatacatgcaggccggaatgtgtgcttatttacgtacgcacgtagcgtttgtagacgtataaatattcaaaccacacacacataaagacacgcacgtacgtacacatgcatgatcacattcacacgtacgtactacttggcttcggcgccaagggtaaggaacgcgaacgggcgctcgccgttgaagttgcccggggggttgtagttgcaggtgatgaagacgccccggttcccggcgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctggagcaggcaatcgccggcgcgctgcgccgcccagtcctgcgcaaacctcgccacgttgttgtcccacgccacagggccgacgccgtccacggcgcgggcgcggttgtgcagattgacgaagtcctgcgggggtgttctgtgccgagacgtcagccaccacggccatgactatggccagtgcgaacattgcaaga

SEQ ID NO: 75901 - DNA, 497 bp, Triticum aestivum
  Clone ID: PAT_TA_75901
ttcggcacgaggcagctcctcatggcggcgctctacgccctgtcgccagcggatgccgtccagcccaccagcgtcgtctccacggcgcccttctactcgtggtaccctgccgtgacggacttcctccggtccgggctgttccgctgggccggcgacgcaaactcgttcgttggcgacgcctacatcgagctggtgtgctccccgaacaaccccgacggcgccatccgcgacgccctgctgggctccggtggcgccgggaaggcggtccatgaccttgcctactactggccgcagtacaccccaatcactcgacgggccgaccatgacatcatgctcttcaccatgtccaagagcaccgggcacgccggcacgaggatcgggtgggcattggtgaaggaccgggaggtggcgcggaggatgaccaagttcgtggagctcaacaccgtcagcgtgtcgaaggactcgcagctgcgcgccgccagggtgctcagggcggt

SEQ ID NO: 75902 - DNA, 640 bp, Triticum aestivum
  Clone ID: PAT_TA_75902
gattcggacgaggaacggcgaaaacagcatttcctcatcttgagcaatatgatgccgatttgattctcggttgcaatggattcatctgggtcggcgagcatgtcgcggtggatgaagggactaatttgaatgaagatcaacataagttgagcatggaagtggaggcttttaccccactagaaactagaaggcacatttgccggcttgccaatgccgtgcgcgtgctttcagcccttggattcactctgaccgtcgaactgataatccagaccgctgaagcaagtctatcatcacacgtcgagataagcgacatgctcggagctgaattttatgtccagacagcggagagagaggccaagcgtcgagccgatctctcgagaaggatgaatgggccaaggtaaaatgcagtttggtcctgcctgcctgattatttgtagagtaacagtacctgacctgtacgatattatctgtaaaggaaaatagagccaatcaagaactgttttgagatgtagacgcttgctcaaccctgtcgcgtccatgtagttagtggtagcagtatcaaaatatagctgctatcgacggagattttgtatactctgttatgtaggccactgttcactttcaaaaaaaaaaaaaaaaa

SEQ ID NO: 75903 - DNA, 730 bp, Triticum aestivum
  Clone ID: PAT_TA_75903
actcattggtggacactgcttcacgaagaggcttccgactggcgagaggaggcgggtcagcattgcaagagagcttgtgatgaggccacatgttttgttcatcgatgagcctttgtatcaccttgacagtgtttctgcactactcttgatggtaacactgaagaaacttgccagcactgggtgcacagtcatcttcacaatgtatcaaagcagcacggaggtttttggactttttgatcggatttgcttgctttcaaatgggaataccctcttctttggggaaacattggcttgcctgcagcacttctcaaatgctgggtttccatgtccaatcatgcaaagtccatctgaccacttcttgagggcaatcaataccgactttgacagaatcatagccatgtgcaagaatctgcaggatgatcaaggggatttctcatctgtgagcatggacactgctgtggcgatccggacactagaagcaacgtacaaatcatcggctgaagctgcctctgttgaatcgatgattgcaaaattgattgagaaggaaggtccttacttgaaaagtaaaggcagagccagggatgcagcgagaattggaattctcacttggagatcattgctaattatgtcaagagactggaagtacttctggagcaggcttgtcttgtatatgcttcttgctctctcaatcggcaccatatttatcgacatcggtcattcactgtcatct

SEQ ID NO: 75904 - DNA, 716 bp, Triticum aestivum
  Clone ID: PAT_TA_75904
gagggcggcgcgtagaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacaccaagggtcgcttccgccttcactctgtcagggatgaggatgctaagttcaagctctgcaaggtcaggtctgtccagttcggccagaagggcatcccctacctgaacacctatgatggccgcaccatccgctacccagacccactcatcaaggccaatgacaccatcaagctcgacctggagaccaacaagattgttgacttcatcaagtttgacgtcggcaatgtggtcatggttactggtgggcgcaacactgggcgtgttggtgtgatcaagaacagggagaagcataagggaaccttcgagaccatccacgt

SEQ ID NO: 75905 - DNA, 633 bp, Triticum aestivum
  Clone ID: PAT_TA_75905
tttttttttttttttttaaagtaaagatgtttgcatggacgcatatatgattacatttacacgctccacagagccgcatggatacatgcaggccggaatgtgtgcttatttacgtacgcacgtagcgtttgtagacgtataaatattcaaaccacacacacataaagacacgcacgtacgtacacatgcatgatcacattcacacgtacgtactacttggcttcggcgccaagggtaaggaacgcgaacgggcgctcgccgttgaagttgcccggggggttgtagttgcaggtgatgaagacgccccggttcccggcgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctggagcaggcaatcgccggcgcgctgcgccgcccagtcctgcgcaaacctcgccacgttgttgtcccacgccacagggccgacgccgtccacggcgcgggcgcggttgtgc

SEQ ID NO: 75906 - DNA, 815 bp, Triticum aestivum
  Clone ID: PAT_TA_75906
tcggcacgaggattccgattaccatgacattcaattgaattggattacatttacaacgagtgaaaaccaacaagatgtagaaaatgcagcacgaacactaaaggctcacgaagagaattatttagtaaaagcagcttcaaaggtatttaatttccagaaactactttactgtgaatcgacggaggcactgagacctggtgcatttcatgcattaactgattaccacttacatactgctgtctcagcagaagtatcattacatcaatatgtggtatcgatgagcgcaatggctgcgagaggagcgacaacgtacaatcatttgtttgaacttttcgtcattttggaaaatttctcagaacgttatcataattcccttcctgctctttccactactcgaacacaaatgatacaaattataagcgaagcaagatcagagatgtggcaaacgagcgtttcatttcatccaaaagcatttaatctttacaaaacatatcaacctgatgctcctaaactcgattattctgaatcttctttgtcagaagaacctgcgcctaatggatgggcaattgttcaaaaagaaacaaagttagcgttggatcacagtcttggccttgatagaggtttatccggaggacttctcgaaataccaaacggtgctccggtttacatcgaattcgaatttatccaaaataataaacatcaaatttggcaacttcaccgtgctaagagaactggtgcaaataatgaaccttttctctccattcgttcttcacttgatacaaactatgaatttggtatgtttacttttcgatggc

SEQ ID NO: 75907 - DNA, 826 bp, Triticum aestivum
  Clone ID: PAT_TA_75907
gagggttcttatgccataggcgagcttcgtaatgattatatacggccaccatcattggagacccccacaaaaattgcaggaaatcatcggtttgacccatattttaaggattgtattggagctatcgatggtacacatgtgcgagcaggtgttaccaaagatgtggagcattcttttcgtggtaggaaggcctttacaacccaaaatgtgatggcagcggtagattttgatctccgcttcacgtatgtattggctggttgggaagggtcagcacacgatgcaaccgttttagctgatgcgttaacgcgtgagagaggcttacaagtaccaccagggaagttctacctagttgatggcggttatggagccaagcccgggttcttaccaccttttcgtggtgtgaggtaccatttgaatgagtggggcaacaatccagtccaaaatgataaggagctattcaaccttaggcactcttcactacgggtgacggtagagagggcttttggatctctcaagaggcgtttcaaaattttagatgatgccaaaccattctttactttcccaacacaagttgacattgttatagcttgttgtgttcttcacaattatgcactatcacaagggattgatgaatttattatacctgaagtgacatggaccacccaaccaattagaacatcaaggcaacaagcaagtgacactagggccgtggtagaccgtaggctacaaatggcagcccaaatgtgggaagatagacaactcatgtatgctaatctatgagtgtggcacactccatgtatttgtatcatttactatatttgaacca

SEQ ID NO: 75908 - DNA, 729 bp, Triticum aestivum
  Clone ID: PAT_TA_75908
gaggctctcctcaccttctcctcgcttcccggtctgaagcgaagggattgacgcggccgccggggatgactccagttcatcgtcgatgggagcaggggagcagcagccgcctccctctcggcctccccgtctcgtcggagccgccgctctcggggtccttcccagccatccgaggatctcccatcccatcccgagccggatttcagtgataggggaggagagaatcgacgatgcatcaaggcgcccgccacctcttttgcagcacagcacaacggcctctgcagaagctaagcggcagttgcctcgtctccttttcaatcgcaacccctgcgacctttaatctcaatagcagagccctcagttgttagggaaggtgtgctcttgcttgtgatggttggccacatcccagcagtgtgtgggagccgctgttttcagccagagttgggtctccttgccattcatcaccagcctgtctgcaggtatggtagctcctactcttctatttgatactgatgaaaaaggagaggcacaagatgaaaaaggagaggtccaaatcttcagacctttgcttccgtagtttcactgaactgaacttctctaaaatataccccaaccagagcttagtcttagatattttgtttgtaatttaaatttgctcagagtgattactccaccattacaatgatgtttatagtgacaaaatgattgtatatgtatgattgattgata

SEQ ID NO: 75909 - DNA, 677 bp, Triticum aestivum
  Clone ID: PAT_TA_75909
attcggcacgagggaagctttctgatcccttctccaagaaggaatggtaccacgtactagcccccgctcctttccctaagaccgctctcggccgcactgatgtgaccaagaccactggtcaacgtcttgcccgtgactccttgttgggccgcgtgttcgaggcttctttgggtgatctcaaggatcatgctgaggacgaggccttccgcaagttcaagctgaaagtcgaggatgtgcaaggcaacgtgtgcttgaccaacttccacggcagtgagccttaccactgacaagctccgctctttggttcgcaagtggcactctctgattgaatgctactctgacgtcaagaccactgatggttatatcctccgcttgttcgacattggcttcaccaagggacgccccaaccacaacaagaagaccagctatgcccaaactgcccaggtcaagcagatccgcaataacatgatctagatcgtcgaacgctaggctgccaatgtcgaattgaaggatttggatggcaaactgattcctgagatcatcggcaaggaaatcgagaatgccactcaaggcatctatcctttgcaaaacgtgttcatccgcaaggtcaaagttctccgctcccccaagtatgacatgtccaagctgatggagcttcacggaggtgccgctgccct

SEQ ID NO: 75910 - DNA, 407 bp, Triticum aestivum
  Clone ID: PAT_TA_75910
catttcatgtttactttatttgtgtttcttcctaccaggagagtgtggatgatgacaaagcaattgtttgtgctgagcctaatcataccacggtcaaaatggactctgggatgagtccggaacaagaacagaaaccagaactgcgcccagcgaccgaaggcgacagcatggctgattcatgacaagtgtatataaattgagacataggtttttgtcagatatttcctgactttagaaatgatgtataaggcaacaaaactaacaaaagcatgcatcgacatgccacatttatcccctccatgtatttatattacattacaaattgtatacccaacagttctgcaatgcagagaattcagcaatgcaatgcaatccatcacatcatcatcaaaaaaaaaaaaaaaaaa

SEQ ID NO: 75911 - DNA, 701 bp, Triticum aestivum
  Clone ID: PAT_TA_75911
gaattcggcacgagggcccggtccagcccggcctcgccgctcgactacagcgccggctccgcctccctccgctccggcgcgtccaccagcggcggcgaggacggcgccttctgctcgccgtggcaccgccgcgcggccaccgcgccggcgacggcgacgacgaagacgacgacgaaggtgggctccatccgacggccgcagttgaccttccaggccccgcctccgcggcccgccggtcagaggcaacggaagaaaatgaggctgccggaggtccagcagctggtgcggtcgctcgccgtggagaacgagagcctgcacgagcagaagggaaagcagcagcagcagcttgatcagcagcagcagcagtccccacatgacagcttcgcgctaccagatctcaaccttcctgcgcaggacggtgctgatgggtcagccccttgttgagcgctccagaccgccgcggcttcgctaaccgaataacaaagtgtacatagaggtagcaggcttagctagacgagtaggggcacgggacgggagtgtcatccaaagaaaaagaatggcacagatttcataagtttttagaatttttactgggtcaggtcaggtgtcaccatcctgagtgacaaggtcaggttgtagctaaacaaaatgactaatttagctcatctgctaattgtttcttacctacctactagttcttc

SEQ ID NO: 75912 - DNA, 716 bp, Triticum aestivum
  Clone ID: PAT_TA_75912
ttttttttttttttttttttgatatcgaacaaataaatattgctcaaaaaacaaccgcagcgcctattgacaactcactgtatcatacgtgttgttatccatcccattctatctatcctatcatcacatcctcatcacatgttataatatttatttcttggtccatggtttagtagtatagtattcatccaagacacgtggcacattatattctttaatgagattgacagaagtaggattggataagaatgcaatggatttttcaagccagttttgttgttgagcagagggagctttagcaaattgttgtcggacatatgtgatggctccttccttaatcttggtagcagcatttaatttttcttcttcttctcttcgttcaacagcttctaattttttaacaattgcatcacgtgcagcatgacgtaatgataaattacgataggttaccatggctttggcggcagcattatattcagcaacaccgtcacgaatgatagcgggaatttgtacttgagcaatcattttacgaagtaaaagagcttgagattccacaagaagatgaccaaaatcattttgatatttgacttcttgtgcatgttgttcacgtaatgcttggaatacagaatccccagcggccacatatgccatccctgtccataatacaaaattaacaccatgtacaaagtgtggatcaataacaactaattctttgg

SEQ ID NO: 75913 - DNA, 773 bp, Triticum aestivum
  Clone ID: PAT_TA_75913
tcggcacgaggatttgatagcatgtacttggtgtggatttttttgatgttgctttacacaaggttcatatgcatggtcaatagcaggtcttacctagtgcgcagagaactgaaatataaaggaggatctagaacttgtcatcttgtatggagaacaaggaatagtatagtacagttctgcttcagcttttcacaaggagagtaggattctagatgcatcgtttgtaagtctactctatctagtttagaagaaataaaaaagaatcattatatttttctattgatgttgctttacacaagttgcatatacattggtcaatagtagttcttccctagtgctcagagaactgaaatatatatcagaccaacggttcatatgcattgatgttgtttctttttcagttctcctaggcttttattgtatgcaggtgctctgacattagaagtgttttgctttatccgaagacattgtgtttagttgttggatgcctttcggtaattaggttattgggaaggtttcactcagagcaagaaaggtatgtggctaccttgcctcttttttagatagaggtctttactttctgcactaataaatccatgtttgtcttctccttaattttccaattatacattttctccccagttttactaatttcggaattatattgtattgtggagattgacaatggtttaatgatctaccgcttatcatctttgtccttagttatttagtaattattacggaaatttatgccacagtacccatacatagta

SEQ ID NO: 75914 - DNA, 830 bp, Triticum aestivum
  Clone ID: PAT_TA_75914
ttcggcacgagggcaacctgctcctgctgggctttggcagccatggctggaggagccggcggcggcggggcggcggagataacgctggagcgcacgccgacgtggatcgtcgcgtccgtgtgctccgtcatcgtcctcatctccctgttcttcgagcgcctgctccaccgcctcggcaagaggctcacaaaaggccgaaggaagccgctgtacgaggccctgctcaaggtcaaagaagagctgatgctgctggggttcatctccctgctgctcaccgtgttccagggagccacgcagaagatatgcgtccgggagagcctgatgcagcacctcctgccgtgcccgcgcaacggcgccggtgccgccaagagcgtgcagcattatgccgcgggcgccaccgtgttcaccggtgtggtgggcagcacgaggagactcctggcaggtggaggcgcctccagtgactattgcctcaataagggcaaagttccaattctttcgatccaagctatccatcagttacacatatttatcttcgtcttagcggctacccatgtgattcttagtgctattacaattattcttggaatcacacagacaagaaaatggaaacactgggaggacaagatccagcaaagcgacgataatggtcctcaaatggtcagacatgtgcaagaattcaaatttatcaaaaaacactttaaaggtcatggaagacgatgggaaatattcggttggctgcgttctttcttcaaacaattctacggatcagtcaccgaagaggactacacaaccctgcgacttggcttcgtcatgaaacacagcaaggggca

SEQ ID NO: 75915 - DNA, 628 bp, Triticum aestivum
  Clone ID: PAT_TA_75915
ggcgtgctggcctcgcccgactccttccttcggcgcccgcgcctttggctcgagctcatctccgagttcaaggcgacgtgcacgcccgttccgtcgttcacgttgccgctcgtgctccgccgtggcggcgggcgctcggcgtcggcgcacggactgcagcggccggtgcagctcggcagcctccggaacctgatcctgataaacgagccgatctacaaggcgtgcgtcgacgagttcgtcgcagagttcggcctccacgggctgcggtccgagtcggtctctccgtcgtacggcctcgccgagaactgcacgttcgtgtccacggcgtggcggagcaccagcgggcgcgtggaccgcctcccgtcgttcaagaagcttctgccgtcggcgaggctgccatcgtccagggcgcacgaggcgtcggagatcgaaatcgtcgtggtggacgagaagaccggtgagccggtgagggacggcacggagggggaggtctgggtctcctcgccgagcaacgcgtcggggtacctaggccacccgtcggcgagccacgaggcattctgcgggaggatgccggggagggcggggtcgcgcttcgtgcgcacgggcgaccgcggcgtggtcaccgggc

SEQ ID NO: 75916 - DNA, 525 bp, Triticum aestivum
  Clone ID: PAT_TA_75916
aacggcaaaacatatggatctcagcaagaactgcgaccatggcctcgcggagatcgaggcgctgctccggcgggagcaggagctcgtgacgcaactccgggcgctcatccttccacaactccacaacgtggatagcgggtcggccgagctcgccgtccagctcttcgacgacgtgatcggctgcagcaccagcgtcgtatctaagctcttcactgctggaagtggagcgaccaccgagctcatcgacgacaagtccttagtgaggaagaacagcactagtactgctgctgctatcgacgacaagatggacgaacaggcgaggcctagttgcgtcgttggtcgaaagagaaggaggaacgatagcaagcgatcaagatcactcgtgaccaatgttccacattatgatggtcaccagtggagaaaatatgggcagaagaacatcaacggaaggcaacatgctaggagctactacagatgcacctacacagaacggaactgctcagcaactaagacagttcagcaaca

SEQ ID NO: 75917 - DNA, 300 bp, Triticum aestivum
  Clone ID: PAT_TA_75917
ttcggcacgaggcattctgtcacacctttgcaggacatctatggggtgcatgactcgccatgtctgacgagggatttctatttattgccaaatgcatcaagagcactggcaccaatctatgtgcagctgcttacatccaggaatgtaaccttggacagtatttgtgcaacatcttccactacgcagtcgctaatctcactcctcgaaatctctaaagtattgagagattgcgcacttgcaaaaataaacatggttgggtcaaaaaaaaaaaaaaaaaaaaaaaaaaaaaaaaaaaaaaaa

SEQ ID NO: 75918 - DNA, 743 bp, Triticum aestivum
  Clone ID: PAT_TA_75918
cggcacgagggtcacttcggccatggccgagtacgcgcttgcattatcaactcctgaaggttaccaaggctacgggccagagcaaggccagaagagtctgaggaaggccatcgctgacgtagtgtacccaagcatggggatacgagacaccgaggtgttcatctccgacggagcgcagtgcgacatcgcacgcctccagatgatgttcgggcgagacgtgaccatcgccgtgcaggaccccaccttcccggggtacgtggacaacggcgtgatcatggggcagacggggccggcggcggacgaggagtccggcggcagcaggtacgccgggatcgagtacatgcggtgcgcgccggagaacgccttcttcccggacctgtcgcgcgtccgccgcaccgacgtcatcttcttctgctcgcccaacaaccccacgggccacgccgcgtcgcgcgaccagctgcggcagctcgtggacttcgcgcgccgcaacggctccatcgtcgtcttcgactccgcctacgcctcctacgtctcccccggcggcggcgacgacaagccccggtccatctacgaggtgcccggcgcgcgggaggtggccatcgagatctcctccttctccaagttcgccgggttcacgggcgtgcggctgggctgggccgtcgtccccgacgagctgctctacgccgacggcacccgcgtggcccgggacttcgaccgcgtggtcaccacctgcttcaacggcg

SEQ ID NO: 75919 - DNA, 769 bp, Triticum aestivum
  Clone ID: PAT_TA_75919
tggtcttacctcgcaagcaacaagagaattaactttccctatagatgaccatggtactgttaagacagtattgaagtactttcaggagacgtatggatttaacattcagcacaccactttaccttgcttgcaagtgggtaaccaacagagaccaaattttcttccgatggaggtatgtaagattgtcgagggacagcgttactcgaaacgactgaatgagaagcagataactgctcttcttaaagtgacctgccagcatccccaacagcgggagctggacattttgcagacggtgaatcacaacgcataccatgaggatccatatgcgcgtgagtttggtataaggattgatgaacgtcttgcatcagttgaagctcgagtcctacctccccctagacttaagtaccacgatagtggcagagagaaggatgtcttgccaagaattggcctgtggaatatgaggaataagaaaatggtcaatggtgggagagttaaggagtggatatgcattaactttgctcggaatgtccaagatggtgcagcgaggagtttctgtcgtcagctggctgacatgtgcgaaatatctggaatggacttctcaaaggaacctctgcttcctcctttatgtacgagacctgagcatgtagaaagagcactcaaggcacactatcaagatgctatgagtgctctgaaaccactgggcagggaacttgaccttctcattgcaattttacctgacaataatggttctctttatggtaatctcaaa

SEQ ID NO: 75920 - DNA, 422 bp, Triticum aestivum
  Clone ID: PAT_TA_75920
gatacttgacaaagcttgacatccactcaaaccagttgatcaatctgcctgatacatttggggaactatctagcttaattgatcttgatttgcacgcaaaccagctgaagtctcttccggcatcatttggaaatctcacaagcctagcaaaccttgacctgagctcgaatcagttcaagatactgccagactgtataggaaaattaatgaacttgagaagattaatagctgagacgaatgagcttgaggagctaccctatactatagggtcttgcatatctcttgtggaacttagattggacttcaatcagttaaaagcccttccagaaggtattgggaagttggaaaagctagaaattctcacattgcactacaacagaatcaaaggcctgcctacaacaattggttcgcttaccagactg

SEQ ID NO: 75921 - DNA, 297 bp, Triticum aestivum
  Clone ID: PAT_TA_75921
tcggcacgagggcccccgcatttccgctggccgccgctccgcaggagacacgagctgcacgcctcctctgacacctgggaatgactggctgtagaagtgcccaagcctgtggagatcagctataccagccttgttggaattgcctggaaagctggattacaggcctgtgtccacgttaaaatcatcatttggaggtgttctgtggatatctagcaatggaaggatcattggttatgcttgagaagtgatcaatggtttcgtacatagtattgactaagtcagtggccaaacatgtgc

SEQ ID NO: 75922 - DNA, 537 bp, Triticum aestivum
  Clone ID: PAT_TA_75922
gaggaagcaacgttagcctcaactttcacgcacgccatggccatgatgaagatgacgcacgacgactacgtccacctgtgcctcatggcgctcgcctccgtggcgaccggcggcgaccaagcacaggcagcgaaggggcagtggctgcagaccgtgactgcggcggcgccagcagccagcgagctcaggttccggtgctccgtctgcggcaaggcgttcccgtctcaccaggcgctcggcgggcacaaggccagccaccggaaacgggcggcgctcgtgctgccgctacaaagcgtttcgccggcggaggagacggtggcatcgtcgacgtcgtctggcgtcggcgggcacaggtgctccgtgtgccaccggagcttcgcgacggggcaggcgctcggcgggcacaagaggtgccattactgggacgggctgtcggtctcgctgacggcgtccgcgtcgcgttccggctccgggtcgtccgtgagggatttcgacctcaacctgacgccggtgccggagaaggccgtcggaggcatg

SEQ ID NO: 75923 - DNA, 693 bp, Triticum aestivum
  Clone ID: PAT_TA_75923
tcggcacgaggctcacaccacaccacaccatccaccaccatggccccaatgcctccattctccgcgaccacgcctgagagcctcctgcagggcgcgactgccgctggtactgcgcctgccaagacgatcctggtcactggcgctgctggcttcattggcttccacacgtgcgtggcgctgctcaaccgcggcgacaatgtcgtgatcattgacgagatgaacgactactacgacgtcaagatcaagcagtcgaacctcgactacctcaccaacacgtactcgtccgagcgcgtcaagatctacattggcgacctgtgtgacgagcagcttgtgcgccgcgcgatgaaggagaccagcccgacctcgatgatccacctcgccgcgcgtgcgggtgtgcgtccgagcattgacaacccactgctctacatccactcgaacgtgaccgccacgaccgtgctgctggaggcctgtcgccacttcggcatcacgcgcttcgtgtacgcgtcgagcagctccgtgtacggcggcagcgacaagaccttcttcagcgagaaggacgtcgtcgacttcccagtcagcccgtacgccgccaccaagaaagacgtgtgagctgctcgcccacacgtaccaccacctgtacaagatcgagtgcttcggccttcgcttcttcacggtgtacggtcctcgtggccg

SEQ ID NO: 75924 - DNA, 585 bp, Triticum aestivum
  unsure (1)..(585): unsure at all n locations
  Clone ID: PAT_TA_75924
gaggagaactcgcgaggaagcacttcatccaccacgtcttcagggagaacgacttcgaggatggcgcccagagcctgtaccgcttcctggagcacgacccggccgtccccaggtactacaacttcaggggctccaccaacgacggcgagcccaagcccgccgccgccgtcggccagaggatgaccaagatcatggtcgccatactcgaggcctacgcctccgaggaccgccgccgcgtcgactacgcccgcgtcgccgccagcgaggagttccggaggtacgccaacctggcgcggacctgcancgggcggacgtcttcgccctgcccgccggggagcgcctctccttcttcctcaacctgcacaacgccatggccatccacgccgtcatcaggaccggccagcctggcgggcgcgggcgccgtcgaccgccgctccttcttcaccgacttccagtacgtcgtcggcgggtacccctactccctcacgaccatcaagaacggcatcctccgcggcaaccgcaggcagccctacaccatcgtcaagccgttcggcgcctccgataagaggctcgagctggcggaga

SEQ ID NO: 75925 - DNA, 618 bp, Triticum aestivum
  Clone ID: PAT_TA_75925
ccttgttagggaacagtgagatttactggtggaaaaaaccttaaaccatgataaggaaggccagacatctgcggaaactggtgccaccagagggctaaatgatgtatatgcagaaataattgcaaagaataatagggtgggtaatgtacttcattctggagctgaagttatcaccgatgattacaatgatcataccacatgttctaaagatatgcatgcttcattctcagaagcatgcgctagcatgcatcacttgcctcaaaatgctgaatctatttctgctctgacgtctgatgaaagcatatctttccttgtaaatcttgaagagaactgcataaaagcagatagtgaatattcgacaataagagacacagcgttacaagggaaaaagacaggcggcaaaactgaagaaggagatggcaaagacaaaatgtcgagtgtaaatttgaaggatcagcgatcttttggagaggatagtgcatcaaagtttgttcagaaatcaagaaaagagacctctgatgcccagagaattgaagggagagatgatataagaaaggcagaaagtgaaattgaaaaggatgtctccctaagaccagataaagataaagaaagggaata

SEQ ID NO: 75926 - DNA, 661 bp, Triticum aestivum
  Clone ID: PAT_TA_75926
cacgctccagcacctctcaacctcaagtcagcgccaccaccaacaacaccacgagaacacacatgaccttcagcgtctcgccggcgatggcgggggggcaggggcacgagtacatgatccgcttccacagccacttcgacgacccgtcgccgagcaccgccaccgccgagccgccgccgtttgccggaagggcgatctcgccggagcaggagcacggcgccatggtcgccgcgctgctgcacgtcatctccgggtacaccacgccgccgccggacttcttcttcccggccgccgcgagcaaggaggtgtgcccggtgtgcagggtcgacggctgcctcggctgcgagttcttcggcgcggcggaggccaccggggcgaccgcagcggcattggacgcgccgaagtcggcaccggcggcggtgaccgcgggcgggccgcagcggaggcggaggaataagaagaacaagtaccggggcgtcaggcagcggccgtggggcaagtgggcggcggagatccgcgacccgcgccgcgcccgtgcgggtgtggctcgggaccttcgacaccgccgaggacgccgccagggcctacgaccgcgccgccgtcgagttccgcggcccgcgcgccaagctcaacttccccttccccgagcagcagcagcagc

SEQ ID NO: 75927 - DNA, 305 bp, Triticum aestivum
  Clone ID: PAT_TA_75927
ggcatcccacggtctcttagataaaaaaagatgcagaaactttttttcttctatttattgcatatttacttcattaacgattgaaatagtacttcctctgtttgtttttataaggtctatggtttttcgtatccactgtcagaaattaatgcatgcacatgatttttttcagaaggtttattgctatatttcctttcttggcgacgcttatcacatcttcccacctttataagaatagaactacggactgttcgctcctccatatccaagatatttaaataagaataacatactcatttcttttg

SEQ ID NO: 75928 - DNA, 648 bp, Triticum aestivum
  Clone ID: PAT_TA_75928
attcggcacgaggtgggagattgagcagccgtcaaagcctaaggagatgacttgcttgaggaagaccaatgttcctcctcgattaagtcgcctgaatcatgatacagggtttaacaggctggctgttgccatgccgctcaaatctcacgagttgtttcaatacttgtttgaatcaagccggacactgaggacgacacaaaaggtgcctggtacggaatatctcgcgcgtatgatagataacccatgtggactccgaagtgccatcctcatggccggcatgcatttctctttccaattcggcgacctcgctacattcgagtccaccttcttatatcacaaaattgaggtcatgcgtgtcatcaatcgttggatcgcatcaggagactataaactcgaagctgcgattattagagaaatggccaccttggctttcacagaggcgtgtcatggagagctcgttgctgccgagactcacatcagtggcattctggcgttgattgaaactgcccgacctgataaaagtgacccgactcgttctgattgctgttccactgaccgagaactagctaaccgttatttcgtcatgtcctatgtctacatcaccggcctcaagagcttactgagtggaatctgtcgaactggcggcca

SEQ ID NO: 75929 - DNA, 677 bp, Triticum aestivum
  unsure (1)..(677): unsure at all n locations
  Clone ID: PAT_TA_75929
gattaagctacctatatatagggtgaaaacaactttagtggacctctgccttctgaaatgtttcaatcatcccgtggtttggatgtttcttataacccttatacttaatggaaaccttcctaacaacccccctgatcgcaagtggtcaataaactatatcgggacttcaattgatgcaagcacaacaattaacagtgagaaccttactctcctcaattgtctccacatgaaagaatgcaacaagttcaacactaaaccaataacttcattcgctgtaaactgtggcggcaagcaaaggatttcttcagatccattgccaattacgtttgacgatgacaccagtatccttggggcagcaggctttcatgttaatactgacaggcaatggatagttagccatgtgggttctgatccttttactaactcttctggacccggtaccataagtacaactcaagttattctggggacagacatgcctgatctctatgaaactgcaaggacatcaacaagtgctttgtcgtactatngcggttggtttgttgaatgggaaatatacagttcaactcttcttcgcagagatacttattgatagccagttaaataatgggacaggaaggcgcttgtttaacattgatattcaggatcagaatatcaagagagattttgacattact

SEQ ID NO: 75930 - DNA, 658 bp, Triticum aestivum
  Clone ID: PAT_TA_75930
tcggcacgaggcttatttgagagatgaagtttctcctgtttgcaatggcggcgaatgctgctcgttatttcacccgcgattcccccattgacggacagtacattgttgtattcaagaaacatctcgccaaggatgctatgaccaaccacatggaagtggctaccttgaagagcgtccagatcaaccgccaatactccattggcgagttgttcaacggctatgctgctcgcatgagccaagattctctcaactatttgttggaccagcccgagatcgactacgttgaacaagacgggacggcccatgctactgactacttcaagcccgcggatctgccctccaagaacaacgatgtgtgtgccactcaagatggcgccacttggggcttggtgcgaacctctgaagtagagctcaacatcaacggaaagtacaattatgacaaggacggaagcagcgcctacgcttttgtgctggacaccggaatctacgtcgaacacaacgacttcaacggccgggccagctggggtgccaactttgtggatactgacaacactgatggaaacggtcatggaacgcactgcgccggaaccatcggaggcacgaaagtatgggttggccaagaaatgccgcttgattgctgtcaaagtcttgtctgctg

SEQ ID NO: 75931 - DNA, 672 bp, Triticum aestivum
  Clone ID: PAT_TA_75931
tcggcacgaggtaaaggatgacatattctggaatttctttaagacctgtgtgtttggatctgagagttctgagaattatcctgagttagaatgcattggtagaagaatacttcctaaactgaagggctctcctttggccgccaaaactctgggacgcatgttaagcatggaccttcaagaatcacattggaaatttatacttgagagtgaattgtggcagttaaaagaaaaggagactgagattttgcccgcccttcggttgagctatatgtacttaccattttatttgaagcaatgcttcgcattctgtgctgtgtaccctaaagattacatattccagaagcaacacttagctgaaatttgggtagcagaaggctttgtagagcctcaaggtggtgttccaattcaagatattggttgtcagtattttgaagaccttgtagcacggtccttctttcgaaaagttagtggtggatacgtaatccatgacttgctgcatgacatggcacaacaagtttcagagcacgactgcttcatcttaagaaacgagagtgactttgataaagttccccagaatgtccgtcatctatacgtactccctagcagtgactttgacgattccagcttgttgagactatgcaagtacacaaagctgcgtacactaattttgca

SEQ ID NO: 75932 - DNA, 488 bp, Triticum aestivum
  Clone ID: PAT_TA_75932
attcggcacgagggctccttgtgtcagtagcaacgctagccaattcttgtatttggcattagcttccgcatacatatctgatctaccatgggagctgtgtggccatttctaaaggtatcccgatacccttcagctatgataaacatggccctaactcggacccctccagtgaaatagcaaaggcagtcgacaactttggtgcgacaaccttcacttggcacctcagtaacattaccgatgtctgccaacagtgtgaacatcaaggtcgatactgtggattcagctcacaaaggcgtcaagcattctgccagcaccatggtacccatgtcatcccaattgcggcctcatctgtagctgcatttgtagttctttcattgattgtggccactgtgatatatctctccttgaagtcaaggtacaatgaagagataaatatgaacgttgaaatgtttctcaaggcatatggcacatcgaaacctacaagatac

SEQ ID NO: 75933 - DNA, 765 bp, Triticum aestivum
  Clone ID: PAT_TA_75933
tcggcacgaggctcagagtttcattgccagttcagcagaggaatcagtttgcagccaacagtgaacttacaagttggcattcagaagttaatgacgcgcagctgcagagaacccctgtcttgatcttgatgcctcgacggagagctgcgcagttctgcgacgatcgtttcaaaggtttcccctcctttggatgaaggcacactcttggctcctctgttttcttccccaagggaccgcctgatcctccctccctccccaccgccgcccctttccagcctccgccaccgcctcctgcactcctgtggcattgcttcgccaccatctcttctaccctgtctgctatcgccaaaccttgctgccgccgccatgtcctgatctggcttgccgccgcaaccggtcagctgagctccccaccaccccatcttcctccacctcctctcttagcccttgtaaataaacactagttaggctctcaagcgtgcatcgtgttgtgcatgtatacaaaacacacctttgatcaccaacgcaaatcatgttggatctctcgctctctaaaatatgcctctttacactccttccttccttccaacctccactgctcatcttgcccgatcggtcgacgggatcaagtagcatggacagaacttggcacaccatagatgatgatgacggactcggaaaatcatgcgcgcttttctgtagtgttgaccagtacaagaattcttccctagtgtaaacttacttactccctccgttcggaattac

SEQ ID NO: 75934 - DNA, 608 bp, Triticum aestivum
  Clone ID: PAT_TA_75934
tcggcacgaggacttatttgagcttcccagcacctagcgctcaatcatggcaacaagacgagaacctcttgctcgcctcagccttcagccagggactcgtcctcccagcaatgttccagccctgaagccggtcgagggtcgcccgagtctctctggcaagcgagagtcacttgttggtaccaagcgtgaatctcttgccggccgcccttccatctcatcttactcccgtcaatcattgagtggagcccccgctcgactgagcctggctccagcggcgccaagtcgactcagcctgggaggcaatccgcccaaccgccgcacttccttggcagtgattaacaaggcaaccgaccctcgacccattggaaagaaggaatacacgacgcaatgtgtaaaaactattttggcatttttgactgcccgcaattacgaccaagcatgcacttccaaaaacctcttgtcaccgacccgcgcggacttcaagagcattgtgaccttcatctttcggcagctcgaccccaacttcgacttcggttccaacatggaagacgagtttcgatgctacatgaaattctttggctacccaatcgccatcagcaaaaccgccc

SEQ ID NO: 75935 - DNA, 665 bp, Triticum aestivum
  unsure (1)..(665): unsure at all n locations
  Clone ID: PAT_TA_75935
tcggcacgaggggagaaggagggcatggatctggttaaaaaaatatccagttcatgttgcatctttgctaaatttgggaatatatgaactgccgttttatttcaaactgacttccaaatttgggaatatagggccttgaaacagcagctcggattaatgttttatcttgttagtctaacataacagtatagagctcaaattaaagcctgcatttccaataccaatctagcatggttccctggactaacttataataatgaaagaaatctaacacattgttttcttgatgaagtaagcaatcatttattttattttttctcaaattaccatgtcactttcttgccactttgccagctattgccgagatatgcattggacctggtcctggcatgtttcatgtgccttctgtttagtattgataatcaccacacgtaacatgtatctgtcgcagacgtgtgagctatctgcacgctttacagttatgcaatgcacgtcgcgttatgattccattgctattgtgattatttgcttaagctgaaaagcatngtgcactgggagtgtccaattgcttgtgctgcgtgctgacgatggaatttttcccctcagtttctaaccatcaaatggtttctttgcagtggccatcttgagaactataccagtgacta

SEQ ID NO: 75936 - DNA, 609 bp, Triticum aestivum
  unsure (1)..(609): unsure at all n locations
  Clone ID: PAT_TA_75936
attcggcacgaggcggggaacaagagaggagtgtgtggtgaagctggagatgcagcaacaggcggtacaagtgcaagcaagagaggacgtgggagaccaagaaaggaggagaggcgagatggtgcggtgtcagggatggagagagggcgtgggaggccaagaaaggagaaggcagaagaagaagcaggaatggatatgctagcagcagcagcggcggcaatgttggccgagagtgggtggagatgatggtgtggcaacagcaacagggggaagctagtcgtcgtagtaaacaacaagaggaggagcactaggcctagggttgaagaagaagaagaagaagaagaagaagaagaagctggatgtggaactgaaactaatctgggctctgctcgttcgtaccttaactgtgtatcaaagttgcaaactactgtaggtagtaatttgtttgtctgaatgcacctgcacctgcacctgcttttgcttgcttatgttccagcacatggnagtggagtagtgctttattttattatattcagatcagatagttgtattcttggattgaaattcagctaaatttttttttgagttaaaaaaaaaaaaaaaaaaaaa

SEQ ID NO: 75937 - DNA, 570 bp, Triticum aestivum
  Clone ID: PAT_TA_75937
tcggcacgaggggcgcccccgccccagccgcctggtcctccggcctcttcgactgcttcgacgactgcggcctctgttgcctgacgtgctggtgcccttgcatcacgtttggcaaggtggcggagatcgtggacaggggctcgacgtcgtgcggcaccagcggggcgctctacgcgctgctggggtcgctcacggggtgccactggatctactcctgcacgtacaggtccaagatgcgcgcccagtacgcgctcccggacgagccctgctgcgactgctgcgtccacttctgctgcgagacctgcggcctcatccagcagtacaaggagctcaaggcccgtggctacgaccccgacattggctggcacctcaacgtcgagcgcggcaacggcggcgccgggtggttggcggcgtcaacccgcccggcatgcaggagatgggccgctagatcgtcaaactctgccgcacgtgtggggtggaggatcgctcgagcaagtgttccaggtgcttggtaagttattgcatagtagtacgtacttgtagctttgttaagttccgaatgcatgtggt

SEQ ID NO: 75938 - DNA, 524 bp, Triticum aestivum
  Clone ID: PAT_TA_75938
tcggcacgaggaagtcaacctcaccgaggagaagcagagagaagggagaagatgtcggggcgcggtaagggaggaaaggggctcggcaagggcggggccaagcgccaccggaaggtgctccgggacaacatccagggcatcaccaagccggcgatccgtcgtctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcactgccatggacgtcgtctacgcgctcaagcgccagggccgcaccctctacggcttcggcggctaggccaccgccagattagctagcctgtgtctagggttcgttgtccatgatgtaattgcagcatctcgctgttgtttgctatcttctgtagaatcgaatggaatggaaattgaactagtttatcattggaatctgttgcgtccgtcaaaaaaaaaaaaaaaaaa

SEQ ID NO: 75939 - DNA, 576 bp, Triticum aestivum
  Clone ID: PAT_TA_75939
gaaaaaatcgtcaggactattttcactttggtgacgtcattaccttcgacacaacatacaagaccaatttgtataacatgccgtttgccctgtttgtcggggtaaacaaccacttccagtctgttatattcggtggtgcactaatgcgagaggaaactgaagctgcttttaattggctgtttaagacttttgtggctctgatgaatgacaagcatcccgtgacgatcctaacagatcaagctttagctatgaaaggtgcgattgagagtgctctccctaacactaaacacagatggtgtaaatggcatgtcctccgggacgttaaaggaaatattgtccatgtgtacaacaagtcttctgggttcaagaaggaattcaacaagctagtcaatgatgtgatgtgtgtcgatgagttcgaatccaaatggttgtccctcgtgaacaggttcaatgtcagtatatggtcagactatatgataagagggtcatgtgggcaaagccgtatttcaaggggaattttttgtgctggaatgacaagcacacagcatagcgagagtgctaatcatatgctgaaac

SEQ ID NO: 75940 - DNA, 569 bp, Triticum aestivum
  Clone ID: PAT_TA_75940
tttttttttttttttttagattaagaatcgtgcttgaatcgtccaacagctatcggctgtgaagtagtttcgattacagaacatgaatatgataacaaagtgacactcgtcttagaaaaaaaatgcttatttatcagtttgagacaacttctccccagaagtacgctcattgtggcagacgcagcaaaccacctagagctaatagtttattcggagtagcaatagcctgggtctccgatcacataagcattgccaccagacttcaggtggccgaagtagcggttcaggacatcaacctcctcagagaagctcctgtggggagcaggctgtgcgccggggaagatgaacatcccacgagagtacttgacggcagcaagcggcatgcacagctcttcagcaagctcaagaatcctaggaatggtgagcaggagcatggtagtcccacaggtcttgatcacaatcttctgagaatagatgaacaggctggactcagatagcacatacgagtcgaagtccttgttggagagctcggacacaatggtgcaccgtgcaagatcaagaacagagtc

SEQ ID NO: 75941 - DNA, 100 bp, Triticum aestivum
  Clone ID: PAT_TA_75941
acatctacagcaacttccacggcccggcactgcttcctcaagatcccgcaaagaggcagttcgccgatgagctgattgcttacgccgacgcctttaccaa

SEQ ID NO: 75942 - DNA, 207 bp, Triticum aestivum
  Clone ID: PAT_TA_75942
tcggcacgagggcaaagtcaggcacttcaccagtctgccaattgtttcagctcacctcagctttttccatatcaagccagggcaagctcaagggcaggtgcacaagatttgtcatctgcacgcaggaaacttctctgggactggccagcaatcagttgtgagggacattcccgttcaaagttcgacaagaggggcattccgagctcc

SEQ ID NO: 75943 - DNA, 666 bp, Triticum aestivum
  Clone ID: PAT_TA_75943
attcggacgaggctctcccggccatggcgccactccaggggggcatgctggagttctccgggctgaggagctcgtcgtcgctgccgctccggcggaatgccacctccgacgacttcatgtccgcggtctccttcaggacatacgcggtgagcaccagcggcgggtcgcggaaggcgccgacggaggccaagctcaaggtggcgatcaacgggttcgggcgcatcgggcgcaacttcctgcggtgctggcacgggcgcggcgacagctcgccgctggaggtcatcgccatcaacgacaccggaggcgtgaagcaggcgtcccacctcctcaagtacgactccacgctcggcatcttcgacgcggacgtcaagcccgtgggcgacaacgccatctccgtcgacggcaaggtgatcaaggtggtgtccgaccgcaacccctccaacctgccgtggggtgagatgggcatcgacctcgtcatcgagggcaccggcgtcttcgtcgaccgcgccggcgcgggcaagcatctcgaggccggcgccaagaaggtgctcatcaccgcacccggcaagggcgacatccccacctacgtctgcggcgtcaacgccgacctctacacccacgccgacaccatcatcagcaacgcctcctgcaccaccaactgcctcg

SEQ ID NO: 75944 - DNA, 622 bp, Triticum aestivum
  unsure (1)..(622): unsure at all n locations
  Clone ID: PAT_TA_75944
attcggcacgagggcggacgctgttcctggtgaagcccgacccgatcgtgctccgggaccacggcggcgcgctgctcacggggaacctcaccgtcaaggtcaacgtcctctactacggccgcttcgcaccggcgcagcgcgccgtcgtcgccgacttcgtgcggtcggtctcggcgccggccccgggcggcgccgccgagccgtccgtggcgtcctggtggcgcaccgtctcgatgtaccgcggcgggggcgcgcggctgaggctcggccgggagctcctcgacgagaccatgtcgctgggccggtccctctcgctggagaacgtcacggcgctgggnaggggcgcggggcaccaccgcggtgccatcaccgccgtgctcacggcgcctgacgtcctcgtggcgcccttctgcatgtcccggtgcggcgtccacgaccacgccaccgccggcgcgcacggcagggcgaggtacgcgtacctgtgggtgggcaacccggcccagcaatgccccggccagtgcgcgtggccgttccaccggccgtcgtacgggccccaggtcccgccgctcgtgccgcccagcggcgacgtgggaacggacggcatggtgatcagcctcgccgc

SEQ ID NO: 75945 - DNA, 706 bp, Triticum aestivum
  Clone ID: PAT_TA_75945
tcggcacgagggttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttagcccgcgttggtggcggccccctcggcgagggcctcgacatcatctacccaggcggcgccttcgacccacttggcctcgccgacgaccccgacaccgcagctgagctcaaggtcaaggagctcaagaacggccgcct

SEQ ID NO: 75946 - DNA, 693 bp, Triticum aestivum
  Clone ID: PAT_TA_75946
tcggcacgagggttaatttgtatgccgaatatcccgctgaactgagccatccgatacctggttttataatcagttcattgttcttttctcgtgttccctcttttctgcttctttttgttggaaggatcatgctcatttctttatctatagttttgtttagtttttttgtttgttttggtgcacatagttgcgatgaggataacaagctccctcttctgaaagaattgacgacattgctggcagaatcgaaccaattaaatattgccaccactgagcaactatgtgtcttgaacaatatttctttgctgttattgatcgtttgcttcttttaacttccagtttacagatttgtttggattgtgattagggattttgcttctggcgaagcagcgagttcatgcgcaagtgaatgaacgagcagcgagtgaagtgcaacagtcataagtaagtctcgccatgttcctaaaaagggtgaccatctttccttcccttctactgacactgagcgagcagcaagcataggcaatagtttccataggggtggggcgcaagcaagtgttttcaggctccactagctagcgtactcttatgctatcaatgaaactgaaagaaaaaactagtgcccttttgtatagatagacacagtactttttctttacttcttccatactaggaagaatggaaggaaatcct

SEQ ID NO: 75947 - DNA, 752 bp, Triticum aestivum
  unsure (1)..(752): unsure at all n locations
  Clone ID: PAT_TA_75947
gaggggccgccgccctcatcttctccgccgcggaagccgcgagcgtcctcgactaccggccgtccaccgtggccgccgtcgccgtcttggcggccacccacggcgcgctcacgagggagccactggaatccaagatcagcagcctctccccgacctgcctcctcgagaaggaggatgtatatgcctgctacaccatgatgctgcgcgatccatcgtcgccgagcaagacggccaagagatcggcgtccgaccggggcgacgccgatagtacatacgcacgcctggacgccgcctccttctccgtcgcggcggcgatgaacaacaacaagagggtgaggctggagctgccggccgtccaccggtgatccaagcccgcctccacggcacgcttgtttttccctaggtgtccagccgcgcggccggagcttcattagtatagttggtcgtcgcagcagttgcaactccggccattttcaccctcgatttctttcccatttctctagattttttagttcntttgatcggcgcactgccaaacaatcggttattggcagtgcggccggattggattggtttgattcccgcgtgccatcgagtggagacaagaagaagaaaaagaagaaaaaaataatcaagaaggtggcgagcttgatgaggcccgagctttcctacggagaggagagcataaagcagcacaggatcggagggaaagcttggctggctgcaaagttgcacgtcggattccacttcct

SEQ ID NO: 75948 - DNA, 672 bp, Triticum aestivum
  Clone ID: PAT_TA_75948
attcggcacgaggaaacactagtatcaggaggtaaccttgaggcaaatgaattgaagcgcgttgtgtttggacctaactatggagagagagatagggcgtttgaactcatcaagaagatggatatccttcaccattttcatatcacctaggatagcagggagcaaatgaggcataagaccttccaaaacatcgtcaaggctagaaaaagccataccggttcactcgaaagcttactatcaaatccaaatgaaactactttatacaacaacgcctttgtcttctacgatttgggtatgtgcgttcgtgctggagttcatttctatctctatctgcgggctttgcaattgctgggaactgaaaaacaccaggagttaattagcagaggattccacttgaaggactacgggtgcttcgctttgacataactcacccatggatcaaatgcaaagggtatcctcacagaggcacattacgatcacaaaaattagcaatttgtcattcacacaccttctaaataagctatgaagttttggattggaggagcagcacacacagccaacatggcagtcgtaatggcccaactttacatcgacggagtcaatcatggagtacatgcatacgtggttcctctcagagacagccagactcataaactgctacctggtgtgctg

SEQ ID NO: 75949 - DNA, 616 bp, Triticum aestivum
  Clone ID: PAT_TA_75949
attcggacgagggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacggatgggacaccgccggattgtcggctgacccagagaccttcgccaagaaccgggagctggaggtgatccactcgcggtgggcgatgctcggcgccctgggctgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcattgagggttaccgtgttggtggcggccctctcggcgagggcctcgacatcatctacccgggcggcgccttcgacccgcttggcctcgccgacgaccccgacaccgccgcggagctcaaggtcaaggagctcaagaacggccgcctcgccatgttctccatgttcggcttcttcgtgca

SEQ ID NO: 75950 - DNA, 722 bp, Triticum aestivum
  unsure (1)..(722): unsure at all n locations
  Clone ID: PAT_TA_75950
cggcacgagggttcatctcactgagctcgcaggcagccctagccaccagcgaaatggccgcgtcggcgctgcaccagacgaccagcttcctcggcaccgccccgcggcgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacggatgggacaccgccggattgtcggctgacccagagaccttcgccaagaaccgggagctggaggtgatccactcgcggtgggcgatgctcggcgccctgggctgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcattgagggttanccgtggttggtggcggccctcctcggcgagggcctcgacatcatctacccgggcggcgccttcgacccgcttggcctcgccgacgaccccgacaccgccgcggagctcaaggtcaaggagctcaagaacggccgcctcgccatgttctccatg

SEQ ID NO: 75951 - DNA, 511 bp, Triticum aestivum
  unsure (1)..(511): unsure at all n locations
  Clone ID: PAT_TA_75951
ggcacgaggcttccttcacgatccacggtcgcggcgaggcgatggacgccgaccacggcggcggggtggacgaggcggaggcggccttcttcgcgcgccggggcagccggtgctgctgcttcccctgctggccctcctccacatcctcctcgtcctccgccctctcccaccagcgcgtcggcggggcggcggcgacgctgggcggggaggaggagcactggtggcagggcgcggtggacgcgctgctcaaggtgcgggagtggtcggagctggcggcggggccgcgctggaagaccttcatccgccgcttcgggcgcggccccggcgggccccgcccgcaccacaacttcggcggccgcaagctcaactacgacgcgctcagctacgcgctcaacttcgacgagggccacggcgccacccccgaggccggcgaccacgccggnggctaccgcgacttctcctcccgcttcgccgccccgcccgcctccgccaagtcctccatggacctcgg

SEQ ID NO: 75952 - DNA, 612 bp, Triticum aestivum
  Clone ID: PAT_TA_75952
tcggcacgaggcacagccccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaagccaagccggtgtcgtccggcagcccgtggtacggctccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatccactgccggtgggccatgttgggcgctctcggctgcgtcttccccgagctgctcgcccgcaacggcgtcaagttcggcgaggccgtgtggttcaaggccggctcccagatcttcagcgagggcggcctcgactacctcggcaaccccagcctcgtccacgcgcagagcatccttgccatctgggcctgccaggtcgtgctcatgggcggccgtcgagggctaccgcgtcgccggc

SEQ ID NO: 75953 - DNA, 693 bp, Triticum aestivum
  Clone ID: PAT_TA_75953
attcggcacgagggagagtcagcttcacgatctttacgaaaaggaggagatctactataaacagcgttcgcggattgactggctgtagtggggcgatcaaaatacaaagtatttccagaatcgagcatcgcatcgaaggagaaaaaacatggtcaaggcactgcgcagggaggatggcacgctttgtacctctgacgatgacatgcggactatggcaatgaagttttatgcttctttgttcagctccgagggttctaatgcagcggcaagtgtgctgcaacacattgatactctagtctcggaggagatgaatgggaagctcacaaccatgatcaccgactgtgaaattgagacggctctatttcagatgggccctacgaaggcgccggggccggacggcttcccggctttgttctatcaacgacattggtcgctagttaaggaggacgtgtgcaggtcggtcaaggatttttttggatggagtggcgacaccggaaggtttcaatgacacagttatagtgatgattcctaaagtcacatcaccgggagttgtttgtctctgtttagaccaattagtctgtgtaatgtgctctacaaaattgcaacaaaggtactggccaatagactcaagggaatcctcccctgttttgatctcagaagaacagagtgcctttgtaccggggcgactcatca

SEQ ID NO: 75954 - DNA, 649 bp, Triticum aestivum
  Clone ID: PAT_TA_75954
tcggacgaggcgcccgccaatcccgccgcggcccggagcgatccaccgccccgccgaccgaccccgcggtcggggtggccggagccggggccctgccctcgcgggtccggttcacgccgtttcttccccgggcgcggcgcccggcggaggcccccctccgatctgtatccatccgtctccccccgcgtagcgcccggcgccgcccgacgcgtcccgccgtcgccgacgccggctgcccccccgccccaccggatcgctgcgccggccgcccccgcctcccgcccgcggccgcgggccccccgtcgcgcgagataacggtgttccttcgttgccatttgggaaaatatgggttggttgaccaaattttttagaggttcgacccacaacatctcggaagggcgagaacaaagcaagcctgcagaagagacaagatggaatgaaccctccacttccactgttgtgattgatcccctttcggaatttgataatgaggatattgaccgtgctatagcactttctttattggaagaggaacacataaaaccaaaggaaacaggaaaggatctgcatttagaatgaggatgaacaactggcaagagctattcaggaaagtttgaatgttgaatcaccccctcgagctcatgaaaat

SEQ ID NO: 75955 - DNA, 651 bp, Triticum aestivum
  Clone ID: PAT_TA_75955
attcggcacgagggttttttggttactgattgcgatctcggttcttgattcccgtccgcgcgctgctaatctcgccgtcttctttcttttggtagaaaaattcctctccgcgttagggtcctttaccgagtttgatttggtttgttatatactcgtctgcctgcgaatccgttgctcgatttagggttactttcgtgtagatccccggctcgaattgcatttgctcgcatcagtactaccgccgtttcttgtttgctctgatccatggacgcaggttccgacttgatgtcgccggagaagagcggcaggcggggcgcgcggccgccgctccgggaggccggcgcgacgccctccatgccgccgctccaggagcccggctccaggcccaggccctacatgccgtccctctgctccacgccccgcaaccctgccgtcaagtgctatggcgacaggttcatccctgacaggtcggcgatggacatggacatggcgcactacctgctgacggagccgaggaaggacaggaagaacggggcgacgccgtcgccggggaaggagacgtaccggaagctgctggcggagaagctgctcaacaaccgcaccaggatcctcgccttccgcaacaagccaccggagcctgagaacagcatc

SEQ ID NO: 75956 - DNA, 695 bp, Triticum aestivum
  Clone ID: PAT_TA_75956
tcggcacgaggcttccccacctccgcgcacggcgcgccccaccccgagatgctagaccaccccagatcctcgacggcccccggcgccgcaacccgcccccatacgcggattcgcacagcaccgccgtccccgaccagcaaccaccccggatcgatgccgatgatgcttgaccgcctccaaccaccgcgggccctccctgctccccccagcgctacctggcgcggccatcggcctctccatcctgggtgagggcggggcgcgggcaaggatggagtcccggtgggagcggccggaggcgaagatcttcgccaatctggcttcctccggtacctgcagctcggcccaggacggcatgcggctcgaccgatggcggcttgcagtacgccgacgccctccgtgctcaccaccgacgcctccttcttcctccacacgtccgggcacccctgctaccgtcgcatccagcgcaggtggggacgagccccggccgccacgctcccctgtcctctgacctctatctccactctcttgggctggatctatatcacacctagagctgagcaactgtggcgtccgactctctgtgtagtcaacatcgtcgatgaacagtgtgctccctgttcctcctctccggtatgagcaattcaaggtcgtcgctggagcagtcggcttgcctcctctcccgcgaactgttgcat

SEQ ID NO: 75957 - DNA, 626 bp, Triticum aestivum
  Clone ID: PAT_TA_75957
tcggcacgaggctccgataatacaataccatggcccccgccgtgatggcttcgtcggctaccaccgtcgcacccttccaggggctcaagtccacagccggtctccccgtcagccgccgctccagcggcagcctcggccgcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctcctccgggtactacgacggtcgatactggacaatgtggaagctgcctatgttcgggtgcaccgacgccacgcaggtgctcaacgaggtggaggaggtcaagaaggagtaccctgacgcctatgtccgcgtcatcggcttcgacaacctgcgccaggtgcagtgcgtcagcttcatcgcattcaggccaccgggttgcgaggagtctggcaaggcctaaactacgagttaaaacaatggcctatgtatgattgtcttttgtgaacttcacttttgtccaggactctgcttc

SEQ ID NO: 75958 - DNA, 668 bp, Triticum aestivum
  Clone ID: PAT_TA_75958
gagggccgctccggcggaatgccacctccgacgacttcatgtccgcggtctccttcaggacatacgcggtgagcaccagcggcgggtcgcggaaggcgccgacggaggccaagctcaaggtggcgatcaacgggttcgggcgcatcgggcgcaacttcctgcggtgctggcacgggcgcggcgacagctcgccgctggaggtcatcgccatcaacgacaccggaggcgtgaagcaggcgtcccacctcctcaagtacgactccacgctcggcatcttcgacgcggacgtcaagcccgtgggcgacaacgccatctccgtcgacggcaaggtgatcaaggtggtgtccgaccgcaacccctccaacctgccgtggggtgagatgggcatcgacctcgtcatcgagggcaccggcgtcttcgtcgaccgcgccggcgcgggcaagcatctcgaggccggcgccaagaaggtgctcatcaccgcacccggcaagggcgacatccccacctacgtctgcggcgtcaacgccgacctctacacccacgccgacaccatcatcagcaacgcctcctgcaccaccaactgcctcgcccccttcgtcaaggtgctcgaccaaaagttcggcatcatcaagggaaccatgaccaccacccactcatacaccggcgac

SEQ ID NO: 75959 - DNA, 533 bp, Triticum aestivum
  Clone ID: PAT_TA_75959
attcggcacgagggagagagagagagagagagagagagagagagagagagagagagagagagagagagagagagagaggcgcctcccactgccagcctcagctcacccgaagcaaagccagctagcacgcagcgcgcgatggcgggcgcgaccatggcgctctcctccccggcgatgggcggcaccccggtgaaggcctccagggcggcgcccttcggcgaggggcgcatcaccatgcgcaagacagcgggcaagcccaaggtggcggcgtccagcagcccgtggtacggctccgaccgcgtgctctacctcggcccgctctccggagaccccccgagatatctcaccggagagatccccggagactacaggtgggacaccgcggggctgtcggccgaccccgagaccttctccaagaaccgggagctggaggtcatccactgccgctgggccatgctcggcgcgctcggctgcgtcttccccgagctgctcgcccgcaacggcgtcaagttcggcgagggcgtctggttcaa

SEQ ID NO: 75960 - DNA, 591 bp, Triticum aestivum
  Clone ID: PAT_TA_75960
tcggcacgaggatcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgctaaaaaaaaaaaaaaaaaaaaaaaaaa

SEQ ID NO: 75961 - DNA, 606 bp, Triticum aestivum
  Clone ID: PAT_TA_75961
attcggacgagggtgctccgcaagccgtctgcgggctgccgctctgtgccccaggccccaggcacagaggtcgtcaggtgggacgccgccacgccgccgctcgcttcccgcgccggcgccgccccctcgcctccgctccaaccgcagctgaaaatgaagaaggcgcttcccctaaaaggcgggtcgggagggtcgaggcatggaacgaaatctcccaaggagctggagagcatcttgaagcagtattttgggtactcggagttccgaggaaggcagctagaggccatagaggctgttctttcaggaagggattgcttctgtttgatgccaactggaggtggcaagtcaatgtgctaccagatccctgctctagtgaagaccggcgttgttcttgttatctcacccttgatagcgctaatggagaatcaggttagcagcttgaaaagtaaaggaattccagctgaatttctctcttcgacacaaacaactgctaacaaaaacaagatacatgaagatctcgattctggcaatccttctttaaaattgctgtatgtcactcctgagttagttgcaacatctggcttcaaagcaaagttaacaaagctc

SEQ ID NO: 75962 - DNA, 657 bp, Triticum aestivum
  Clone ID: PAT_TA_75962
tcggcacgagggtgacgttccacttcatcaacgcgtacgaggagaaggacgaggaggggcgcgtgacggcgatcatcgccgactgctgcgagcacaacgccaacacctccatcctcgacaacctccgtctccacaatatacggagctttaccggcgaggatgtcctcaccgacgccgggtggggcggttcaggatcccgctggacggcagcccattcggcgagctggaggcggcgctggacccggaggagcacgggcgcggcatggacatgtgcagcatcaacccggcccacctcggcaaggagtaccgctacacctacgcctgcggcgcgcgccggccgtgcaacttccccaacacgctcaccaagatcgacctggtggagaagacggccaagagctggtacgaggagggcgccgtgccgtccgagccctacttcgtgccccgccccggcgccgtcgaggaagacgacggcgtggccatatccatggtgagcgccaaggacgggtcgggctacgcgctggtgctggacgccaagaccttcaaagagatcgcccgggccaacttccgctacgggctgccctacggcttgcactgctgctgggtgcccagggacaagtaacaacatatacagcaccagagtcaacatacagggtcagc

SEQ ID NO: 75963 - DNA, 553 bp, Triticum aestivum
  unsure (1)..(553): unsure at all n locations
  Clone ID: PAT_TA_75963
tcggcacgaggcacccgtacgctttctcctccagcgaatcgagcgggcagcgagcgaacgctccccacgcgcacgaaccctagccgccgctctcctctcctgcgacccccaaccaccaccgctcttctctcctgtgcctcgtctcccaaccacccaacccaaactccggcggcctcctctccctccagcgccgctgctccagcctcaccttccttcctctccaaaggaagggaagggaagggaagngatgnngggaggggagggaaggccccagatcgagcggagcgacgcccagatccgcagcggcaccggcaccagcgcgccgtcgcgccgtcgtccacctggtcctcgaggaaggccatggatgggggcggaaccctagccggcgactccttttcgtggccgccaaatccttgcctggagctgcaccgtcatccatctctctacatgtttctcgattcactgccgctgcgcgctgtgcttctggatcacgtgcaagtcattgccattggagagcaggggtggcttggtatttatggtgggcatggagcag

SEQ ID NO: 75964 - DNA, 804 bp, Triticum aestivum
  Clone ID: PAT_TA_75964
tcggcacgaggctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaggtgatcaacgaggtggaggaggtcaagaaggagtaccctgacgcgtatgtccgcatcatcggattcgacaacatgcgccaggtgcagtgcgtcagcttcatcgccttcaagccacctgggctgcgaggagtccggcaaggcctaaacagctcactcacgacaggccatatataaagtgccagttgcagttttgtcaactctgacagttgctttgggttttccttctccatttatctttcttatttgttcctaagaaatatgtgtatgtccatgttcatgtaccaacatggctcgagaaagcatgctcgtatgagaatgctatcggtggctatgtatatgaacggacgcataatattatacaatatgtcgactatatac

SEQ ID NO: 75965 - DNA, 715 bp, Triticum aestivum
  Clone ID: PAT_TA_75965
tcggcacgaggcttatcatctccttctctgctccgtgcctctgtctgcccgacacacaaagacccaactctgattcgcgtcttccgccgtcttccactatttcagtctggcgtgaccggcggagcgcggactggtcactggggctcgccggcgtgggggctgtcgaggggccggaaagagctgagaggccagaggctggtcatggctcctgggctcgtctcgtcgcggctgggcaggcgacgccggcgccgcgcgcagagatccggtgagctgatccaactcttctgattctgtctttttagtgtagattctttcatcttaattagttggggaaagttctaattacgccatagaatttttgtactaaattaaaattgttgtttacaaaaggaggcattgatggttaagggggttccctaaaaaatggttaagggggaaaccattgaagcatcttacagaagaaagagaggcgagtgtgaagctaacgaaccaaccttaatggaagcagaaccaaggctcctgtcttcttgaatgtgagattattaagacaaggccactttgaagattattaagacaaagcaacgtatacgatggaagacgtttttctagccaatagcttgatagtcaacataaagagtgaaatcatggagaagtactaatatgaatgttcttatgtcatagtgattaattcagtactccctggttaagcagtatt

SEQ ID NO: 75966 - DNA, 565 bp, Triticum aestivum
  Clone ID: PAT_TA_75966
tcggcacgagggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaccgtcgcggccatcaaggttggcccgccgccgccgctctccggtggactccccggaacggacaactccgacgaggcaagggacttcgacctgcccctgaagaaccggttctacctgcagccgctgccaccggcggaggcggcggtccgggccaaggagtcggcccaggacatcctcaacctcaagccgctcatcgacaagaagcaatggccgtacgtcatgaacgacctccgcctgagggcctcctacctgcgctacgacctcaagaccgtcatctcctccaagaccaccaaggaggaaaagaaggacctcaaggacctcaccggcaagctcttcgccaccctcgacgggcttgaccatgc

SEQ ID NO: 75967 - DNA, 577 bp, Triticum aestivum
  Clone ID: PAT_TA_75967
tcggcacgagggaccggcggaccacgcgtcgccgtcgacgtccgcgtccttctcggggccgtccacgacgacgacggaccgatccgggagcgcggagcacgaggcggtgccggaggcggtgcggtgggtgcggcgcgggttcgaggacgcgcggccggtggcggagatggtggacccggcgctgctgcgggaggcgccggcgctgcccaagaaggagatcgttgccgcgttccacgtcgcgctggcgtgcaccgaggccgacccggagctccggcccaagatgaagaccgtcgccgacagcctcgataaggtcgggtcgtgaggacggatgcatcatgcacgtacggccattggcttacgctgccacgttatgtgttcgtgacaaagctcgtctgggaagtcttcttttcttgagctttccttcctctctggctctcaagctcttcatattcttttttatttattttgtaattgggggtttcttggctatttgttccgacaaaactgacgatttgtgatcatacaacagcatatatagaagtgtacttttccgcgtccaaaaaaaaaaaaaaaaaaa

SEQ ID NO: 75968 - DNA, 727 bp, Triticum aestivum
  Clone ID: PAT_TA_75968
tcggcacgaggggacgtccggctcccgtggtggcgcgcatggccaggtacggcgtgctggcgattggatctggcgtgggggcggccaggtgagggcggatctggcgccggtgagggcgtggcgcggcctgccatggaggcggcgagcggatctggcgccggcgagggtgcgcgtccaggggcgagcgggcgtggtgcgtggcctggcccggtggcggccaggcgagggcgcgcgcgggcgcggcctggcgcggtggctcccaggcgagggcacgtggaggtgcctcggattcggcgcgggctggcggggcggcgcccctccggcgtgtagcggccggatctggtcgaacctggccagatccgtggtgtgtttgacgcgcgccggccctgcgcgctggtcctatgatgctggagcaggcggctccggccgtgatagatgcgggatgcagggactgatctggtcactgtaggctcgccgtgggcggggtggaccacgactccatggcttctacgactaggttctgcggcggtggcggtgcgagactgcatggacgagcttctgtgggcacgagcgaaggtgtgcggcgatacagacgaaagtcctgcacgaccagaggccggtggcgatggcgcctgtgggtgtcattttcctccttgaaggcgtcacctgaggtgtgttggcatctttctcgtgctcggatggtggtttgtcaccgggcgaaatccta

SEQ ID NO: 75969 - DNA, 158 bp, Triticum aestivum
  Clone ID: PAT_TA_75969
attcggcacgaggctgctgctcaccgtcttccggggcccattgggaagctgtgcgtcagcccgagcaccatgctccacctgcagccctgcaagccgccgctgcacgagacggaccacctcggtggcgctgtgttcaccggcgtgttgggtggggggag

SEQ ID NO: 75970 - DNA, 446 bp, Triticum aestivum
  Clone ID: PAT_TA_75970
tcggcacgaggacgatgcatcctcgccgataggccgcaaagcctcccccattcggttctcccctcgccgcaatccacagctccgcgccccgcctccggctgcggctgcggcgccgatggggtacgtgctgtcggcggtggcgagggtgctggagcagccgacggcgtggggcgcggcctgcgagatggcgctgctcgcggggccgctctgggcggcggccctcgtcggcctcctgctcggctgggcctggcgccctcgctgggccgccggcatcgtcacccccgccgccgacccgccgcaggtcgccacgctcgacttctggagggcccagctccccgcccgcatccgcggccctctcgactacctcgccggcgcgcggcagcagcagcagcagcggcaggagcaggaggaggaggaggcttccctgcaagggccgtcggagatgg

SEQ ID NO: 75971 - DNA, 585 bp, Triticum aestivum
  Clone ID: PAT_TA_75971
tcggcacgagggctccccaccaccgacgagctcctcccctcttccctcgccccagatggagtagcagggccggatcctgccgccatccgaggctcgcaagaccgccgccgcagcgctcccgcctccccgcgacttcctcgcctacctcgaggcctatctggcccgccacgacggcgtcgacaagctccttaagatctcacactacgctacgcgcctcgccctcggcccctcgctgcagggcctctgccccgcaggcctccgcgcgcctcaagtccttcgagtccagcctcggcctcagacgcaaggccttccgcctcagcaagttcgtccagacgtcaacgccctccgcgcgcactccggccccctccctctgcccttcgtgctcctcgcctacggcggcgagggcgtctactacatcatcgggcagttcgtctggctcgcgaaagctgccctcctcccggcgcagctcctcccccgccttcagcgcctcagcgcctgggccgagctgctgggttacgtcggctccaacaccatcaagctggaagtggtgatgaagatggagtcttcaatcaagatgcggctggc

SEQ ID NO: 75972 - DNA, 711 bp, Triticum aestivum
  Clone ID: PAT_TA_75972
gaggggtggacgtgatcatcaaaaggtacaacctgcgtagcgacgtccgtagcatcaacctctcgggcatggggtgcagcgcggggctcatctccgtggggctcgccaggaacctcctgcaggttcttcctcgaggctcccgcgcgctggtcgtctccacggagaccatcacgcccaactactatgtcggcaacgagcgcgccatgcttctgccaaactgcctgttccgcgtcggcggggtggccgcgctgctgtccacgtcccccgccaaggcccgattccgcctcaagcacgtggtgcgcaccttcaccggcgccgacgacagcgcttaccggtgcgtgtatcaggaggaggatgagcaggggaacatcgggatcaacctcagcaagaacctgatggccatcgccgggaactcgctcgaggccaacatcaccaggatcgggccactcgtcctgccggcctccgagcagctcctcttcgccctctcctttgttgcgcggaaggtgcttcgcgtgcgagtcaagccctacatcccggacttctccacggcgttcaagcacttgtgcatccacgcgggcggccgcgccgtcatcgacgagctgcagaagaacctcagcctctccgacgagcaaggtggaggcgtcgcggatgacgctgcaccggttcggtaacacgtcgagcaggctcgttgtggtacgagctggcctacgt

SEQ ID NO: 75973 - DNA, 730 bp, Triticum aestivum
  unsure (1)..(730): unsure at all n locations
  Clone ID: PAT_TA_75973
gattcggacgaggcgaagccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcngagaaggtgggctcccgcagcggcacctgctccaagcaggtcgtcatcgccgactgcggccagctctagatccgcccgcccgccgngtcgccgtcgtcgtcatcgccccgtgtgtcccgtgtcgtgtcgtcgatctaaataagagagtcgtgtgtcgtgtcttcccctggtccgtccgatgagatctccg

SEQ ID NO: 75974 - DNA, 697 bp, Triticum aestivum
  Clone ID: PAT_TA_75974
tcggcacgagggcgcctcccactgccagcctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtcggccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctggtgcacgcgcagagcatcctcgccatctgggccctgccaggtggtgctcatgggcggccgtggagggctaccgcgtcgccggcggcccgctgggcgagatcgtggacccgctctaccccggcggcagcttcgaccccctgggcctcgccgaggaccccgaggccttcgcggag

SEQ ID NO: 75975 - DNA, 706 bp, Triticum aestivum
  Clone ID: PAT_TA_75975
attcggcacgaggcttgtgctagctatagctcttgttttgctgttcatcgtcaagctgattggcgtgctcctgttggcatcaatcgaccgacagaccggcaatggacggctgccgggatggattctccggcgacttcatggtgctgcggccggacaagggcggcgtccgcagcctcctccacctgctgcgctgcagcgacgtcggcgccagcgacgccgtcgactgcgcccctggcgaggaggtggtcctagaccggtggcgccggtggatcatcttcctctccgtcgtggcgcagatgctgctgctgtgggtgaagacacccttggccaagctcgggagcgccgtcgagtactggatgaacctcatcacggacaatggcggcggcgtgctcaagcttattagaaacgccatgcaaggcaaattacgaattccggacagagagtcccccaactatcgatcgctcattggactcatcgacatgagagtcgaactggacaagaagatcaagccagaggatggcagttacctcgctgctctgggtattatggcctccaaactagcctacgagaacgagctggtcatcaagaacgtcgtcgaaaaacactggcacatgaaattcctcgagttcttcaactgctggaacgaattccgaggggatcaaggcgattacacgacgcaggccttcatgttcgccgacaagccggc

SEQ ID NO: 75976 - DNA, 771 bp, Triticum aestivum
  Clone ID: PAT_TA_75976
tcggcacgaggctacagtcctactgtcagcctcagctcgcccgaagcaaagctagcgagtacgcagcgcgcgatggcggccgcgaccatggcgctctcctccccggcgatggcgggcacacctgtgaaggcctccagggcggcgcccttcggggagggccgcatcaccatgcgcaagacggcgggcaagcccaaggtggcggcgtccagcagcccgtggtacggctccgaccgcgtgctctacctcggcccgctctccggcgacccgccgagctacctcaccggcgagttccccggcgactacggctgggacaccgcgggcctgtcggccgaccccgagaccttcgccaagaaccgggagctggaggtgatccactgccgttgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcatgcgcagagcatccttgccatctgggcctgccaggtggtgctgatgggcgccgtggagggctaccgcgtggccggcggcccgctgggcgagatcgtggacccgctctaccccggcggcagcttcgaccccctgggcctcgccgaggaccccgaggccttcgcggagctcaagggtgaaggagatcaagaacggccgcctcgccatgttctccatgttcggcttcttcgtccaggccatcgt

SEQ ID NO: 75977 - DNA, 770 bp, Triticum aestivum
  Clone ID: PAT_TA_75977
attcggacgagggcgcctcccactgccagcctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtcggccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctggtgcacgcgcagagcatcctcgccatctgggccctgccaggtggtgctcatgggccgccgtggagggctaccgcgtcgccggcggcccgctgggcgagatcgtggacccgctctaccccggcggcagcttcgaccccctgggcctcgccgaggaccccgaggccttcgcggagctcaaggtgaaggagatcaagaacggccgcctcgccatgttctccatgttcggcttcttcgtgcaggccatc

SEQ ID NO: 75978 - DNA, 735 bp, Triticum aestivum
  Clone ID: PAT_TA_75978
attcggcacgaggggccgatattgtcacgccgctgcccctcccaccccgggtgacgcctcccgaagctcccatccagctgcgcttccccagcctgaggtgccgcccagctgtccactaacctagcggcggccgtcgcccactggttccctggcatcgcccctaacctgccagttgatttgctcgcgccgtcgtgtcctccgaccgtgatctgcctcgcgacgccacctccccagactacgacctgccttgagccaccacctccccagaccacaacctacctcgcgccgcgacggcctctggccacaacctgcctcccgcccccacgacctccgaggggccgccccacaggctgcagcttaggagactctccgctgtccctcttccaccaccggcaacgtcttccccaccctctctgtcctaccctgtttccaaatttggtttttgcagcaggtctgatcccttgcctgtgctctccacttgtcctcactccttgggccttccctttgcttatcaccatacattttatacagagcggtgtcatgatgcatctcctctgcctagatgatggacagagggcctaagctctagggccttggcatcattacaaggaagacaagcttttcgactccatctgtatgtgccaggaaaggtgaatctcagagatttgtcttgtagactggtggcatgatgctacaaccagtgttcaaggggacatggtaaaaagtagcaaattc

SEQ ID NO: 75979 - DNA, 478 bp, Triticum aestivum
  Clone ID: PAT_TA_75979
tcggcacgagggcgacgccagcgagcgccactcggccgcgcagccgtcggcggcgtcggaggtcaccaggatgcggatcccggcggcgccgcggatctcctggaggaactgccggcagtggccgcaaggcatgtgggagacggcgatggcgcgcagcgcgggctccccggcggcagcggcgttggcgatgaggaactgctcggcgtggaccacctgggagagaggggcgcccaggaactcgaggttcacgccggcgtacacgcgcccgctctcgcccagcccgacggcgcccacggggaaccgcgagatcggggggcgcgcgcgccgcatcgcggaagggatcagcaggggcagcaggtcctccaccgtctccaccccggccgccgcggccgcgcgctccgcctcgtcagcgctcatcacaaatcctggcagctcgacggcctcaggcttcgccgtcatcctctcctcccccattgct

SEQ ID NO: 75980 - DNA, 777 bp, Triticum aestivum
  Clone ID: PAT_TA_75980
tcggcacgaggtcctggccttcctcgacctatacgccatcgccgccgccgccgccgcccatcgacgccgccgccgccgccatcacacgatgtcgctgccgctgctgcggactccttcccgacgctcagggcgctgcggtagaactgcgcttggctgcagtgcgtgttcccggtgccattgccgaccgtcggtgcgccaccgtgctggcacctcgatgggctgctcgaggtaatggccgtgaggtgtacaagttgacctcatgctgcaatcgctctaataaaaagggccacgattgaatcgatccccatgtcatcctaaacttcagatttccatccaactcagcaatcgatctgaaaaaagcggaggaggaggcggctgcagtaggcagtaaggctgccgagtgaagggactacaggggattgctggcgccacgatccctgctctgttcttaaatcctttcaatccatcacagaagatacatgcatacaattggcttgatccctaatgtttggacaagaaaaaaagttggttgtgtacatgcgtatccataagtggtccttttgacttgattgtgtgatgtaggaagagaaagcatgcaagttgccatggtctgcataacgacattgcttccagtggcaccaaagatatatatggtaggcctgcctacggacagaagatcccttggatgtttctaggaggtttaaattgtagatgctttcagatgaccctatgttagccaaccaaattagttttattacatggcaaccaaattagctg

SEQ ID NO: 75981 - DNA, 732 bp, Triticum aestivum
  Clone ID: PAT_TA_75981
tcggcacgaggatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatcattccagtgcgagcttgtcttcgccaagatgggcatcaacccaatcatgatgagtgccggagagctggagagtggcaacgccggagagccagccaagctcatcaggcagcggtaccgtgaggctgcagacatgatcaagaaagggtaagatgtgctgcctcttcatcaacgatcttga

SEQ ID NO: 75982 - DNA, 709 bp, Triticum aestivum
  unsure (1)..(709): unsure at all n locations
  Clone ID: PAT_TA_75982
gattcggacgaggcccagcacacgcccccggcgcggccagattcgtcagccgcgtacgaggccgctcgccggcgggcaagtccaccggtcctgcctcctgcgttcccttcctcggcggcggcgccgattgctacgcgcgcgcgccgagcgtcgcaggtgacgccactcgatcgcagtgcacctcttcagcggacgcacgcacctccccagagggcgagtcgagctcggctggaatcggccagcaatgccaaccgcccgcctgtcctccatcttcacctcctccttcagggatccttcacgagcccccctcgccgccttggctgccgccacggaacgcgtgcgcgctggaacgctaacccgggaggacgcgcaccacctgttcggcgaattgctaggccaagccgccgccgtcccggaacgcgggttgaacaactttcttgccacactcgcccgtgctccaccctcacctgcctgcagcgatggccccggccttgccatcgccctcttcaaccgcatgtcccgaggcgctgntgcaacgggtggtgtcgcccacgctctgtacctattccatcctcatggactgctgctgccgcgcaggccgccgnggactttggtggttgccttcttcggtcgcctcatcaggttgggggctgcgcttggaggtcatctccgtcagcaatctcctcaaggggctctgccaggccaagcg

SEQ ID NO: 75983 - DNA, 788 bp, Triticum aestivum
  unsure (1)..(788): unsure at all n locations
  Clone ID: PAT_TA_75983
tcggcacgaggtccatttgggatgagaaaaaggagccacctccgcacccactcctccttcccaattctcctccagattccaatccttcccccggatacaccgtgaacttggacatatattttcgtatatagagagaggggtagatagatagtttttagcttgcaggaggaagtttccatggctcgtggcggtgtgaatatgtgctcaaattgcaattagctggtgaccatatgcgtacggttaacactccaacttcgaagaatcaggccaagaagattaggctgcacgaccgctactgcgacgggatgatgccgctgtgcaacccgagctccgaggcgaggcagctttccgcgtcctccaccgggctcccgacgtcgcaccaggaactgttcatgagcgccgggtttcaacagcagcagcagccgcagcaccgcgacgccgccgccgggtgggcgcgccaggagtactacgcgccgccgcagaggtcggcggcgttcgcgcagagatgcgtcggctcgcncaacggcggcgnttctacgcggccgagcacctgctcggcatcggncagttcgacggcgctcccctcgggatgctcccgccggcggcaacgatgatgccagcggtgccggccaggacgcgngccggagagcggcgacatgtacatgtcgcacgagctcgagccggtgatgctccgcgcggaccggtcgccgttcagtgaggacgtactacgtgcagccgcagcagcggcggggacccggtggagctcgagctgccactgccactgccgc

SEQ ID NO: 75984 - DNA, 754 bp, Triticum aestivum
  Clone ID: PAT_TA_75984
tcggcacgaggccatggtcctgatgccgcggagagctccgcgcctcgccgctgccgtcctccccctcctcttcctcctcctcgcccccgcggaggcggtgcccttcgtcgtcctgcacgggatcgggggccagtgcaccgacagcagcgttgccgagttcacccggctcctggccgactggtccgccgccgacggccactgcatagaaattggaaacggggcacgggactcctggctcatgcctctcaacgaacaggctgatatcatgtgcaacaaggtaaaggagatggaagagctaagcggcggctataacattgttggtctgtctcaggggaacttgattggccgggcagtggtcgagtattgcgatgatggaccaccggtcaagaatttcatctcactcgctgggcctcatgctggtactgcttccgcgccacacctgtggttctggttttttctgtgttattgttgatgcccttatcaaatcggagatttactcggactacgtgcaggtacttatatcttggcttagtcacttcccaaaccctagtcgtgctagtactccctccgtccgaaaaaacttgtctcaagcttgttccctcaaatgaatgtatctagcactaacttggtgctagatacatccatttgagggacaagctttttcagacggagggaagtattaatgaacgagagactttaactcaagtcgtggtgaattacaggcacatcttgcgccaagtggttacatcaagat

SEQ ID NO: 75985 - DNA, 727 bp, Triticum aestivum
  unsure (1)..(727): unsure at all n locations
  Clone ID: PAT_TA_75985
ttcggcacgagggccgctggccgtcctcctcgaccagagagggagggcgccgccatcaccaccagtccaccatggcctcctcctcctcgcttaagatccccgcaccaacccaccaccctgccgaagagggcgcgtccgcggcggctgcccttccacgccgtctccgtccgcccccgccgctccgcagtctcctccgcctccgccgcatcctccccgcagcagctgccggcactgggcgacggcgacgacgccaacaggcccaccggcgtgcccgtgcccgagcccttctcccgcgacgccgctatcgcgctgcctcggccgttgacgagcgcggatctgatggggcaggccagggggaaggcctcaggttcgcttaccaggtccatttttttctcctctcttcttctgagatacactgacgataatcatggtgatgaatgattctgatgatgatgcaacgcaactctgaccaaccaatcttaggggtgcccgggcgccacggatctgcaggtcgacccttgtcctcctctctgctcnctcttatggggagtggccaatgagtgccttttttatgtcttgctcctggtagagagtaagactattattctctctgtgcacttaaattttggttgtttccttgccttcattgcttgttttttactggtgtataaatatgtgccttttttcctcctggtagggcctaggattgctacttttgttcctttcc

SEQ ID NO: 75986 - DNA, 597 bp, Triticum aestivum
  Clone ID: PAT_TA_75986
tcggcacgaggctccgtcatgccgccgcaagtgccttcctctctccgccgcctcctccctctctccaaaccctagctccggccccgctcctctacctctcgcgccgcctcttcttctcttccgtttccgctccccggccccccttcacccgggccgccggcatccgccccctcgtgtgccgcggccaggccagccgccatcacctccgccccgggagcagcacggccaggaaggaacccgaggggatggctagcggcggcggtggcggtggcaaagacgcgggggtggcgttcaataagatgcgtgcggaggggagggacgtcaggaaggacaggagcatggagctcaagaaccgtagggccaaccccatcagcacaacctcctacgtgcagatactcggtacaggaatggacactcaagataccgctccttcaattttactattctttgacaaacaaagatttatatttaatgctggcgagggtcttcagcgtttctgcactgaacacaagataaagttgtcaaagattgaccacatctttttcactcgcgtgtgctcagaaactgcagggggccttccaggtctcgtgctaactc

SEQ ID NO: 75987 - DNA, 612 bp, Triticum aestivum
  Clone ID: PAT_TA_75987
attcggcacgaggcggggaggtcgaagggtaggcggtagattggaggagcccagcgagccggtcggccggcgccatacagaagcagcgctgccgtctcctttcccccacttttttaggagctggatctgaggtggccaaccgccgctgtcgccgccgccccgtcgggaaaaggccaccatgtagatcacgcagcaggccggtccacccgctaaaatctgttgattttgcccttcgttgtatcttctgcaccatctgcttctctattcacccgccaaacaaatgagtatgtgccatgctttgcaggaaattcattgaacagatgtacctcttctcctgaagccgatgctgccatgcctatgaatcggatatgaccgatgctttgtcaagggctcatatgagagaagaaaaggaggctggagatgcagagaaagaagctctaagctcaacaaaggcatcaggatgaaaacgtcggcattagagtcgtggtcgtggcagggaaggcgaacccagcgcagctctgccagtggctcaagaggaagataagcaaggatgtcaagattttccgccgttgtccacacgggctgagaattgtaataagcagggctagccgt

SEQ ID NO: 75988 - DNA, 633 bp, Triticum aestivum
  Clone ID: PAT_TA_75988
tcggcacgaggctcccgcgtaccaagccaccgaccaacatggcagcgtctctccaagccgcggccacgctgatgccggccaagatcggcggccgggcctcctccgcgcggccgtcgtcgcacgtcgcccgggcgttcggcgttgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaaaaccaagctcatgacccgtctcacctacacccttgacgagatggaaggcccgctcgaggtcggcgccgacggcaccctcaagttcgaggagaaggacggcatcgactacgcggccgtcaccgtgcagctccccg

SEQ ID NO: 75989 - DNA, 744 bp, Triticum aestivum
  Clone ID: PAT_TA_75989
catctggacgcacctgctcggcttcttcttgttctcgggaatttttagagtagcatttctcatgactccattggcaaggccgatggtgagaagtgtaagtacctgagtgatgctgtttcgtggaatatgcccagccacgtggaagcaacaactctatttcaaggctgtgtcgtgcaggttctgatcatggtatggcagcacactttccagcgtcgatctgagcaaacgatgatgcaaggctgctcctccttgtactgcatgtcttcatcgacttgattctttgacagggagatatttaaagccttcacttgttcattgtgtcatctgctgattactttttctattattttcttgcaaagcatgtaatggtttggagtagttgatcatggcctgatggaacattcatgttgttagcatgtatatatacactattacagcagcttgttgatcaagcgcttctttctatctaaatgtgtgcacagaagttcaattaccttctaaaaaattattggtgcactatctatctatatatatacactatctatctatatatatatatacactattacagcagcttgttgatcaagcgcttctttctatctatatatatacactatctaaattgtttgcaacggcattatgcacatgaggcaggactatacaagtgaattgtcacagtaaggtccttccatggatttcatgtggctccttgagttgtaagatgcagctccaacattgaatata

SEQ ID NO: 75990 - DNA, 663 bp, Triticum aestivum
  unsure (1)..(663): unsure at all n locations
  Clone ID: PAT_TA_75990
cacaccccagaactcgatcgacaacccacatccatctctagcttctaccagctgaagcacactagcaccaagacagaggcagactccatggacgctgtggagtcctcttcgtcctactcgccaccgtcactgcgccacaagctgcggaccaccgtatgcggctgcttcggctcgccgtcgtcgccgggtagcggcggggagaggccacaaaacagcggcagggacaggtggaggaggcgcgtggcggccgcgggggagttcaggtacgacccgctcagctacgcgctcaacttcgacgacggcgccagcggcagcgatgacggcgcggaagcagaggacgcggccttcccgtaccggaacttcaactcgcgcctgcggntccctacgccggngccgggctccctgagccgtcggcatcgcctgaagtcgccgatcgaatcgtacaagtagctgtcggccgtcctttgctgcttctgtacctttctgtctctctgattcttcttcttctccaagtgaaactgtattaactctgtgaaagcattttatacggccgtgcaaatcgcagcgatgtagcggcagtgtaccagtagcatcattgtatagtgtatacatataggataataggaatcgatcaaccaattttagtgttcaaaaaaaaaaaaa

SEQ ID NO: 75991 - DNA, 644 bp, Triticum aestivum
  Clone ID: PAT_TA_75991
actcagcgggaacaggggaaccatgttgcgggcggcggcgtcaaggtgcgccggcggcgccatccggcggctgtcggtggcttcgtacccagaagcggtaggcgcgcggaggaagcctcccctggatgagggggactggtcctactacaaggagtggtggggcgaggacgacggccccggcgttggagctcacaccgtcttctgccgccactccgagcatggcaatggcgtcgtctccgtcgtcgcctacccagccacccgaccggccagcgatcagtggccagtgacggagagatggcttcaggaaagaaattcggcaatgtacccagaatcaagtggtgctgaccagtttaagatactaggctaccagtggcgagtaatgcgctttaacgaccatacacggcaaagtactgcaaaagtaatggcgtgttaccggtctgggggtgatagagcattatactcaatgcagcaacccaattgtttagctgttccttatgtcaagagcatggtatcagcagggttgacagcagctccctagttgttcttatgatctccctcaagcagtttctgagccgaacactatgaaaattctttgtatcggtcatggtggcggcagcataccattgtttttggctagtaaattc

SEQ ID NO: 75992 - DNA, 298 bp, Triticum aestivum
  Clone ID: PAT_TA_75992
tcggcacgagggtgcgaaggctatttaactgacgtgtggaaaaagcgagcaagaaatttacattcttctcctcccccctcctccggcgatgaccgccggtctcctcctcggcgacgccgccgcggccccgcgcgcccgcatcgccgtctgccggccgcgcctgcacctctgcggctgggccccgaggccccaccacggctgccgcctctcccgcggccgggggcgcgcgccggccaggttcgccgcgtccgcgtcgggcggcgggcggggcggatgggacgagccctcggaggaggag

SEQ ID NO: 75993 - DNA, 510 bp, Triticum aestivum
  Clone ID: PAT_TA_75993
attcggacgaggggaagctcctagccaacaccaatcaaagcctccatccaaccccaagcaacctcgaggatgtcttgctgcggaggaaactgcggctgcggcagcgcctgcaagtgcggcaacggctgcggcggctgcaacatgtacccggaggttgaggccgccggcgccaccctcctcgtctccgccaccgccacccacaaggcgagctcgggcgggatggagatggcggcggagaacggcggctgcggctgcacccagtgcaagtgcggcaccagctgcggctgctcctgctgcagctgctagatctatcatcggtcatgcatgcaccgcgcgcatcatatctatgatctatctacaatctacttaccatgtaacgccacctgatcgagggtctttgtatgtatgtaagcacctgccagcatgagcagagcaggtgcactgccatgcatgtaaaccgacccctaaataaaatctcccgtggtttaacctaaaaaaaaaaaaaaaaaa

SEQ ID NO: 75994 - DNA, 733 bp, Triticum aestivum
  Clone ID: PAT_TA_75994
attcggcacgaggctctgtcagactggcgccttccgcgacctgccctctccactccatggcatccgtctcccgcgctctccgcccgcgcccgcgtctcgccgctcctcgtcttgggtgcggactgagagttgggtgctctgtgccagcatatggaagtgctgccacggagaaggccgactggggattggccattgcgccctcaccagcgaccactcttgttcccgttgtgaggagccgtcaaattttctgcaaggcagaagctaacatttctagtaacctgccagcgagcgagcctactggagcaagccagtatgagaaaatagttgagctactcaccactcttttccctgtctgggtcatattaggtacagttattggcatctacaagccatcaatggtcacctggttggagactgatctttttaccgtgggcctaggatttctaatgttgtcaatgggactaacattaacatttgaagatttcaggagatgtttaaggaatccatggacagtatgttttttgccccttggccgcatgtatttgtataaaaatattgatgcagttctgtacttaataacctcatgaattgatgtagaatttcttttgtatgttcactgacgtaatagcttctttgcaggttgggtgtgggatttcttgcgcagtatttgatcaaaccaatgctaggatatgctattgcattgacattgaagctatctgctcctcttgcaact

SEQ ID NO: 75995 - DNA, 704 bp, Triticum aestivum
  Clone ID: PAT_TA_75995
attcggacgaggcggccttcctggtggtggccgcgaagctcatcgtccttgcggcggccgccgcgacggcggcaaacgcggcctcctacgcgcggttccggaggcgccacctccgccgcatccgcagccccatcgacgagtcggccgaccccgtcgccgatttccgctccctgccctcctccgctgccgcagcagaggatgatgattttttcttcgggttagcgacggcgcctgcgcatgttgaagacaggctggacgatgcttggcttcagtttgcgacagaacaatccgttgatgacaaggagtccatgcgcaaccagaaacaagtcgatgcagtgatggcctctgctggtggtgatggaggctctcagccatcttctaggctaagaggggacgaaaagggtaccgatggagagaaaaggaagcctcttagggtagccatggaggctatgctcagaggatttgaaaagttttctgagggtgaagaatctagtggtggagataactgcagccacaatgttgctgcttggcacaatgttccatgcccgcaagagaggcttaaattttggtccgatcctgatactgagttgaaacttgctaaggaaaccggcattagtgttttccgcatgggcgtagactggacaagaataatgcctaaggaaccaactgaagatttcaagagctcggttaattttgcagcactt

SEQ ID NO: 75996 - DNA, 618 bp, Triticum aestivum
  Clone ID: PAT_TA_75996
tcggcacgaggaacaagaagccagcactagtttacaagagattcccatggattacccgatgcaggaggtgcaccagcacccaggattccgggcggttcatccatggcagtggtggcagtggcagctctccgtcctggcttcgtcctcttcgcctccggctccgtcgtcgcggccgcccaaccacgtcagctgggatgagaccggcgccgcgcatatctactccgctgacctccccggcgtgaagaaggaggagatcagggtggagattgaggacgggaggtacctcgtcatacgcaccgaactggacgctggtgacgcggaagtccacggccgccgaggcagcttcgcgaggaagttccggctgccggggatggtggacgccgacggcatcacggccgagtacgcccacggcgtactgaccgtgacggtgcccaggatgcacacccgggcccggcccgtggtcaatctcatcgggcttggtcctgcctgcgaccccgtggccagagcagcttaaactgatttattattatattatattatatattcaagttcccatgtactaaacgaaatgatgaatggataaggtctagcctgccagaaaaaaaaaaaaaaaaaaaa

SEQ ID NO: 75997 - DNA, 637 bp, Triticum aestivum
  unsure (1)..(637): unsure at all n locations
  Clone ID: PAT_TA_75997
attcggcacgaggctcgttttcacacgttatcagcacgctcttacagagagcaataggacaaggcggaggcagccccgacgaactgccgaacttcagaccggccccaagcggcggcgtggtgagcccggacccggcgctgaacagcgcaaggggacacgcgcgctcccagccatcggccgtgactctcgggtctcggcatagcgcggcggtgcccgccttcggccggcgaaacggtcccgatctcccagcagcggcgccgacgatgggcactacttcgtctcgattgattggcctcgagaaatagacaagtcggggtcaggggagatcaagcaaccaccagatagcaaagtcttgatctaattaccacatgaacaaggtgctactttccgattttatttttgcaaacaacaaaagctatcgtcaggaactagtacctttggcatttgtcttcaggcaagcaacagccagaagaacagcaacatncttcttggttgtggcacaacacatccctcccggccaggtctccatcgcgcagaggctctggctggaggtcgtgacagcggtgcccagcccgcaacagtggcgacgcccatggtgcagccatggacttctttctcggcgtgagacggaggcgct

SEQ ID NO: 75998 - DNA, 680 bp, Triticum aestivum
  Clone ID: PAT_TA_75998
tcggcacgaggcgcaggtcggcaggtctttggcatgcagatggcagccatggatgcggcttgctcccaacgccgggtgcggccgtgggcggtgaggagatccccctgtcctgctttcaacttcggtgggcacttgtctggcggggtggcgagctccatggatttgcagtggcggtcatggatgcggcttcctcccacccgggagggtcgtggcttgtggggtggctgtctctctctttcgggcggacttcttcatcgttggtgttcttgttgttcgtgctcggagtgccccctcgtgtgtctctgcttggcagtgcccagcgtcctcgccggtggcgcacaggtgtcgtggcgctatctggcctcgcgtgacctttcgaatgtaccccatggcacaggtggtgccgcggcgtagtgcagtctcggatgcgcggcgcctttcgattgcgtcgacggtgcagtgtcctggtttggtttgcttggcgatgcccttcgacttcgccggtggcacatagacgtcgtggcgctgtctcggccccgtgcgacctttcgattgtaccccacgacacaggtggtgtcgcggcgttgtgcggtctcggatgcgtggagccttcgattgggtcgacgatgcagtgtcgtggcttggtttcggctggccaatgccgttcgattacactggtt

SEQ ID NO: 75999 - DNA, 722 bp, Triticum aestivum
  Clone ID: PAT_TA_75999
attcggcacgaggcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcttgggttcacagtgtacccatcaccccaggtctccacctctgttgttgagccatacaacagtgtcctgtccacccactccctccttgagcacactgatgtgtctatccttcttga

SEQ ID NO: 76000 - DNA, 321 bp, Triticum aestivum
  Clone ID: PAT_TA_76000
cggcgacgccggcgagagagaagagggatcccgacgttgctcggtcgggaggcgaggcgcctcctcctacgcctcgcgctcgccggcggcgccgctgccctcgatcctggccttccctcccccagtaagcgcgcaccattccgaagcgtctgcctacttcgatttggtttggttattattaaagcatctgcgtcgcgcctacttggattgttgctgagcgtatgtggatcccggttcgattatctgaaggaaaagctggcttccaggtttcgatttgaagggcgtttcgtctgggatctcttcctggtggtttcgagatgg

SEQ ID NO: 76001 - DNA, 550 bp, Triticum aestivum
  Clone ID: PAT_TA_76001
gattcggcacgaggccgggccggaccggaccgagcaggccagcggtcctcttttcagggaccggaccggcgaggcaaaagcccgggctggaccggcggaccggccaaccactcaccggcgacgagatggtgaccatggcgtcggggagtgaagcctctaggccctaataagaagggggaacagagcgggaaggtgcagtgactcacgtagaacacgatggtgtggtcggggaggccggggaagcaacgacggcgacataatcgacgatgaatgacggcgacaggagttcggtaaggaggaagatggcgatggcttcggaatgaatcaggccgattcattccatggggacgtagatctcatggtcgcggagctcctggacatggtggttggtcgttgggaggccggtcgccgcgtccgcgagaggttgtgcactggacggcggcggcagcggcacaggtgcgtgcgtgtgtgcgtttttttgagcgaaacgtgtcctgcaggatcgaggcactgtgagggatggagaggagagctcaggtgagtggctggt

SEQ ID NO: 76002 - DNA, 733 bp, Triticum aestivum
  Clone ID: PAT_TA_76002
tcggcacgaggcctccctggcctctcggggctccccggagaaacactctgtccccactttctccgggcggcgccgagatccgttccccagtcgacggaccacgccgacggccgcctccgggaagctcgttaccgccacagcgccgcggcctccgcatcacagttgatcatcagatggagcagcggcaatcaatcaccatgtcgaagctagacagcagcggtgtgacagtcctcgacgacttgccagagtccataattgccggggagatactcatcaggttgccggcagaggacatccttcgctgccgtgctgtgtgcaagttgtggtgccatgccacctccgcccacgacttccttctcgctcaccatcatcgccagccctcgctccttctcatcaattgcttcaaccgtgacaacagattctgtgacggccatctctgcgtcttctgcggcgaccatgctgggtctaccggccgcaagctctgccggcccatcctctggtatgctgaccacacgcaggatgtagacagcctcgctatccaggctgcctgtgatggcctcctcatcgtctcttacaaagataatggcagacgcttcgatatctgcaatccaacaacccgccaacgtgctcccctgttgctgcttcctggaccaagatgtcgtgcttcagctaaaagcattcgcatagcaggattctaccagcattgcccgtccagagaataccgtctgctcta

SEQ ID NO: 76003 - DNA, 725 bp, Triticum aestivum
  Clone ID: PAT_TA_76003
gaattcggcacgaggctcgccaaccccaccggttttccctagatcaactctgccgccgtcgtgtcccggcacagatcaaggtgtgagctgctggacacgatgagggagcgggcatcttggagcggaccgagatccactgcgtctacgcgagcacctcaggctcaggcggcgccatatgattcgtgccgtcgtcaagggccatggagctcgggacgccgctctcccccctcctacgccatcaagcatcaccaagtcaactcgatgcagggggatgcttcttcttcttctcggggcgccgtgccgccatggaaggtctctctctctctcgtttcaatttggtacggtgctatagttggttcccttccctccctgatgcggttcgtcacgcctctctctttcgatctgtagttgagctggtaggtctagcatccatattggctttacatacatcatggacaacatatttttccagatctttcccctcaagaaaagaaaagatggcactcacttagttccaagtcgcacaattcagatatggttgtttctgaaagggattattgttgtataggaaataaaagcttggttctatttgtaactaaaggtcttgattatctatggttaacttaattcatacatcctctatatctgattatatttttatggttcagatttcatatgccattaaatctgacccaagatatgtagtgtacagcctgtcatctctt

SEQ ID NO: 76004 - DNA, 660 bp, Triticum aestivum
  Clone ID: PAT_TA_76004
tttgagcaacggcacagctcgggagatcgggcggcggaagagggaagcacccccggggttgagctggttgccgagatgagctacaggatgatgggcgaggaggaggaggacgccttcgaggcgtcgtcgtgcgcgtcctccggcggcgagtcgggcgacgagggggacaggttcccggccagcgggggcgcccgccgccagtccgcgccgccgcaggcgccgctgaggaggatgaactcggacagcatctacgacatgtccggcatgacggcgcacctccccgccaagtaagtagcagtactactccaactaactcatccgtcgacgacgaacgacgggcagagcaaaggctaacgatgtggctgcgcaggaaggggctgtcggcgtactaccagggcaagtcgcagtcgttcgcgtgcatggcggaggtgcggtgcctggaggacctgcagaagaaggagaagccgcgcgggcacaagatgaagccctgcaagagctacgctcgcgctggggggcgtggccatggccaggaagccgccgggctcctcctgcgccaacctcggcctcatggacgccggcaacggcttcatggcgccccggaacatccccgtcaacgacgactgctaccatcagtaggttcagggtctatttctcgggtca

SEQ ID NO: 76005 - DNA, 672 bp, Triticum aestivum
  Clone ID: PAT_TA_76005
tcggcacgaggccaccacagccccactcctagagagcacgcacatcggacacgcacgaagtctcctcgaccagcgagcaatggcgaccaccgcgatggcgctctccccctcctccttcgccgggaaggcggtgaaggacctgccgtcgtcggcgctcttcggggaggcgcgcgtcaccatgcgcaagaccgcggccaaggccaagccggtgtcgtcgggcagcccgtggtacggctccgaccgcgtgctctacctcggcccgctatccggcgaccccccgagctacctcaccggtgagttccccggcgactacggatgggacaccgcggggctctcggccgaccccgagaccttcgccaagaaccgggagctggaggtgatccactgccggtgggccatgctgggcgcgctcggctgcgtcttcccggagctgctcgcccgcaacggcgtcaagttcggcgaggccgtgtggttcaaggccggctcccagatcttcagcgagggcggcctcgactacctcggcaaccccagcctcgtccatgcgcagagcatcctcgccatctgggcctgccaggtcgtgctcatgggcggccgtcgagggctaccgcgtcgccggcggccggctcggcgagatcgtcgacccgctctaccccggcggcagcttcgaccccc

SEQ ID NO: 76006 - DNA, 648 bp, Triticum aestivum
  Clone ID: PAT_TA_76006
gggaagagaaaggtacgaaaggtaaccagatgtgggtgtgatgctcgtattattgtgaagcggtgcactgataacaagtataaaattacatcatggatcgagcaccataatcatggatttgtgccgcctgataagtgtcacttgattagatcgaatcgtcaattgagtgacaaggtgaagccaacagtatccacgcattgcaaagcaagcacaggcacctcccaggcaaacaagcctgatcatgtcagtgaggggaggtctgacaatgtgggttgcacaaagagagacttgcagaaataccatcatgatctttgtagtaaaattaagaatgaagatgctcagatatttgtggcccagctatgtagaaagcagcaagaggattcagcatttttctttgactgtgatgtggatgaccagggtatgttggtgcatgtattttgggctgatgccacaagcaggaaaaactacatttatttcagtgatatgttaacttttgattgtacaaacacactgaatcaacacggcatgatttttgcaccatttactgggaccaatcatcatctgcaaagtgtgtttttcggtgctgcattcctagctgatgagaagattgagtcgtatgcctggctgtttcagaccttcctaagggca

SEQ ID NO: 76007 - DNA, 633 bp, Triticum aestivum
  Clone ID: PAT_TA_76007
tcggcacgaggcaaagaaggataaagttcacattaacttggtcgtcattggacacgtcgactccggcaagtccacctccactggtcacttgatctacaagtgcggtggtattgacaagagaaccatcgaaaagttcgagaaggaagccgccgatatgggcaaggcctccttcaagtacgcctgggtcatggacaagctcaagtctgagcgcgagagaggtatcaccatcgatatctccctttggcagttcgaaacccccaagtaccacttcaccatcattgatgcccccggacacagagatttcatcaagaacatgatcaccggaacctctcaggctgattgcgccatcctcatgatcgcctccccccagggtgagttcgaggctggtatttccaaggaaggacagacccgtgagcacgccttgctcgccttcacccttggtgtcaagcaaatgatcgtctgctgcaacaagatggacgagaagaccgtcaacttcagcgaggagagatacctcgaaatcaagaaggaagtctctgagttccttaagaaggtcggctacaagcccgacaccatcaacttcatccccatttcaggatggaacggagacaacatgcttgacagatcaaccaacac

SEQ ID NO: 76008 - DNA, 724 bp, Triticum aestivum
  Clone ID: PAT_TA_76008
attcggcacgagggccccggcgtcgccgtgccccgccccctcccggcccacggaccccgacttcctcagctgcgtcctccagcccccgaccccctcctcctcaacctcccgccccgaccccgactacgccgccctccgccgcctcctcctccgccgcaagtcctcctccgcgctcaaccaccgcatggagtggcggtgcaacggcaagggctacgtcgtctaccggaacttcctcctccgccgtatcgaagccgcctcaagcagcgcccacagcacgcccagcaacagtgggaggtggtttgctagccctactacattttctgaagcagacagctggagttctatcagggacctcagaagtaacagcggtaagttaagccgcaccttgagtgtcagctcaaagcatagtgaacctgagcgccatgtcagattcgccgaacctgcgtactcgtttgttggaatgcattgcatctttgacaactgcaaagcatcagttaccgtattgcaatttggccgcacgaattcagatctgcttgcttatggttcatccgatggcagtttgacggtttgccaggtttctgagccaccctctgttcttcaaaaattaacaggacattcaaaagatatcacagattttgatttttcatctaataaccagtacatagcttcatgctccatggataaaactgtgagagtgtgggagatctctaaaggcacttgtatc

SEQ ID NO: 76009 - DNA, 656 bp, Triticum aestivum
  Clone ID: PAT_TA_76009
attcggacgagggtgatctctctgctgctcgtgtatatcttagccacctacctgccaacacagcgaccagggcgacgtcggctgactttcctgcctgccgtccgtcgcgctatctgcatggctttcgcgcccaaggcatcttcctcggctccgtcgttgagccgccccatgcgttgcggcacggtggcctctgtggcggtgcccgtgccgctgccggggaggcccgtggtcagagcagtcgccgcggcggcggtggcgtcgctcgaaccggcggtgactgtacccgcgcccgcgctggctgggaggtccgcgtcgctgtccgcggccggcaaacgcggcctgtcggtggcagaggccatgtctcggggcagggcgaatggcaagacggcgtttatcccgtacatcaccgccggcgaccccgacctggcgaccacggcggaggcgctcaagctccttgacagcctcggcgccgacgtcatcgagctcggcttgcccttttcggacccctccgccgacgggccggtgatccaggcctccgcggcgcgggcgttggccgctggcgcaaccaccgacgccgtgatgtccatgctgaaggaggtgacgccggagctgtcctgccccgtggtcatcttctcttatttcagccccatcctgcg

SEQ ID NO: 76010 - DNA, 627 bp, Triticum aestivum
  unsure (1)..(627): unsure at all n locations
  Clone ID: PAT_TA_76010
gattcggacgagggtgattcatagcgcgcgcgcgggcgcgggcgatcgaggcgagcaaggcggcatgggggccgagcaccactcgccgtcgtcggccaagacctcccctcgcggctccggcgtgggtggcgggggcgagcagtactccccgtcgaccaagtctccgcgcggtggtgccggaggcggaggcgagcactactccgcgtcgagcaagtccccgcgcgctggcggcatcggcggtgtctcgtccttgctcccgagcggcggcgtgtcgtccctgctgcgnagcggcgcggtggcgacgctgctcgagagcaggtggacgctctccggcgccatcaccgtgttcctgttcctcgccgtcacgctcaccgtcacgacgtcgtcgtcgtcgctgtcccccgtctcggcctccttcttctccttcctcccggccggccgcgccgccctcgtcgagccgccgcaggcccagcagcagccgcaggccccgccgccgcctccgcccggcgccggcgtgccgcggctggcgtacctcgtgtccgggtccaagggcgacctggaccggctgtggcgcgcgctgcacgcgctctaccacccgcgcaacctctacgtggtgcacctggaccg

SEQ ID NO: 76011 - DNA, 686 bp, Triticum aestivum
  Clone ID: PAT_TA_76011
attcggcacgaggagaaggcggaaagcaagcctaagcaggatcacctaccgatcgctgcagctctctaaatcttgaccataaatgtcagtaagtgactcgttgtagctatgattgaatggtcgaagaaatctcgatgatcggcatgattggccgaatgctagccaagtgattgaaaggcacggattgataccactgaggcagaagaagaaagaacaactccaaacaaccccacaaacggctgtccttaaccctccatgaatacatcatgttgttccatgtatggtgacaggtaggcgatcgttaaagactagatccactcgccttgttcctaagagaccctaacagagttccaaacaggacgcctttagcccaaggatggccctctttgagtttctaaaaatttgcatgtttgaccggggtggaccagcgggcatgactaaagactccttcagcccgcatagcttagtgaagaagatggaaaaaatccaaccaaaacctaaaaaagttcctacttaaaaaagcctatggttgtcctccgacccaactctatcacatttccatcgtcttgagtggcaggtatatcttttacagctttggctaaaaatatctcatgaccaattcaattcatttcttttccatgaaaaaagagtaatgatgtcttgtgtcgaaacaaactatccccaat

SEQ ID NO: 76012 - DNA, 728 bp, Triticum aestivum
  Clone ID: PAT_TA_76012
caaagcccacccggcgccgaagcaacacgcgcacctgccgcttgccatgtcgtccgccgcgccggcgccggaggagcagccgccacgccctgtgcgtttcggcatcatgggatgcgcctccatcgcgcgcaagctcgcgcgggccatgctgctcgccgcgcccgcctgcgccgtgaccgccgtcggcagccgctccgaggccaaggcccgcctcttcgccgccgacaacggcctccccgcggaagcgcgcctgcacggctcctacgaggcgctcctcgacgacccgggcgtcgacgccgtctacctcccgctccccaccagcctccacgtccagtgggccaccgccgccgccgcgcggggcaagcacgtgctcctcgagaagcccaccgcgctctgcgccgccgacctcgacgccatcctcgccgcctgcgacgccagtggcgtccagttcatggactccaccatgtggatgcaccacccccgcaccgccaagatgcacgagctcctccccgccgacgtcggcgacgtcagagttgtgaacagtctgttcagcttccgagcaaacgaagatttcctccagaatgacatcaaggtaaagccagacctcgacgccctgggcgcgctcggcgacgccgggtggtactgcatccgcgcgatcctgtgggccgtcgactacgagcttccaaagcacgtgatcgcgctctctgagcctgtcaagaaccaagccg

SEQ ID NO: 76013 - DNA, 752 bp, Triticum aestivum
  Clone ID: PAT_TA_76013
gagtgccatcaaggatatggctgttgctctgcatttccagctccgcgtcgtgaaatcggaccgtagccgattcatcgccaaatgcaacacagaaggatgcccgtggcgtgtgcatgtggccaagtgccacggtgttccaactttcacggtccggacgttgcaaggagagcacacatgtgagggtgttcaggacctacatcatcagcaggccactgttaactgggtggctaggtctgtcgaggcaaggctaagagataatccgcagattaagccaaaagagatattgcaggatattcgggatcagcatggggttgctgtgtcttatatgcaggcatggcgcggaaaggagagaagcatggctgctgttcatggtacccttgaggatggatatcgccttcttcctgcatactgtgaccagattggaaagacaaatcctggtagcgttgcagtatacaaaggggctgggccagagaattccttccaacggctctttgtttcatttcatgcatctatttatggtttcttaaatgcgtgtagaccccttttggaaattgacaaggcagatctaaagggcaagtatcttgggacattgctatgtgcttcggctgttgatgctgatcacatgatgttccctgtagcatttggtgttgttgattctgaaagtgatgagaactggatgtggtttatctcagaactgaggaagatgcttggtgttaacacagataagatgcctgtctttacaataatctctg

SEQ ID NO: 76014 - DNA, 674 bp, Triticum aestivum
  Clone ID: PAT_TA_76014
tcggcacgaggcagccatgagcaagtggtggtgcatcgcctccctcctgctgtgcctcgcggtggcggtggcgggcaggagcatgcctgctcgcgacgactgcgatactgttgctcttgctgccggtcgcaacggccaagacggtgctggtttcggtgaagccaagaccgcctttgctgggagcaatggtggtgacggcgggctcttcggcggtgccgtcaatggtggccctctcggcgggggcatcgccggctttggcccgcacggcggctttggtgccggtgccgggccgttcggtggtttcggcggtggcttcggtgctggtggtggaggtggaggagggggaggcggcggcggcggcgtgataccttgaggtggccgggacacgagcgcgtatgtaaacgtggtagtagctgtacgtgtgtccctgatttcatttacacgcatctgttggtgtaataagaagtcctctgattagctgcgtgagcatgcatgtatgagtcatacgtgtcattatgtcattagcctcatcgtgttcgtatctgattagttaatgtataaatgaaagcattggtgtgtgagatggtttcttggtctgagcatggatgcatgaagttagccgtgttgcggtgtttgtatcatattgatgcttatttattaaaaaaaaaaaaaaa

SEQ ID NO: 76015 - DNA, 716 bp, Triticum aestivum
  Clone ID: PAT_TA_76015
aaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagct

SEQ ID NO: 76016 - DNA, 769 bp, Triticum aestivum
  Clone ID: PAT_TA_76016
tttctagggcagcaacaaccagtttccaccacaacaaccatatccacagccgcaaccatttccatcacaacaaccatatctgcagctgcaaccatttccgcagccgcaactaccatattcgcagccacaaccatttcgaccacaacaaccatatccacaaccgcaaccacagtattcgcaaccacaagaaccaatttcacagcagcagcaacaacaacaacaacaacaacaaatccttcaacaaattttgcaacaacaactgattccatgcatggatgttgtattgcagcaacacaacatagcgcatggaagatcacaagttttgcaacaaagtacttaccagctattgcaagaattgtgttgtcagcacctatggcagatccctgagcagtcgcagtgccaggccatccaaaatgttgttcatgctattattctgcatcaacaacaaaaacaacaacaacaaccatcgagccaggtctccttccaacagcctctgcaacaatatccattaggccagggctccttccggccatctcagcaaaacccacaggaccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaagataactctagtactagatatatgaaacaccgttttctcagtccatggtttggtcattgtagcgttgaa

SEQ ID NO: 76017 - DNA, 648 bp, Triticum aestivum
  Clone ID: PAT_TA_76017
attcggcacgagggagtcccaacccaccaccaccgccgtctcttccgcccaaagcaaactgctcccccggtaatcagcgagcgcattgaaacggatatacacatcctaacctgagcgccgctctccatctatccatccatccataccatcgtcttccccgtagatttcccacgcaacttggaggcggcggcgatggggaagctggcgaggctcgtggacggcatcaagaggaggctgaccaggaagaagcagggggaggaccaggaggcggcggcggcggcgtgctacgacaaggtgggcaagacggagagcatgcgggtggagatcaggagccgccgcgcgcaggagctcatcgccaagaacctcgccgccgccgactccatcggccacggcggcgccaagaaggccaagaagcgcttcttcgccttctgacccaccggaatcgggacctccgtctctcgatcgatgtatccttgtggcaagcaagatcgatcaatccccggtcttgtactcttgtccccccgtgtgatgattcattagttgctcgattagctccctgcctgcagttgatcatcatgtactgcaaatatgactatctcctctaagattaagatgtaatccatgcatgtcttgttctctgagcgctga

SEQ ID NO: 76018 - DNA, 732 bp, Triticum aestivum
  unsure (1)..(732): unsure at all n locations
  Clone ID: PAT_TA_76018
ctcctccccgccgcttgctcgcgccaccaagccgggggcgccggagatgatctcgtccatgtcctgggtgcccaggggcgccgccaggagcgcacccatccaggcggaccctcccacgcaggaggagatcgacgaggccatgaggagcatcgccctcgccacagaaaatgatggcagcgccgccgccgacgaaaactatggcgagatggaggtcgatggcgccgacgaggaggacagtgaggatgtcgcccgggccaaggccgccgccgaggcgctcgggaagaccggctcgggaggcggtgtctccgatgggctcgaggagctcaacatggaggaatacgacgacgaggacgacgtagagcccgagcttctcagtaccgagaggggggatttgtactatgaaaacaacgaagaggaccctcatctcgtcaggaacaacgatgatgatgatggtgatgaggacgaggagattgaagacatggctatcaaacctactgatatgctgattgtttgtgcacacaacgaggatgagttcaattctcttcaggttagtatagtggaagagttggaggacggggatcttaatatgtatgttcatcatgaggtccctctctcagattttccactctgcacggncttggatggattttaacttcaaggatgccaagaaagaagggaatttcattgctgttggaaccatggatcctgcaattgaaatatggaacttggata

SEQ ID NO: 76019 - DNA, 700 bp, Triticum aestivum
  Clone ID: PAT_TA_76019
attcggcacgaggctcatctctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaatacatacaactccttctgttaaaaaaaaaaaaaaaaaaaa

SEQ ID NO: 76020 - DNA, 799 bp, Triticum aestivum
  Clone ID: PAT_TA_76020
attcggcacgaggctcatccttgccctccttgctatcgtggcgaccaccaccacaactgcagttagagttccagtgccacaattgcagccacaaaatccatctcagcaacaaccacaagagcaagttccattggtgcaacaacaacaatttctagggcagcaacaacaacattttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaacaacaaatccttcaacaaattctgcaacaacaactgattccatgcagggatgtcgtcttgcaacaacccaacatagcacatgcaagctcacaagtatcgcaacaaagttaccaactgttgcaacaattatgttgtcagcaactgtggcagacccccgagcagtcacggtgccaagccatccacaatgtcattcatgctattattttgcatcatcaacaacaacaacaacaacaacaacaacaacaacaacaacaacaacaacaacaacaacaacaacaacaacaacaacaacaacaacaaccgtcgagccaggtctcctaccagcagcctcagcaacaatatccatcaggccagggctcgttccagccatctcagcaaaacccacaggcccagggctttgtccaacctcagcaactgccgcagttc

SEQ ID NO: 76021 - DNA, 719 bp, Triticum aestivum
  Clone ID: PAT_TA_76021
attcggcacgagggccaagcggatgggccaggagcgccgccgcgcgcccggggccggcatggtcgtgaacacctgccgcgcgctcgagggcgagttcctcgacgtgctcgccgcccagagcgcttcctcctccgacggccacacgctgttcgccatcgggcctctgaacccggtgctgcccgccaccgatgcggccgcggccgcacaggctccggcggagcgacacgagtgcctggaatggctcgacaggcagccgccgttgtcggtgctgtacatttcgttcggcacgacgtcgtctctccggacagagcaggcgagggagctggccgcagcgctgcgcgacaccaaccagcggttcgtctgggtgctgcgcgacgccgaccgggcggacatgcgcgagtccggcggcgcgcgcgggctcgcggacgcggcggcgtccctgctcggcgacgcagcggctcaggggacgggcgtggtggtcaccgggtgggcgccgcagctggagatcctggcgcacgtcgcgacggcggctttcatgagccactgcgggtggaactcgacggtggaggggctgagccacgggaaggccatcctggcgtggccgatgcacagcgaccagccatgggacgcggagctggtgtgcaaatacctcggggccggcgtcctcgtgcggccatgggaggagcgcgggcaagtcacgccggcggccgccatccgcg

SEQ ID NO: 76022 - DNA, 605 bp, Triticum aestivum
  Clone ID: PAT_TA_76022
attcggcacgaggcctcagtcctcacgcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgcgcgcgcgcgctgaataaaataaaaccaccgttcgtgttccgtagttctgtatgcccctgtcgcgtgtgttcgaccagtactgtccttcctcatgcctccacttctaatgaatatatggcgcctcaactttgaatgaaaaaaaaaaaaaaaaaaa

SEQ ID NO: 76023 - DNA, 483 bp, Triticum aestivum
  Clone ID: PAT_TA_76023
gaggccgatgctgcagttcgccaagcgccttgcgcaccacggcctgcgccccacgctcgccgtctcccgctacatcctcgccacctgcaagcccgacgccgccgcgctcggcgccgtgcgcctcgcggccgtctcggacggctgcgacgcgggcgggttcggcgagtgcaacgacgtcacggcctacctagcgctcctggaggccgcaggatcggagacgctcggggagctccttcgcaccgaggccgcggaggggcgccccgtccgggcggtggtctacgacgcgttcctgccgtgggcgcgcggcgtggcgcagcggcacggcgccgccgccgtcgccttcttcacccagccgtgcgccgtcaacgtggtctacggccacgtgtggtgcgagcgggtcggcgtgcctgtggaggctggatccaccgtcgtcggcctgcctgggctgccggcgctcgagccggagggcctgccgtggttcct

SEQ ID NO: 76024 - DNA, 381 bp, Triticum aestivum
  Clone ID: PAT_TA_76024
ctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggaatccacaatctaaacgaggacaacgctcgcagcatcccccccaagtgcggtgtcaacctatcatacactatc

SEQ ID NO: 76025 - DNA, 812 bp, Triticum aestivum
  Clone ID: PAT_TA_76025
attcggacgaggcaccaactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcagcagcaaca

SEQ ID NO: 76026 - DNA, 500 bp, Triticum aestivum
  Clone ID: PAT_TA_76026
tgcttacggtttggggtgatgatggcattgttgaagccgtgaagactgccatggagagagcagccagcgcacatcttaaccaccctagtctactctttcagagatttcgcccgttaatgcattacggtttggggtgatgatggcattgttgaagccgtgaagactgccatggagagagcagccagcgcacatcttaaccaccctagtctactctttcagagtttcgcccgttacccccctcccccccccccccccagcttggatagacttcgcccgttctcaagtttaatagtgcttggctccattcatctctgttttatgatacactattctctcagtcggataataatgtactatggataatgatacaaaattgtagaattggttaagactgctactgtactgcattttctgtaataatcggtcatccgtacgtgttgatggtttaatattattgggcgaccattcgtagtcgtcattctctagaaaaaaaaaaaaaa

SEQ ID NO: 76027 - DNA, 770 bp, Triticum aestivum
  Clone ID: PAT_TA_76027
gcttttcctcccccgccgccaacagctccccttgggatcgtccccgcaatcacctgcacactcacttctctcctcgttttcagtcaccacccagttcaccccagactccagatccattcatctgaacggctggatcgtaatccaacgtccaagaggtgccccatgcagctcccgcagccatagcctcctcgatccgatctggatcgggagaggagcacctgtcctgctcctcgtcgcctcgttgcccctctccatggcctcctctgccgcccttgttgcgagtcgcccggattcgtcagaccccgcgtcgtccccgtcgtcatgtcgccggcataatccggtgatccgtaggcctcgccatgccctgcctctcctttccttctcctttccttcttctctctctcacttgtgtctcgtcgccgccgtttgtagaggccagcgccgccgcttggagctcctacgccctgccgtactccgccatgattggcctcgtcaccacgctgctcccgcgacaaccagccccaccagcggcgcgctgccttgtcgccgccggcaagcccctcgggaagctgctcctcgctggccttccctgcacgtccgccgccgcaagttccgtcaccgctccgcgccttgtcgccccttcgcccgtcgtcggagctctattccagcgccgcgcagctcctctgttctgttcgagcaggcaacgagcagatccattcgcgttgaccaagcgaagcaagcgccaggcccagtctgcttctttttgccac

SEQ ID NO: 76028 - DNA, 697 bp, Triticum aestivum
  Clone ID: PAT_TA_76028
tcggcacgaggcgccgctcgcctcccccgcgacggcgatgcggcgacgccccccgcctccaccgcccgcgtcacatgccccctcgaagagccggctgctcctcccgcatagcgcttcgccgacccccccacatcctcccgcggacccgacgccggtgagtcgccgcaaccctagagagccccgcactcggccagatcttttctgcatcgggctgttgggttccccaattaggagaagcgtcgatcccaagatgaacacacacatattctttgctttggcttcaactgtactcaagaacgcaccgagccactgtctctgtttattttcggccaccatttctatttctgcagacttcgcctccagtgtgagtactgacggataatcgtcaacagcaagagtagctgccactgattcatcaacggaaatggttgcttcttgcttccccgcgatgtgatgtgcaaaaacggaggagtaaagcttcaaacagaatactgacgtacgccccatccgtgcccatcctcgtccctcgtccattggatgccttctcggctagctttgcttccacccgtggaactgccttttttactcaaattgctggttgcttgacgcagtacgcttctagcctcttgttgcatgagccatagcccgtgctatatatatggggtggggctgtggattcagtactctgttctttgat

SEQ ID NO: 76029 - DNA, 398 bp, Triticum aestivum
  unsure (1)..(398): unsure at all n locations
  Clone ID: PAT_TA_76029
gaggcacgccagcaggccgtggaggccatgtgcccgggcgtcgtctcctgcgccgacatcctcgcgctcgccgccagggacgccgtcgcgctctccggcggcccgtcctggtcgccgctgctggggcgcgggaacgggcgggtgtcnctggccagcgacaccacctcggcgctgccgggccccggggccagcttcgaccagctcaggcaggcgttccacgcgctggggatgtcggtcaaggacctggtggtgctctccggcggccacacgctggggatcacgcactgctcctccttccagggccgcatccacggcttccgccccggcgccgacatggacccggcgctgaacccatccttcacggacgcactgagcagggcgtgcccgaccaacaacac

SEQ ID NO: 76030 - DNA, 652 bp, Triticum aestivum
  Clone ID: PAT_TA_76030
tcggcacgaggcagcaatcccccaaatctcctcagcctcccgcgcatctcctccgacatggcccgcaccaagcagacggcgaggaagtccaccggcggcaaggcgccgaggaagcagctggccaccaaggccgcccgcaagtccgccccggccacaggcggcgtcaagaagccccaccgcttccgccccggcaccgtcgccctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgaggcctacctggtgggcctcttcgaggacaccaacctctgcgccatccacgccaagcgcgtcaccatcatgcccaaggacatccagctcgcccgccgcatccgtggagagagggcctaagctctgttcgtcgtcgtctgttagtcgtcctcttagcctgatgtgttcatcggtggaaatgtgcgtgctagtgtttgttcgtgtcgtggtcgatgtagtgtgtctgttctgatgtcaccatcttgctgtcatcagtaactgaaatgaaaatgttgctatctgttctaaaaaaaaaaaaaaaaaa

SEQ ID NO: 76031 - DNA, 777 bp, Triticum aestivum
  Clone ID: PAT_TA_76031
gttcctggtatcgcgccggcggaggttgggatgccagcaccggcggcttcaagtgcagacggcaaatctgtcgtgagggtgctactggagagcctgcaagtgcagataaggctcaaggttctgagtactccatagagcaagtagatccaaaaactccggggtggacacaaagagtgtgtgtcggtgctgccgcgctaggcagagctccttgcccggacaaggtcactgaagaagtccgtcctgatccgtggtacatgattgatgctttttcggtaactatgctagcagccatgggtcgatggagcagatgtctcctatctcgctagcgtggatccttcttttctcaagagcggcgatccggtggaaaccccatctgtgagaaggcgcctgcggttaccggcaaagatggagctcttgatgcagttgattaacagaagaactgttgtagtcttgtagaggaggtgaatggcagcgacatacccatggagcccctgacgacaccgcatgggggcaagctgccggccatgacggcatcaagtgcggacgggcagatatgtgcggcagaggtggtggcagaggcaacgattcgagaaccgactcaggcgtccaagcattctatagagcagaccgcccaaaaacggtcaggattggggctgctgagcctggcaaggcaccgccctaataggatttcagcaatggagaaatcaacacgcggttttgctgaaaacactggagactatgtcattgtgccgaaattaggaacaactttcatacatt

SEQ ID NO: 76032 - DNA, 712 bp, Triticum aestivum
  Clone ID: PAT_TA_76032
gcgtctggagggaacttccaccagctcgatgcgttctacgagagcgtgatcgacagtcacctcaaacggcgagcatcctcctccgccgacgacgaggaggacttggtcgacgtgctcctccgcctgcacgccgacccggctcaccggagcacgttcagcagtcgcgaccagatcaaaggcatcctcacggacatgttcattgccgggaccgacacgtcggcggcgacggtggaatggacgatgacggagctggtcaaccacccggacatcctcgccaaggcgcagcacgaggtgcgcagcgtggtcggcgacaacggcatggtccgggagcccgacctcccggagctcacctacctgaagctggtcatcaaggagtcaatgaggctgcacccgccggtgccgctcctggtgccccgggagaccaccgagccatgcacggtccacggctgcgagataccggccgggacgcgggtgctcgtcaacgcgaaggccatcggcgcgcacgccggcgcgtggggcgccgacgcggcgcagttcgtccccgagcggcatgagcacggcgaggacctcggcgacttcaagccgtggcacgacagcttcgcgctggtgcccgttcgggattcgggcggaggagctgccccggcgtgcacttcgcgacggccgtggttggagctggtgctggccaacctgctcttctcctttgactggagcg

SEQ ID NO: 76033 - DNA, 733 bp, Triticum aestivum
  Clone ID: PAT_TA_76033
gattcggacgaggttataagtagagtgcatcattaaagccaagcaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcaactgcaaccatttccgcagccgcaaccatttccgccacaactaccatatccgcagccgcaatcatttccaccacaacaaccatatccacaacagcaaccacagtatctacaaccacaacaaccaatttcgcagcaacaagcacaacaacaacaacaacaacaacaacaacaacaacaacaaatccttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcacggtgccaagccatccacaatgtcattcatgctattattttgcatcatcaacaacaacaacaacaacaacaacaacaacaacaacaacaac

SEQ ID NO: 76034 - DNA, 692 bp, Triticum aestivum
  Clone ID: PAT_TA_76034
tcggcacgaggctaaagatcagtagcaagcagctagcagctggctatagaaataatggcgggcaagatcaagacagtggtggtggtggtgcaggagaaccgctcgttcgaccacatgctgggctggatgaaatccctcaacccggacatcgacggcgtcaccggtgccgagaccaaccgcgtcgtcgtggccgacccccgctccaaagccatccccttccgcgacggctccgagtacgtggacccggaccccggccactccatccaggctatctacgagcaggtctacggcacgcccttcgtcgacgcccaggccacgcccatcaccccgccgggcgtccccgcgccgccgatgagcggcttcgcgcagcaggccgagagggagaagcctggcatggcggagacggtcatgagcgggttcaggccggacgccgtgccggtgtaccgcgagctggcgcaggagttcgccgtgtgcgatcgctggttcgcgtccaacccggcgtccacccagcccaacccggctgtttgtgcactcggccacgtcgcacggcctggtgagcaacaacacgcaggcgctcatcgccggcctgccgcaaaccaccatatttgactccctccacgacgccggctacttccttcggggtctactaccagtacccgccgtccgtgctcttctaccgcaacctccggcag

SEQ ID NO: 76035 - DNA, 695 bp, Triticum aestivum
  Clone ID: PAT_TA_76035
gacgcatgcatgcacaacggcgctatccatggctgcctctgccgccgacgacattgccgagcttgcgatcacctcgcttctcctcaacacgcggttccgcccgttccatctgaggcagtacgacgggttctggctcctggaggagttcctcatggacgttcccgccgtccactcggtcttcgagccgaggccgtcggacgtcctccttcgcaaagtgcggcaccacctggctcaaggctatcgtcttcgccacgcgcaaccgggccgagcacccgccatgtgacctcaaccaccctctccgccatggcaaccccacgatgtcgtcaggtacctggagatggcgttcgcgcagtcaacggacgacagtggagcaggcgatgcgtttgcggcgctcccttcgccacgcgtggtcgccacacaccttccctactctctcctgccacggcgcatcaccgcggaggagtccggctgccggatcgtgtacatctgccggaacccaaaggatgcgttcgtctcctcgtggttcttcgccaagaagggggcggccaccgttgcacgagcacgagcacgagccgacaaggacatggacatgcagctgcagcagcagccgccgtacacattcgaggaggcgttcgaactgttctgcgatggcatatgcgtctgcggcccgcaatggcgtcacgagatgggctact

SEQ ID NO: 76036 - DNA, 760 bp, Triticum aestivum
  Clone ID: PAT_TA_76036
ttcgccgtcccccccgcctcccctccgtcgtctgcagccgtcggccaccgctgttgtctatatgccatatgggaagcgggcaagaagagcacgacgaggaggcggcggctgcttctttgccagagtgatagcgcaacacggcccagccggtgacgaaggcgccggacgtgctccgaggacggccatgtagctgaacaccaggccggccatggtgaaggttggtggcagcggcgggcgccgtcgcaggaccctctccgacctgccgacatcctcctccaattcccgcacacggctccagccccgacgccagcagccgccgcgcgcgcagctcccgctgacgtcgacgccgcagcaggcggtgctcctccggacccaggttgtcatagtagtcgtcatcttcgtcgtcgtcttggtaggtagacgacttcctctgccgccgccatggcgacgggcccaggcgcaggagcgagtggagcagcagctggttgctggccgtggtagggctgtgctgctgacgctgttgtggtggcgcaagccctcgcccgtccttccgtccatgccgccggctcccggtgcccctttcagtgccggccttcatcttcgctgtaagcagccgaggtgaagcaggaatgcaggatcgcggatgccgcatccgtgaggaaggcggaacccaggccatggcggcgcgaggtcgacgcaatgtctgcgggctcgagcagctggcgtatgcggtgccgaccgatgtcagaggtggacgcat

SEQ ID NO: 76037 - DNA, 769 bp, Triticum aestivum
  Clone ID: PAT_TA_76037
ctagagcacaagaatcaaatccaagtaagtagtacctaacgcaaatccaccatgaagaccttactcatcgtaacaatccttgcgatggcaacaaccatcgccaccgccaatatgcaagtcgaccccggctaccaagtacattggccacaacaacaaccattcccccagccccaacaaccattctgccagcaacaacaacaatttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaaccgtcgagccaggtctcctaccagcagcctcagcaacaatatccatcaggccagggctcgttccagccatctcagcaaaacccacaggcccagggctttgtccaacctcagcaactgccgcagttcgaggaaataaggaacctagcgctacagacgctaccagcaatgtgcaatgtctacatccctccatattgctcgaccaccattgcgccatttggcatcatgagtactaactgagaagagaagaactctattactagatatatgaaacaccgttttcttaaaacatggtttggtcgttgtagcggtgaaaaataaagtgacatgcactatcatgtaagaacccgaactagactatttcaaactt

SEQ ID NO: 76038 - DNA, 663 bp, Triticum aestivum
  Clone ID: PAT_TA_76038
ataggcagggtgtctttttaagtgaaagttctttctaagtattttttcaacttcttgtctgggcatatattgctgtattataggatgcctgaacagcgagtcccaaatttgggaacaggacagacaactacctcccagttttgtatatatgaaagtgagcgagtcccgaatttggggacaggcaggggtccattaggaacatggcagttaatttgcataatcctcgacctcctcctgtaatctctctttgtccctttcttctctgaatttcccggtgttgtataagtctgtaatattcagattttaagagtacttgctccctgtactaggtacttctactacttatttttagctgtttagtactactctgtagatctgtgatactagtctagtcgcttgtataattttgtttattagtgtaacctgaaccattatgtgtgttctgtagtctctgtgatagctccagtacatgtgaactatatgttgtggtgtaaatcattttcattctatcttataaacgtgtttcttcaatagctatttctgttcaagtcttgttttcattgatattagcatttagtttgtctcaagtaaaaaaaaatactaaaaatacagtgaagataatctgaacctccctatgtaaaatttagtttgtctgtaatacta

SEQ ID NO: 76039 - DNA, 747 bp, Triticum aestivum
  Clone ID: PAT_TA_76039
attcggcacgaggctcacggcccgtaccttgggacgacaaccttctgttccttggcttcactgctcatcttgctcatgaaggcctgcgtttacagtccagctcaggacattgggcctgagctctcgccgtcattggcggatcacaggctaaatatgaagaagttatggggaatgcctgcgcttttcctgtcttccttgatctttgctctcggccactttgttgttgcttacagaacgagctgcagggctcgacgaaagctgcttatccatcgcattgaccctgaatcgattctggcttacaagaatgcctttcctggatgctacaaggttcctcggtcgcccactccgcacagtgggaaactttattcaaggagcgagagcgagacaaagagaaaaactcttgtgcacgatgacagggatattccaatcagttttcttgctgatagtgatagcatgttcattgcttgccaggggatcactgtacactacaaaatgtctgatccatcaagttgcatatctccagctcctgaattgtttccagaaactaatcatgatgctgtttcgtcaagcatttctcctagaagacagaggcatgagagcccaccaacagcttcctcgagtacccgtcgtcttttgcataggagctttagtcatcagtatcaccaaacatcgttatatgcaccattgttggtagaaccactgatctctccaacggtgtcagatggcatcccctttctcagtcttgac

SEQ ID NO: 76040 - DNA, 671 bp, Triticum aestivum
  Clone ID: PAT_TA_76040
gagggcctgaccctcttcggctcctccgacacctctttagagccctcaagagtggctccgttctctcctccgacctcgagggggtggtcaagcccaatgtcaccttcctgcaggagtgcgggctaggtgcttgtgacattgccaagctctacgtacttatgccatcgacgctcagcgtcagcacggaacacatccggacagcagtggcgtgcgtcgaaggtcttggtgtaccccgtggatctcggatgttcaagcacgcgctacgagctgttgcattcctcagcgaggaggaaatcaccaccaagatagagcacttgaagaaaacgttcaggtggtcagatgccgaggtgggcattgctgtttctaaggctccaggagtgctgtcgaagtctaaagaatcgctggagcgaaggttcgagttcctcatctccgaggtggggttggaaccggcatacattgcttatcgtccagcaatgctcatgtacagcttggagggcaggatgagacctcgatactacgctgtaaagtttcttaaggaaaatggattgatagatcatgaccgggacttctttaatacagtcatggtcagtgagaaggtattcgtcgagaagttcatatgccctcataaggatgctgcacctcacctcgctgatgactatggagcagcttgc

SEQ ID NO: 76041 - DNA, 264 bp, Triticum aestivum
  Clone ID: PAT_TA_76041
ttcggcacgaggtactgaagctgatttccccggagacatgggagatgtcctcccccggggcatcgtcgccgtcgaagagaagcgcggcggagctcgccgcgcatgagggcacggcgccttcttgctccggcacggcatgtctgaggtcaagtcagcctggtctgtcctcatacccaccaccatcatcatctcttagtgcaggccttctgcaatgtatatggaaagatgggctccctcactttgaactgtcactggacaatccta

SEQ ID NO: 76042 - DNA, 668 bp, Triticum aestivum
  Clone ID: PAT_TA_76042
catcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtggttatggactttaatacatacaactccctcctgttcaaaaaaaaaaaaaaaaa

SEQ ID NO: 76043 - DNA, 752 bp, Triticum aestivum
  Clone ID: PAT_TA_76043
attcggcacgagggtccgcacctgcctctccccctcgtgctcccatctgccctgccgacaccgcttgccatgagagacccagaggaagtaatggcggagaagacggaattcagggcgctgcagccttccctgtgttcttgatctggagcctgtccaacccgtcgggccccgccggcgtacctccggtcagcgcctcgatttgtcccatgcctctcgctcatccacctcgcgcccgggatcggccgccgtcggttcgttcttccggggatgtggcgctccgcctgcgttggttcttcgtggttctttcggtggtgcgtctcaccggcggccggttggtcggcaactcggcatccgttgtccgtgtcaccgtctgttggttccatcgcttcaggtacatacgttcttgttccttttcctctctaaatctgatttctgtgtttttttatttcgtgattctttgttttatttgtgaaatttgcaggtactatgattccatcatgtaatttggatcttgaggaatctcgctgacggcgagtgggagattcgctgtgtcaaatagtttcttgtggtgatggcatgcatgtctcattggcctctagatggcggtctggtatacttcgttggggtagagtggtcgattccgtcttttcctcccacgccggatgttcagtgccttgatgatgcatggaatcattaaagggatagcactactgcttagagataatgatgatgatgctacaaagagtttgttg

SEQ ID NO: 76044 - DNA, 690 bp, Triticum aestivum
  Clone ID: PAT_TA_76044
gaggccgactcgtattaagcgagagggccgcaatcccagatggacaccggcgagcaagccggcgaggagtcgtcggcgaaccgccgggagcgcctcctcgccctccgctcctccgccgccgccgctgccgcttcctccacctcctcctcgccatctgccgcgccgccgccgcccgcgtgggatctcccggagcccgacctggcgcccacctcctcggccccgcgcccgcgctcgcggttcgacttctacaccaaccccggcgcggccttctcctccgccaccgccgccgtcccgcagaagcgcaagaacgccgaccccccgggccccaatcccgccccggccccgcctcacgggaactatggtaacaattatcctcctccacaccagcaccatatggcccaatctccgatggaaggtgcgccagggaatagtccatggagaagtcctatgcagttccagactcctatgtctggataccgaggaacacctcctggacctccacctcactggaactcacattctgcttctccagctcaagatccgtatccacatcaaaccaactttgggttcagaggccctaatgttggccgagggggcagcccgatgaattatggaccaggaggtagcccgatgaattacggaccaagaggtaacccaatgaattacggaccagggggtagcccgatgagt

SEQ ID NO: 76045 - DNA, 415 bp, Triticum aestivum
  Clone ID: PAT_TA_76045
cccggcacaagtcccacagccacagccacactgcgccgcactgcactggacacacggccgcgcacgcgccgccgcggggaggcgaggagcgagagggagagagacgggggcagcggccatggtggaaggcggcagcggcgcgggggctacgtcgacctgccggcgcggcggcggcggaggcggcgtcgtcggccccgcggcacggcggtgctgcggcggcgggtgcgggctcgggcgtctcgtccggcggctgcggcggcaggggaggcaggcgctgtgcgcggccaggccggcggcggcgtcgacgtcctcgtcggcggccggggcgctccgggggtgccagtacgacccgctgagctacgcgcgcaacttcgaccagagcggcttccgccacccccacccggacgcggacgcg

SEQ ID NO: 76046 - DNA, 721 bp, Triticum aestivum
  Clone ID: PAT_TA_76046
gagggttgatttcacccaatccttcacctaccaagtcaagctcagagaccttatcagaaaaccagaaaatgttcattcgggcggttcaaaagaaatttaaggctgaccattctttgtcaggaaagtcactgctgcattgttcaactatagtcagcaaacaggggtgcaatatgaacttcaggtgatatgcactgtgaatcctgttgtggttgaaggtacaagtgttgccctttttaagaaaaatggcaaatatgagtattctcatatcaacttttgggcaacgcccaagggatcaaacttctctgcccctggtccagtactattttttgcccaatgtagcaatggtgataaagatgaggatgaaagaccatccatgtgcgtccctgtatcgagttcctggatatctgatgccttcaggtatgttttcatcacaggcatgccatgtactgcatgtgtgctgcctcgctgccagccagttcctctgttgccctgcgatctgctcctgataggtttctgaccttagtgtggccattttaggggtaagatttttctgtcatctcttcttgttgaaaaggggaaaagacatacaggccaaagcctagggcaatgaagaggtggaaaaacagaatcttttgacatgtgctgcttgaaaacatgacagtgaatatcaagtggtttgttatgacacaaacgactgacagaagagtatgcgtgctccctc

SEQ ID NO: 76047 - DNA, 588 bp, Triticum aestivum
  Clone ID: PAT_TA_76047
tcggcacgaggctccagtcaagcaatcctcgcacatctctccacctcccgaatcctctctcccccaccagcgcggcagctcgccatggacgcctcagccaccgtagccgccgggaaggcgaagaagggcgcggccgggcgcaaggccggaggccccaggaagaagtccgtggcgcggtccgtcaaggccgggctccagttccccgtcggccgcatcgggcgcttcctcaagaagggccgctacgcccagcgcgtcggctccggcgctcccgtctacctcgcggccgtcctcgagtacctcgccgccgagctgctggagctcgcgggcaacgccgccaaggacaacaagaagagccgcatcatcccccgccacctgctgctcgccgtcaggaacgaccaggagctcggcaggctgctcgccggcgtcaccatcgcccacggcggcgtgatccccaacatcaacccggtgctgctgcccaagaagaccgccgagaagtcccccaaggagcccaagtcgcccaagaagaccgccaagtcccccaagaaggcgtaggcacccattgcctagataggtcggagtagccgggat

SEQ ID NO: 76048 - DNA, 668 bp, Triticum aestivum
  Clone ID: PAT_TA_76048
atcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaatacatacaactccttctgttcaaaaaaaaaaaaaaaaaaa

SEQ ID NO: 76049 - DNA, 477 bp, Triticum aestivum
  Clone ID: PAT_TA_76049
attcggcacgaggcaatggccaattttgtgggtgtcaacgctgttgcctatgccgcgcttgtcatcgctaccgtcgcggccactcgcaagcccgactgtgcgaagacacaggaagacttcgagcactcgctcgatgccttcatggagtcttgcgactgccccgatgacatgttctctggcctcgaacagatcacccacatccacctcgcaatcgcaaaagaactacaggctgccaccaacaccgaggagaaagaggtgcatgaagagaaggatacaatagccacgccgccgatgtcggtgatggttccagccttcgaggaaaagtagatctatcaatcaattgatattgtggcttgttgttgtgatgttaattggttctcttggttattattctaatcaggtgagtcatctttggcatgaataaaatggtgaaaagattggagaactgaaaaaaaaaaaaaaaaaaaaaaaaaaaaa

SEQ ID NO: 76050 - DNA, 617 bp, Triticum aestivum
  Clone ID: PAT_TA_76050
attcggcacgaggactagtccgatctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacaccaagggtcgcttccgccttcactctgtcagggatgaggatgctaagttcaagctctgcaaggtcaggtctgtccagttcggccagaagggcatcccctacctgaacacctatgatggccgcaccatccgctacccagacccactcatcaaggccaatgacaccatcaagctcgacctggagaccaacaagattgttgacttcatcaagtttgacgtcggcaatgtggtcatggttactggtgggcgcaacactgggcgtgttggtgtgat

SEQ ID NO: 76051 - DNA, 604 bp, Triticum aestivum
  Clone ID: PAT_TA_76051
gggcgtagctgggtggctgtgggcgggcccatgattgtaaatgtgcgcctgtcccgttgctccagcctccagcctccagcagccagcagggaggccaggtgcttgatcattgcgccgggcccatccgtccgtccacgcgttcccggggatcgatgcaaggtgacagtggcgagtacgtgtgcgcgtgggatggcgcagcagccccaaagttgtactacgtggtggcttgatgagatgagaagaaggcgctgccgcctgccggtggatctcgcagagtcgtgcggggctgaggtggtggtcatgaaaggtgtactttcgtcgccggccgaggcgaattccaattccaatggccgaagacggcgacgggtccagagtccagacgcccagcggcgtggaagagagcgcaggctttcgatggtgtgatgcgtggttcgtccctttcttcttcgttcgtttctgctccttgttctgtgtttttccatggatggtttgctgaggatgagttgcgcgtccatgcaggcggcacggggcgtgaccgggtctgggaccgatacccgatgcccctgcttgccgtgcgccatgggatggggtttacctacgtacg

SEQ ID NO: 76052 - DNA, 721 bp, Triticum aestivum
  Clone ID: PAT_TA_76052
attcggcacgaggctcataacagacaccgctgagaaacggagagagtactcatcccaaggcaagaaagattcatccttctcgtatcattaccaatcagtggttctttggtaattgcgttcctgcacacgtcctttttcctcatgaagattcttgccgttgtcctacttcggttcttgcaaagagcctgacatacgcctgtttcagtgcacaacttgttcccataccctcaagcaagcgtgtacccgccaccgagctcacatggctaccagacccaccttggtgaagagagcccttcctataactggccagggcaagcggctccatctgatcgtggacctcacttgtacagctaccaagacgatcctgactgcctcaccttcctgagaggatggtatgatgctttttccggcgctcatttctctacatagcatgcattgttgggacatgcagtttgttatgtatgggctcccctttgttaggccctgctactactggctgtgctactgctaaccggtaccccgtgatggctacatgcagcttggctgggctgtgctgctgctgcttgttggagcagtgttgctactactgactgctactacgatacctgctgagacgtgtgtctactctacccttctccccttgggtgatcctggctactcaagttgaacagctttgcttgtgcgtgagtatgatctcatctgtactgtactatgtaactct

SEQ ID NO: 76053 - DNA, 632 bp, Triticum aestivum
  Clone ID: PAT_TA_76053
tcggcacgaggcgagcatttattaatttctttctcctccagtcttctctgaccctccctcccctctcccctgcgcaagtgcacagtgggtcagtgccgcggcgagctcccccagcctcggcctccccacccgatctggtcgccccccgcccgcggacgcagcccccgccaaaccctagggctccgccgcgccgccgcgcgaaggggcgcttcgctgctcgcccgcccgtgatggagcccgccccgcagctcaaggccgagccctggcgcccgccgcaccgcgccggcgcggccggcgggcgcgcggcgggggaggcgtcctccgccgtcacgggccagagcagcggcagccgcccgcggaggaggcagcgggagcctcccgcgtccgaggacgactcggcctccgccaggcccgtctccacctccggcggcggcggccaggatttgactgatgcagaagcaaagcgtttcaaggcaaataaatccagtgatgagaatggcagtttcagaaaagatgctgaagctgattcaagaaatgctagtaaggctgttgatcaaaatcctccaccaccaaagcaagatttcatccatgtgagggcaagaaggggtcaagcaactgacagccatagcctt

SEQ ID NO: 76054 - DNA, 551 bp, Triticum aestivum
  Clone ID: PAT_TA_76054
gaggccacacacatctctccacttcccgaatcctttctccagctctcgccatggacgcctcagccaccgtagccaccgggaaggggaagaagggcgcggccgggcgcaaggcgggcggccccaggaagaagtccgtgtcgcggtccgtcaaggccgggctccagttccccgtcggccgcatcgggcgtttcctcaagaagggccgctacgcgcagcgcgtcggctccggcgcccccgtctacctcgcggccgtcctcgagtacctcgccgccgagctgctggagctcgcgggcaacgccgccaaggacaacaagaagagccgcatcatcccccgccacctgctgctcgccatcaggaacgacgaggagctcggcaagctgctcgccggcatcaccatcgcgcacggcggcgtgatccccaacatcaacccggtgctgctccccaagaagacggccgagaagtcccccaaggagcccaagtcgcccaagaagaccgccaagtcccccaagaaggcttaggttccttgcttagttaggctgtagtagctggga

SEQ ID NO: 76055 - DNA, 508 bp, Triticum aestivum
  Clone ID: PAT_TA_76055
cccccgccgcggcggcggccgccgccgcccgggcaaacagcctctcccgcatcttctcctctccctcgccgccaagagtcaaacaacccaaacgcaatcgcaagaccaagcgcgcgccaacgccctcctccgcccttccgatccactcctctcgcctcgtaccccaccattcgccccccttcccatggcctaccccgccgcggccgccgccgcggccactgcctccagcttgtcaaacggcctctccagcatcttctccccctccccgccaaccgtaaaaccacccaaagccgagcccgacgcggaccagatcctccggaagccccttcgcggtgtcctcaaggccttcatcaggcagcgggaccctgataagctggtctccatgttcgtccaagcttcgtcagcatcgccgcgcttcggcgaccggcacgacctgtacgatgcagcggtgagccgcctcacttccttcggccgcccagacggtatccaggccatcatcgacgtgcag

SEQ ID NO: 76056 - DNA, 571 bp, Triticum aestivum
  Clone ID: PAT_TA_76056
tcggcacgaggagacggcaggtaagggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccgaaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggcgaagcgcgccaagagcaaggctagcagggagaggaagcatg

SEQ ID NO: 76057 - DNA, 720 bp, Triticum aestivum
  Clone ID: PAT_TA_76057
tcggcacgaggcccagctgttgctcctaacggtgctgtcagccaggttgagagcatcgctacctctcagaccgtcaccaagacagttaccaagaagatcaccgctgtcaacgtctccaacactggcggtgttgttaaggttctcaccattgctgttgagcaggtcaagagccagaccaccaccatcaaggaggtcatcaccaaggtcaagtccaacgccatctccaaggctgccgccgtcaaggtcgtcactgccgaagtccactccctcaacgtgctcctcaccgccgttgtcaaccagctcaaggatgtcgtcagcatcaagatcaacatccccgacgtcaaggtcattctcggcctcgtcatccaacttctccacgagctcgtcggtgtcgccaaggaggtcctgagcgtccttggtctcgacaacgttatcggcagcgctttcgagctcctcttccagaccgtcgccaccctcctcggcctcgtcacacagctcatcggcgacatcgttcccggtctcgtcgacatcctctccaacatcctcaacaccctttcgggcacccctcttggacccatcatccagcccgtctccaacatcttcgatggcctcactggctacctcacccagggcactgcttaagcgacacgttcaagatatgagaccagggtatgcgggatatgccccttagaagacaagacaagcatagagggagtttag

SEQ ID NO: 76058 - DNA, 733 bp, Triticum aestivum
  Clone ID: PAT_TA_76058
tgaggaaaatcctgcaacatccaggggattccatggaagtgtgaatggtgtggcgttacacttctgagggcaacgaatttgggacctccatctgattcctgctgtatcgagaatgttagcgaagatgcaacctgtggcaacatgctttgccagtggcacaaccacaagatggattgtggtggtacatatgtggtaaccaaaccacgagggcaaaggatggtccgaaaaggtggagagttgcttcttcggactggaacaactgaaatgaccaagtcacaaggagctgtacaacaatcagattcagatgaagtgcagaaagcaattgttttgtctgcagcccctcgcagtcggagaagattgaagccgaagcaagagtttgttgcatgggagaatattgaacttttgtctatggggagtcgcagtgatgcaaaatcagtgggtagtagctcctcaaagaaggcagaggatgtcctttcgagccaactgaaacggaagcaaacatctgttacatcagagaagcatgggtttctctcactagggagttgcgacaatgcaaaatcgtcgggaagtaacacctccaggaaggcaggaaagttccatgagccagatgatgttaagccttatgcatcccagaaaaaattgaagctagtgcaggacttggccgcatcggaggaatatggagctttctttctagggacttgcaacagtgcaaaaccaccacgaagcagcacat

SEQ ID NO: 76059 - DNA, 782 bp, Triticum aestivum
  Clone ID: PAT_TA_76059
gctttgctctgagcttccggtttatctttcttgatctctaacctcctccctccctcccccatcgctatgcccataattgcgacgcctgcgaacgtgggttccccgaatcctgcatccacatctttggtccgcttatgcgccagcctccaccaccaccgctgcccagccgccctggtgtgcgggtgcggcggcctacggtagcggtgacccaggactggatgggcaagaggggtcaaattctggtcaaaattgtgatgcaggtagtatgggtgatgaaattgtgtcaaaatcaaaggagccagcccctgatactgatactacttcctgtgaggaagcatcatcttcaacagcagtcaaaccaacaagattgctggctgttaacggtggcttggttctggagtcatcactgaggccggttacaggaagaaactctcatatcctgaagcaacaaaagataaatttgcttaatatagaagcagcgttgcctgaggaagctttcagagcctcaaagtctcaacaaatgagaaggcgttcatggcgttcttttgtgaagcgtgcagaatcaatctccgagatggtactggcgaccagcatgttggagagagcgataaaatccgaattcttgaagaatgattgtatgtactggtcctccttcacagtagctatcaagacctcaactctatcctcgctcgctctcaggatatacactctccgcgactgtatcatgtacaccaaggagcctaacatcgtgctggcgacaaaggttgtaaacatggggagga

SEQ ID NO: 76060 - DNA, 710 bp, Triticum aestivum
  Clone ID: PAT_TA_76060
tggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcatcctgcaagaacaacaacaggttcagggttccatccaaactcagcagcagcaaccccaacagttgggccaatgcgtttcccaaccccaacaacagtcacaacagcaactcgggcaacaacctcaacaacaacaattggcacagggtacctttttgcagccacaccaaatagctcagcttgaggtgatgacttccattgcgctccgtaccctgccaacaatgtgcaatgttaatgtgtcgttgtatagaaccaccactagggtgccattcggcgttggcaccggagttggtggctactaataaggaaagatctctagtaatatatagttggatcacctttgtttagtcgatggatatgtcgatgcagcggtgacaaataaagtgtcacacaacgtcatgtgtgacccgcccaaactagttgtttaaattctaaaataaaat

SEQ ID NO: 76061 - DNA, 649 bp, Triticum aestivum
  Clone ID: PAT_TA_76061
cttccccgccgacctgctgtcggaagccgcgcatcctccggaacaggtcgtctgccggaccgttatgtcgtgcgccgtcgcagccggccacgcgtgggaggagcgttgagctgtcgccattaccgaagccggtcgagcgccggtgtcgcaatcgttctgaggggagccgcgtgagcggagcgacctcgcggagccgagggctgtggcccgagaacgcctctgcatgcgcatctgctccctatggcgttgcctcatggagtcgaattcgaggaccggctgaaggccactgcgctcctccgtcgccgctctacgagaagataggccgagggctgtgcctgacaggtgcaacggcctcatcttccagtgcaagatgcatgcatgccaaagcatcctcgcctttgccgtcaaaggccggtgtacagccgcgttcgatgcaatctgtagggctgcgttcccgatctcgttgctcatcgcactggcgtgcagacccaccgccgtgtacggtcgtccctgccgccgcagagatgtcgccatccgcgccgggcgccggggttgactgcttgcggtttcccgctgcagcgcgccgcaccgaagggtgccgttgtagcgtatcgcgtgccacgcgccaggagatgccgcggctgttcct

SEQ ID NO: 76062 - DNA, 741 bp, Triticum aestivum
  Clone ID: PAT_TA_76062
gcccttatcctggatgtttcttctgtgttatgaaggaagcaaaccctagcaaacgaagagcaagtgtgctgaaattctttagagaacttccttcccaagatgatgatggccaagttctccctattagtggcctttggaacactgccatggcacacccaaatgaccctgaattcatcaacttggggatatttgagtgcatggcagctctaatatggaagggcctgaaaaacaggcgttggctttcacatgatcagaatatttacatcccatattatgcagcacatgttattggatcatatacgatgaatatggaggagtttgcagaacgtgctgttcgtgccggagtaatacctccattagttgaactcttaagaggtaggctgacctgggtggagcaaagagttgctgtcagagctttggggcatttggctacataccctagtacattccctgctgttgctgatcatggagaagtgcttgaacttgcaattcaacttgcctcaagctctctagaaattgtgtactctcacttttaccaattcgtagatcgaaggcttggctaccactgtgatcttcttacacgtggtatgggtggtgctgaaatggaatctcgtaaagctgaggaatgggctagccaactgcagtgctggtctttgcagctcataaactgctttgcatttaagcctgagtttctccatgatatctgcaagcctgaatttctagctaagttacctggtatgt

SEQ ID NO: 76063 - DNA, 756 bp, Triticum aestivum
  Clone ID: PAT_TA_76063
attcggcacgaggctcgcacaccaccgccgagtgaactttgatctttcataggtccgcgtagccgatgggctcgcgcgcgctcgccgtgctctgcctcgtggccgtcctgctcgtgcccgcgctcgctgtgcctggaggcggcgacgacggctgcgaggcggagtcggccgggcgcgacaaggcgcaggcgctgcggctcaagatcatcgccatcttctgcatcctcgcggggagcgcgatcggggcgggcctgccgtccctggggcgccggttcccggcgctccggccggagacggacctcttcctcgccgtcaaggccttcgcgggcggcgtcatcctcgccacggggatggtgcacatcctgcccgccgccttcgaggcgctgcggtccccgtgcctcgtgggcgggccgtggaagcgcttcccgttcgccgggctggtcgccatgctcgccgcggtcgccacgctcatcgtggacaccgtcgccacggggtacttccaccggacgaacgccaagcgggccgccgccgtcaccgacgagccggcgcatgacgacccggaatccgcccccgacgggcacgcgcacggcatgtcggtgctcgccgccccgcccgacggcgacgagctcgtgcgccaccgcgtcatctctcaggtgctggagctgggcgtggttgtccactcgctcatcatcgggatgtcgctgggtgcctccgacttcccgagcacggtgcggccgctggtgccggcgttgacgt

SEQ ID NO: 76064 - DNA, 711 bp, Triticum aestivum
  Clone ID: PAT_TA_76064
gaggctggaatggttacgagagcaggatcaacagtcagtgcaaacacacgggtcgtttacccaggttcgggccgcagagatgtgtaataccctagtcctgctttggtggttgtatatctgtgttcttgaggagctcgaactagctacagagggcgtaacttgtccaagggtccgaatccttctcctggatgccttgggtctccttttataggcaaagggatcgccacagtggcaccaggaggtggcatcgaggtactgtggctaagcttatcgctagtcattacgggacaaagcgcatttaatgcgcagcttaggtgtcccctcgctttattggggacgggagcgaggcccgtcccatccgtcgccgctcctcctcgcttcgacacgcgccttggccagcggtgcatgcggcgccatgtaggcaggcaagcagctgaggtggcgcggtggtggagccttcaagaagatctgcatcgcctccccaagatcgcagatccgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgcaagctcctggagaagaggagcgtcgatgacctcatcctttccgtcggatctg

SEQ ID NO: 76065 - DNA, 756 bp, Triticum aestivum
  Clone ID: PAT_TA_76065
gagggtggccttggtccgcgccagccggttagaatttccgagacaagaaagcgcatatgtctctgacaacctgatccaccaatcgaactcgtaccttgctttctcttcctctcgctggcggcggcggcggcatcgatgtacagcggagacgaattggagacggaaatgaagaggccaccttccccctcaactcctccgagcgacggcgtggactcagccatgtctaccgccagcattgaggacgacgaccatcaggctgtcagcgacgacgaagaggagtatgaagacctagagaaataccaaccttttaccgttgatgatttcccaagggttagtagtgagtttgatgagcaatctgatgctgtgttccaaaatcctgatattcaacttcgaggcccttcagcaatgtttcttttccggacattcaacgatccccttattgaaaaacacaagcatttcttcggtagccaatatcaactctatgatgagtctgaagtcaatgtgaacaacaatgttagggccattgattgctcacacggttgccattgtgtaccgagcggcgtgctgcagttcattgatctcaaaattgctggttatcgccacgtccaacctggatgtgccaatatatttggttttttcgcagtacgtgagaatgctgaacctttgcgcaactatgtgtacaggcgtgggattgacaattatgaagctgtaaatgtgaagcgggatacggaccattcatcgaaactcggcgtctgt

SEQ ID NO: 76066 - DNA, 788 bp, Triticum aestivum
  Clone ID: PAT_TA_76066
tcggcacgaggcgccaacctcctcgagttcgacgtgtacgacctgggagctcaccacggtgcccaccaactcccacctccgccgcctgctcgtctccaccacgcccaagtccgtcgtcgtcgtggaggacatcgactgctccctcgacctctccgaccgcaagaagaactccggcggcgccgacgaggacaacacgcagctggccatgctctccccggccgcggccgcggccatggcggcgatcgggcgcgagtccatcagcctctccggcgtcctcaacttcgtggacgggctctggtcgtcctgcgtgggcgagcgcctgatgatcttcaccaccaaccacccggagcggctggacccggcgctgctccgcccgggccgcatggaccgcaagatcgagctcggctactgcacgcccgcggcgctccgcgtgctcgccaagaactacatcggcgtcggcgaggaccccgaggacgagcccgacgcggtggtggacggcctcatggccgaggccgagggccttctggccgccgacgtgcgtatcacgccggccgacatcggcgaggtgttcatgggctgcgacggcgcaggcgcctccgccgccctcaagaggctcgtcggcgagctgcgcggcaggagagacgcgccggccgccgatacggtgcagtccggtgcaatgacagaggagaagatggagtgaggaagatcaaagacacagagattgaccagtggtaggtggcttgttgcagcattgcctggaggattgcagatgaaattaacttgaataa

SEQ ID NO: 76067 - DNA, 671 bp, Triticum aestivum
  Clone ID: PAT_TA_76067
gttcacctaccgcgacatcttggctgccacgggcaacttctccgacgaccgggtgatcgggcgcggcggctccggcgtggtgtaccgcggcgcgctccccgacggccgcgccgtggcggtgaagaagctctccaggccgcgcgacggcgtggacggcgacggcgagcgcgagttccgcgccgagatggaggtgctcgccgaccggatggggttcacgtggccgcacccgaacctcgtcacgctctacgggtggtgcctctccggcggcgccaagatactggtctacgagcggctcgacggcgggagcctggaggcgctgatctgcgacacggcggcgttcgggcgggcggcgcggctggacgcggccgtgggcgtggcgcgggcgctggcgttcctgcaccacgagtgcgtgcccgccgtggtgcaccgcgacgtgaaggccagcaacgtgctcctggacggcgactggcgcgccaaggtgacggacttcgggctggccagggtggtccgccccggcgacacccacgtgagcacggtggtggccggcacggtcgggtacgtggcgccggagtacgcgcagacgtggcgcgccacgacgaagggcgacgtgtacagctacggcgtgctcctcatggagctcgccacgggccggcgcgcggtcgacggcggcg

SEQ ID NO: 76068 - DNA, 783 bp, Triticum aestivum
  Clone ID: PAT_TA_76068
cggcacgaggctcattttacctagcagactatgaggaacacccccttgggtctgctcctcctcgtctgtgtcgccgtgttgcacgcagatgcatcgcaagaggctcggctcagaaggttcatccggtctagacggagcagtagcaatgccaacaacatagatgaaccaagggtaggaatcactaccactacccgtagccctacagagtactatgtccatgacctggccaatttgaaggccgccgataagatccatgtgctgccggggcagcctagcggcaccatcggcttaaatcagtacggcgggtacgtgaccgtccacgagaagaacggccgagcgctcttctactacttcgtcgaggcagccagcgacgcggccgcgaagccactcctcctgtggcttaacggaggtcctggctgctcatcgcttggctacggagcgatgatggaggtgggcccgttccgcgtgaacaaggacaatagaactctcagcgaaaacctgcatacctggaccaaagtggccaacgtgctcttcctggaatcgcctgtcggcgtcgggttttcgtactccaacacgacctccgaatatgactcgagcggggacaagaggacggccaacgatgcgtttgtcttccttctcaactggctcaagaggttcccagagtacaaaggccgccccttctacatctccggggagagttacgccggccactatgtgccccagctcgcagccaccatcctcatccacaatctcaacagcagtacaagaacttccataaaccta

SEQ ID NO: 76069 - DNA, 690 bp, Triticum aestivum
  Clone ID: PAT_TA_76069
tgggtgaaggtgacaactgtgggggatgaccaggttctgtttcttgggagaaggtgctccagggctgtctctgtgtctcagtatgggttgccgggtgatcgcatctttttcttggatgatgacgaagtgaatcgtgtgaaatacggctatgatgagaacaccttttgcagtgcctataacatgagagacggcaaggtctcttcccctcatccaatgatctcctggaaacgttgtgatgagatgtgtcttgcagcatggctcttccctcaggactgaatcactgaagtgaagatgttattgctgttccagctgcttccaacttggtatggtgatcagtagttaccaagcaaataaattgccttagtatgtatccagtttgaccaccttatttatctgaacttacatggtggttactatggtgcaagttgttagcttaattggtttaccgtgcctgggaaagatcctaaactgcatgactgtttatctgtcaattgtcttagcagggtgatctctgaccttttgtagtggctgtagagttgattgttcatactgaagtttggtgaacctactgctgccttttgcgattaatagtttgtaggaacctcatatgtgtgagcctacatgatggttgtattgtgcatatccaatgtggaacatgtagatgagataattattttattttgctactag

SEQ ID NO: 76070 - DNA, 669 bp, Triticum aestivum
  Clone ID: PAT_TA_76070
attcggcacgagggcaagccatttctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctagtctccaacggcgacgagcgaatcgcgtgaatgagatgagatgggactgggagacgccggcgacggaagcggaggcggaggcgttgcaggagcgcatctgggacctccacgacaagctcagccacgccatcctcgccctctccgcctgcgccggccttccggcctgccgctgccggggcgcccccaacggccacgtaatcctcaaggggcagcggccgccgcaggggggagggcacgtcgaccttgccgcggcggcggcggccatggcggacgcgcggggcctgcacgccatccgcaccgcgctcgaggaccttgagggccacctccacttccttcgcgatgttcagtcacaacagcgtgccgatcgagatgccgcgattgctagggtgcagcaaagtcgtattctccttgctgc

SEQ ID NO: 76071 - DNA, 473 bp, Triticum aestivum
  Clone ID: PAT_TA_76071
cccctccctctataacgcgcttgttcgctgcgcccctcgtcgagcccccgtggcacgcttggccgccgacacctagccgggcgcccgtagccgagcccagtggccgcgcgcccgtggccgcatgcctggccttgccgccctggccgcgcgcccgtcgtcgcgcccctggccgagccccctggcgtgcctggccgccgcgcccctggccgtgcccatggccgcgcccatggtcgccagcccgtggccgcgcgcccggccccgccgcgctcgccgcgggcgccccgctctctgcccgcgccccggccgtgtccacccgagcgacgccgccgtggaccacgagaaggattccatcgagctcctcctcgcgcgccgctgcatcgagcgaaacggcccgttcctcggcatctgccgcggctcgcaggtgctcaacgtcgcctgcggcggctcgctctaccaggacgtcgggcacgggc

SEQ ID NO: 76072 - DNA, 425 bp, Triticum aestivum
  Clone ID: PAT_TA_76072
attcggcacgagggcccccaacgttctaatacaagatcagataaaaaccaacaactttgtaatacaagatgagggctacacatgttctactcctagtccttgccctcttcatgctatccccagatctggcgaaggctaagctgcactgcacggatttcatcatagtcaaccagtgcgacgtggacgagatcacatgccaacattactgctacagccagttcaatggaaccggcaagtgcatccccaacaaaggatgccagtgtcatttctgctatgcaactccaccccagccatcgcctgctagcagctcctagtcgtagttttctctgtaattttctgtttcttcaaggtcaatgtacaacagttatgaacatgattcgtttctagtgcaacaactatggcgccataaaaaaaaaaaaaaaaaa

SEQ ID NO: 76073 - DNA, 745 bp, Triticum aestivum
  Clone ID: PAT_TA_76073
attcggcacgaggctactatgtatggttgtcatgtctgcagttgcaggtgaacttgtgagccgtttcatctccttcctgctgaacaagtaccattcgagtcggtcacactcggaggagaaggtgatggagcggttgcaacatctcctaatgagagtttgcaccattgtttaggaggccgacgtgcgatacataaccaactccgggatgatgatgcagctcaagacactatcagaggccatgtaccaaggataccatgcgctggacaacttaaggtaccgtgccctccaagtcactgcaggcttcgaagaggttagcatcaatgactcatctggcagcagcctatatttagccaagcgttctcgaagtacaaatgataaggtcacgcgcctcgagtcacatggtgccttggaaagcttagaaattgctattgctaatatgtcagaatttattgttcttctcggtggatgtgagcgcatgtcccgtaggccatatgatgtttatctttacactgaaaatttcatgttcggccgacacattgagaagcaaaagctctggagcttcttgttgcagcacaactctcctggcgatgatgcaccggcagttcttccgatcataggtggtgcagcaattaagaagaaaactttggttgctcatgcgtgggtgacgaaagggttcgctcacgcttctcctctattttgcacttgaatggagacaaccttttgagaagacctgaccatggaatga

SEQ ID NO: 76074 - DNA, 763 bp, Triticum aestivum
  Clone ID: PAT_TA_76074
gcaacaaccacaagagcaagttccatatggtgcaacaacaacaatttctagggcagcaacaacaacattttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagtacaacaacaacaacaacaacaacaacaacaaatccttcaacaaattctgcaacaacaactgattccatgcagggatgtcgtcttgcaacaacccaacatagcacatgcaagctcacaagtatcgcaacaaagttaccaactgttgcaacaattatgttgtcagcaactgtggcagacccccgagcagtcacggtgccaagccatccacaatgtcattcatgctattattttgcatcatcaacaacaacaacaacaacaacaacaacaacaacaacaacaacaacaacaacaacaacaacaacaacaacaacaacaataacaacaaccgtcgagccaggtctcctaccagcagcctcagcaacaatatccatcaggccagggctcgttccagccatctcagcaaaacccacaggcccagggctttgtccaacctcagcaactgccgcagttcgaggaaataaggaacctagcgctacagacgctaccagcaatgtgcaatgtctacatccctccatattgctcgac

SEQ ID NO: 76075 - DNA, 732 bp, Triticum aestivum
  Clone ID: PAT_TA_76075
gagggcggtgctcttcgcccaggtggcggcgctccactacgcctgccgcgcgccgcgcgccaccgcttgagccaagggccgacgatcttcgatcctccccacccaccctttagctgctcaaggattcggaggtgactgccccagtggcccctccgcctgtgttcgccgctgcggttcccccgccatcgcctccagctggccgtgctggcgcggtccccgctcccctgttgcttgctgcggggggccagccggaggtgccgcctcttgatctcaacagccccgccccaagtgagcccgagccgggcgtggtacccgtctctccgcgccgcagcccccgcatcatgtagatgtatgatggggagcgagtcagttctgtggaacgggcttccaagcaaaaggcgctggtgtccagcgccaactctgaagatgctgcggctcgccgccgtggctcgtccggcggccgtcgcaagaaggcgaaggttcaggtggttgctgggcttctgaagttgccactctctggaacccctcgccctctaacccggggcaagctcaagcagttggctcggtgctgcgacctcaacaccgaggccatcctctctcaagcagaagcttcaacatgcccttccacgtcgtccgatggctcgactgcttcctctgtgggtgctgaacttcgtctgaatgtgtaggcccttagtattgcatcagctgccgctcctacctatgctcttcctg

SEQ ID NO: 76076 - DNA, 580 bp, Triticum aestivum
  Clone ID: PAT_TA_76076
acggcacgatgtacccacggacaaccacctgctttctcgccgccgccgtcgtcctcctcctcctgccccttctgacctcctacccatgcacggtcgccgcacatcgcctgccgccgccctctcctccagtgctgctgctaggtggcgacgccagtgcttgcggccggagcgcggcgcgtgaggggaaggggctggcggtgggagttgccaggcgcttggggcataggccgccggtgtggaggcctccctcgccgagaccccaggccagccagggggtgtacacgcccacgccgccaccgccgccgtcgatcaacgaatagggcgccgggggtcatggcatgcatgcgcgggcacgcgatgctggcttccttccatcaatcaatatctcctgcttattccagggtgttgcgtggatatgcactacaggataaggaacagctagcggccgtgtaccatagcacttccgctagtgtcaaataaacttgagtctattctattagttgtacaactactcatatgatgctcacttatctccattctataaagtataataaagtacaactacggtggttttttgttt

SEQ ID NO: 76077 - DNA, 638 bp, Triticum aestivum
  Clone ID: PAT_TA_76077
ccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaataca

SEQ ID NO: 76078 - DNA, 585 bp, Triticum aestivum
  unsure (1)..(585): unsure at all n locations
  Clone ID: PAT_TA_76078
attcggccgaggctgcttcttaggatgtctgagatgcactcgaacctaagacgaggtatatgttcctactcaacaattcctacttcgtatcacaggtgatacctgagttaagataccagaccggagatgacctacttaaacttacatctgaatgtgagaagtacatggatagatatctcgatgtttcttggagacctgtgaggctgtgatgtccaggctggagctggaccgcaaacccaaatcaaaattctgtgggctgcttcatcgatcgaagtcgaacaacacctctttgtaaaactagatgaagcgtctcaaccctccgaggagagcccgtgtgctgtatatgttgatcgtacgagagaatccctctcgtgggtttacagagtcggtttaggagaagacagaagaatagatagataattaaacctaaccaaactctgtctaaactaggaataatacttggactacaagagagagagagagatgcgtgacatactatgtcacgtttacatgtttaacaccctcccttaatcacaactgcgcaagttgagattannaaaaaaaaaaaaaaaaaaaaaaaaaana

SEQ ID NO: 76079 - DNA, 725 bp, Triticum aestivum
  Clone ID: PAT_TA_76079
attcggcacgaggccaaccacgctgcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgtggaggtaacgtgaagtggagggctctccgtctggacactggtaacttctcatggggtagtgaggcggtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgctggcctgcatttcgtctcgccctggacagtgtggcagagctgatgggtacatcctggagggcaaggagctggagttctacatgaggaagct

SEQ ID NO: 76080 - DNA, 530 bp, Triticum aestivum
  Clone ID: PAT_TA_76080
tcggcacgaggctcctcaagcagggtaggatggcctggtttaggcacaaatagcactggaaatagaggacagtgtcacaaggaagctgatgcatcaaagagccttgagatgtcagcggagatgaacgtgtcatgcatctccgatcaaacatcgagcccgccggtgccgaaccttgagttcaccctagggaggacacaccattaagtaactagttaaacaacaggtttctagctagattaattaattgatctagtgtactccagcaacaatagctagatcaaggtaaagagaaagatggatgaaacatctgatcaaggccaaaggtgatgagatagaaagtgataatcagtctcccctccattatatgtgtgtgtgttgggtagagagagagagagagagagagagagagagatctaggttgctagagagagtgagagtgaagtatctgatcttgttctccatgaatggtatgctttatgtataaagtggtcttatgttgtttaaaaaaaaaaaaaaaaaaaaaaaaaaaa

SEQ ID NO: 76081 - DNA, 350 bp, Triticum aestivum
  Clone ID: PAT_TA_76081
ggcacgagggggacaagcctgatgcccagatcgaggtcatcccggttgatgcatgggtgacccaggacttcaggcccgaccgtgtccgcgtcgtcatcgccgtcgcccgcacccctaccgttggctaggtagtttgttgtgcatgaataattaataatgatgtagtggactaaagacatggatgcagggcatcagtgtatcatggatgtactttctgtttggtaaccttctaagggacgaataaaaggcattctaggcatcaacatgtcatggatgcactttctgtttaaaaaaaaaaaaaaaaaaaaaaaaaaaaaaaaaaaaaaaaaaaaaaaaaaaaaaaaaaaaaa

SEQ ID NO: 76082 - DNA, 641 bp, Triticum aestivum
  Clone ID: PAT_TA_76082
cccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaatacata

SEQ ID NO: 76083 - DNA, 539 bp, Triticum aestivum
  Clone ID: PAT_TA_76083
ctagaagaagaggataattagctagccagtcattcgccgcggcacatgccaggaacaacacagtttctgtgcttggtcgtagctcttctggtctccctgtcatgcaatgccaagcacacggatcctgacacgtaccgtgaatctatgtgggaatccaagagacaggtgcatgattttggtgggcacaactgccaaaacacttgcgtaagaaaaagcatagatactgacatatactgtgaatatatgtgggaatgcaacaaaccggtgcatgatcatgaccagcgcaagtgccgaaacttttgcgtaagcatgggctacgactacctcaggagctattgtgagcaccacccctacccgtactgctgttgccataagtaatctgaattcgatgactttggggtgatatctggatgatgatgcttgtcatgtgctacttataaagctatagttgtttgtgtatgtgtgtgtgttgatgtcatcccattgtaataaccaaagcagttcatcatgattgtccgtggaataagatgatttccctg

SEQ ID NO: 76084 - DNA, 585 bp, Triticum aestivum
  Clone ID: PAT_TA_76084
gaggacgcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacgtgcaagtgcggcaccgcgtgcggctgctcctgctgcagctgcaactgagccggcgcccaggaggccggccggcagaggcgagcacgaggatgaggaggagaagcaagcaatcatcatcaccatcaccaccacccagcgtatcagtaccactagccgccgcatgcgctcgcgcgcgcgctaaataaaataaaaccgtcatgtgttccttagttctgtacgcctcgcgtgtagtgttcgaccagtgtccctcctcatgcctccacttctagtgaatatatggcgcctcaactttgaacgatccaaaaaaaaaaaaaaaaaaaaaaaaaa

SEQ ID NO: 76085 - DNA, 729 bp, Triticum aestivum
  Clone ID: PAT_TA_76085
ttcggcacgaggctagagcacaagaatcaaatccaagtaagtagtacctaacgcaaatccaccatgaagaccttactcatcgtaacaatccttgcgatggcaacaaccatcgccaccgccaatatgcaagtcgaccccggctaccaagtacattggccacaacaacaaccattcccccagccccaacaaccattctgccagcaaccacaacaaactattccccaaccccatcaaacgttccaccatcaaccacaacaaacatttccccaaccccaacaaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccat

SEQ ID NO: 76086 - DNA, 762 bp, Triticum aestivum
  Clone ID: PAT_TA_76086
ttcggcacgaggaagagttacatcacctcaacaatcattttcccatcaacaacaaccatttccacagcagccatatccacaacaaccatatccatcacagcaaccatatccatcgcaacaaccatttcccacaccccaacaacaatttccccagcaatcacaacaaccatttacccagccccaacaaccgacccccttacaaccacaacaaccattcccccagcaaccccaacaaccacaacaaccttttccacaaccccaacaaccatttccctggcaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccatagtgtcgtgcattccatcatcatgcagcaagaacaacgacaaggcgtgcagatccggcggccactgtttcagctcgttcagggtcagggcatcatccaacctcaacaaccagctcaattgga

SEQ ID NO: 76087 - DNA, 694 bp, Triticum aestivum
  Clone ID: PAT_TA_76087
gagggtgcgtccccctacacacctgagctagggagcgagcgagggagggatggactggtacgagtggctgcgcagggcggggctcggcgaggacctggccgccgagtacgcgctcctcttcgcgcgcaacgagctcggcgccgccgacgtccgccacctcgaccacgccttcctcgccaccatgggcgtcgccgtcgccaagcaccgcctcgagatcctcaagctcgcccggaaggagtcctccgcctcggccgccatcaccgtcctgccgtggcgcgccaccaggctgctcgccgcggccgcgcagcggtccgcgcgctccctggccggctgcctccgctcggccgcgcgccggggcaggtccaaggccgccgtcgcgccgcgcccgctggcgctctgccaccagggcgtggcagggccggcgcggtggaagggcgcgccgacggccgcggacggccgggaggtcacgaagaggaagctggcggctctcctgacgcgcgtgggcaagcccatgcacactctcacgaacagcgcccaaaagccaacaacgaagaaaggcgccgtcgcgtcgccgacgacgtacatggccacggcgatcgtggccgggtgcttcgcgagcacggagacctgcgacagcgactacgacgccgacgacgatgaggacgaggacgccgagatgggcgacggcggcggc

SEQ ID NO: 76088 - DNA, 715 bp, Triticum aestivum
  Clone ID: PAT_TA_76088
cggacgaggcacaaatccaccatgaagaccttattcatcctaacaatccttgcgatggcaacaactatcgccaccgcgaatatgcaggtcgaccccagcggccaagtacaatggccacaccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccatagtgtcgtgcattccatcatcatgcagcaagaacaacgacaaggcgtgcagatccggcggccactgtttcagctcgttcagggtcagggcatcatccaacctcaacaaccagctcaattggaggtgatcaggtcattggtattgagaactcttccaaccatgtgcaacgtgtatgtctcacctgactgctccaccatcaacgcaccatttgccagcatagtcgtcggcattggtggccaatgaaaatgcaagagttatgcta

SEQ ID NO: 76089 - DNA, 756 bp, Triticum aestivum
  Clone ID: PAT_TA_76089
attcggcacgagggtttccgccgcggcatccctccccgtggcggcgcgccctcgccgcgctccaggacccgtcgccgcggcagctccgcgacaaccgcgccaggctctccgacaggcactgccactggatactgcagtcgctgggccaggccgtgcacatcatcgcgcccgacggcaagctcctctactggaaccggtatgccgagcatatgtatggctattctgcatcagaagcaattggccaggatgccattgagttaattgttcatcctacagactttgatgctgcaaacgtcgttatccagaatatatttatgggcaagtgttttagaggaaagtttcctgttaaaaacaagtcaggagagaggttctttattgttgtccataacactcctttatatgatgacgatggtagcttgattggcctcatatgtgtctcacttgatgtacggacactgcaggagatatttagtccttcaaccacagagaaatcctgtcaaagttcatcaaagccccattttcatgttaacaactggcctaaaagtggttcacaaaacaaaggttcttttgactcccagcaacctctgcaatctgctagcacctccaagataacaacttttgcgaccaagcttacaagtagagtccgttctcggataaggacgggtcagaattgtgagagacggtgtgctagtggctgtgaggatcagtattctgaacatgatgtcagggcggacctgacatcaagtgaggcaagca

SEQ ID NO: 76090 - DNA, 772 bp, Triticum aestivum
  Clone ID: PAT_TA_76090
ttcggcacgaggcctaggcacacctcacctcacacatcgccacctactggaatgcgacttctcgacgctggccttgctcacaatggaactatatcaagtttcatagagatccaaaatcagttcatcggtcccaacatcacacatgcaatagaggcatgccaactgttctacatccctgcaatactccaggagggatgggctctgtacatttgggacatgttgtcaaggatcattcacattatcgacccgggtgctggcccaaggggatgcaatgcagaccagaaggatcgtcatgagctcatagcgtcgcggctccacgacgccttgtttctccgcctaaacgattattttgctggttggcccacacctaaggaaaactggactacaaaatacccgctactaatgcaaaatccagttaccagggaagaaagtgggttatgcgtcatgcatatcattaggtaccacgacggggaaaaagcccggaatgcgcttaccaagaataccttggcagtcaccagactgtgtgccatccaggagacgatgaagcttcaagggaaccaatcatcactcccagctgatgcactatgggttgcaagtcgttcattcaggaagacctcctcaacaattacactgagcagatggtcaactactgcagaatggctatggacagttgtcacgaagatgcattggctactgcctactgcggccttgttttgaaggagaaggatcaacaaatatcagaattagagaccaaactatactctctagcgtc

SEQ ID NO: 76091 - DNA, 658 bp, Triticum aestivum
  Clone ID: PAT_TA_76091
gattcggacgagggttggcttctcctccccttccggttcgggttctggttcggttctggtccgagagtagctagcctagtctagggtttccgtagagaggaagggagagggagatccatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgcgggttcggcttcgtcacgttcggcagcgaggagtcgatgcgccaggccatcgaggagatgaacggcaaggagctcgacgggcgcaacatcaccgtcaacgaggcccagtcccgccgctcgggcggagggggcggcggcggcggcggctacggcggccagcgcggcggtggcggaggctacggcggcggcggcggctacggaggcggcggcggctacggcggtggtggcggctacggcggccagcgcggcggtggcggcggcgactccggcggccagtggaggaactgagcctcgaatctcccagttatcgatctatctaccgtgtcgtcgtcgtcgtcgtcgtcttcgtcagcaagttatcttcggtgtcgtcgtgttcctgtgtcagtctgagtc

SEQ ID NO: 76092 - DNA, 598 bp, Triticum aestivum
  Clone ID: PAT_TA_76092
gaactcgtccgcccccaaatcgacgacgggcaccagatgcggccgccgtcgccgccgcggccgctggccttcccgacgctagactcgctcgcggcgtacctccggccgcgcctcccgggcccggcgctcgcctcctggggatccgcgccggggaccaagaacctgctcaacctcttcctggagctctcctgcggcggctgcacgctcctgcccgcggcctcctccccaccggccctcgtcgtgcgcgccgtccacgtcgccaccgtgcgcatccgcaatcgccggggagcgctcctcgtggagacccgccagctgctctccgacggcacgctccgccgccgggccgcgcggccgctctccgagaagatgcgccccggggagacccccgaggccgccgcggcccgcgccgtcgtcgaggagctcggcgagcgcgcccgcgtccggatcgtgggggcggtcccggagccgcgcgtggaaggagcgggagtccgtctcgtacccaggactccccgccaggtacgtgctgcacgcggtggacgcggagctcgtggagggcgtcctggaggagggcgagttcgacacggaggagggcggcgag

SEQ ID NO: 76093 - DNA, 482 bp, Triticum aestivum
  Clone ID: PAT_TA_76093
gatgcgagccaagtggagaaagaagcgtatgcgccgtcttcgtaggaagcgcagaaagatgcgtgcccgatccaagtaatcgactcgccctccaagccacggtctccacgatggcctcttctgccgatgtcgccgtctaggtccgacgctctcgacatcaagccactgtcctgtggccgctggttccgggagtaaaggatcgtgatggtgccggaagcgcggggacctcgaggagccgcggtcgagctggttacgaggatccgagtgccgcctgctggtcttgactggactcgtctcgccttcgtcttgccgacggtagcgatcgacctcgtcatccaggagctcccctctgcctcctccaatgtatcaacacaattgccctaacccacacctacccaaagccaatcacacaccctcgattgcggggcctctcgtgaggcaccgctctaaaaaacacctaaaaaaaaaaaaaaaaaaaaaaa

SEQ ID NO: 76094 - DNA, 737 bp, Triticum aestivum
  Clone ID: PAT_TA_76094
gagggtcggttcaattaaggtatcagcagaatatgttacgaatgtgaagttcattgcgcgaaagggatggtttgtgcctgtatcatgcgatcgtgtcgtccatgtgtacaattacgaaaaggaaatgcaaaaggtcacgagtttcagagctcacgattgtcatcagccctattgctcattagccgttcatccaacccagtcgtatgtgctgtcaggatgtgatacacaaataaagctttgggactgggagcaggactggaattgcgtacagatatttgaagaacactcctctgccattattgccctaaaatttaacccagaggacaccaatagttttgcaagtgcttcgaatgataacacagtttggagtcttgattgtccgcaatctaagtatactctgcatggccattcggttgccgtactttccctggatttcttcacacatgatggtcaacagtatttgattagtggctctaatgacaagactgccaaggtatgggacatgcagaagaaatgcgttcgtacactcacacatgaggccgcagttaattccgtcgtttcccatcctagtcttcccgttctaatgacaggtacagacaatggtgctgttcatgtgtggagctccactaatttcaggctcaaggcaatatttaagcttgggatcgctgaatcggtttgtggtctcgtacatttgatggggtcaggaagggttgcagttgtacatgaaactggagtgt

SEQ ID NO: 76095 - DNA, 390 bp, Triticum aestivum
  unsure (1)..(390): unsure at all n locations
  Clone ID: PAT_TA_76095
tcggcacgagggccagttctactgcaacaacaaataccatttgttcatccatctatcttgcagcaactaaacccatgcaaggtattcctccagcagcaatgcagccctgtggctatgccacaaagtcttgctaggtcgcaaatgttgcagcagagcagttgccatgtgatgcaacaacaatgttgccagcagttgccgcaaatcccccagcaatcccgctatgaggcaatccgtgctatcgtctactccatcatcctgtncaagaactaacaacaggttcagggttccatccaaactcagcagcagcaaccccaacagttgggccaatgcgtttcccaaccccaacaacagtcacaacagcaactcgggcaacaacctcaacaacaacaa

SEQ ID NO: 76096 - DNA, 593 bp, Triticum aestivum
  Clone ID: PAT_TA_76096
cgccggcggcaggagcttcgtcctcgacgccaatcttccaccaccaccccgacgccctcgccccgcacgccgtgtcgaaccgcgtcgccatccccgtcatcgacctctccggccgccgcgcggagggaggcggccgagaccgtgggcctcttccaggtggtggcgcacggcggccatggcggggatgctggcggcggtgcggcggttccacgaggagccggtggaggccaaggcgcgctactacacgcgggacgcgggcaggagcgtccgctacaactgtgtgcttcttccgcgccaaggacggtgacggggagtggttcacaggcgcggtacaggacggtgacggcggcggagctgctggggtcgtcgagggcttcttcttcagccatatttaccttgattacgataataaacattggggaaaccaggacacaaagatgtactacttccttgatgcttgggagattcaaggctgaatgcaccgtgagagattcaaggctgcggtgacctgaaatggcccaacagaactccagactattatccttgtcgatgccaaacactcctaacttcaaaaaaaaaaaaaaaaaaaaaaa

SEQ ID NO: 76097 - DNA, 528 bp, Triticum aestivum
  Clone ID: PAT_TA_76097
gagggcgcctccggccgctgcgggctggagcgctgggcctctgccaccggtgatgcagccgtgcggtagatcaccgttggcaccatcggccgcaaccagcggctccgctgccttgtgcggtcatgccagcagcgagcggctcgatggaactttcttttctcctcctttacgcactcagatgagagcgatttgcttgtgtgcgtaggcgtacaggccttcttgccattgacgggaagttgccgatcggatcgccacgtttagcaccatggtggtggcatggatcgggtggcagcgggctgcacgccgatcggagatctggatcgtccgcatccaccgccccaatccgcgagggctgtcatccgagaacgactccatcgcgcgtagccgcagatgctctctcggcagggcgtgctgataacgtgttataaagggaaacgagagacaatcgagagagccttggaacagatgaaaaagtgaattccttgttctcaatgatgatgggttacacctaaaaaaaaaaaaaaaaaa

SEQ ID NO: 76098 - DNA, 225 bp, Triticum aestivum
  Clone ID: PAT_TA_76098
tcggcacgaggtagaaagacctatcgccaccaggcccggtcccgactcccgagggaaaggaatccagcaagccagccaggagcgcgcccccacccgccggcgacggcaacggccacatgccgaccgcctcctgcctccgcccgcctctccgcagcggccgctccgccgcggcgcgcctcggattccctcccccgcctcccccggcgcagctctacccgcggggct

SEQ ID NO: 76099 - DNA, 669 bp, Triticum aestivum
  Clone ID: PAT_TA_76099
tcggcacgaggcaaaaccattttgccagcaaccacaacgaactattccccaaccccatcaaacattccaccatcaaccacaacaaacatttccccaaccccaacaaacatacccccatcaaccacaacaacaatttccccagacccaacaaccacaacaaccatttccccagccccaacaaacattcccccaacaaccccaactaccatttccccaacaaccccaacaaccattcccccagcctcagcaaccccaacaaccatttccccagtcacaacaaccacaacaaccttttccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagcgtcgcgcattccatcatcatgcaacaagaacaacaacaaggcgtgacgatcctgcggccactatatcagctcgcccagggtctgggtatcatccaacctcaacaaccagc

SEQ ID NO: 76100 - DNA, 695 bp, Triticum aestivum
  Clone ID: PAT_TA_76100
actggcgacacgggggaaaccctcgtcgccgccggcagccgtcctccgccagcgccccctcccatcgccgccgccggagggccggccggcgaagccgcgccgcgcccggggatggcggcgacggggcggttttgtccttcccctcgtgctggacccccctccccatccccacgaacttctccttcaccatcgctcctccgcgttgctgccgccggcgggccggccggtgaggccgcgccgcgactgaggttgtgggcggcagggtggcttcgtccccttcgcgctggagctcctctcccccaacctccccgccaccccagatccgatctgccgagccgacctcccctccaactgttgtgttcatcttgccggtccgatgcggcggtgcggccgtgctccgtgctgggtcatgcgagggctcgggtggaagtggccgggctggccaaggctcagtcttgcccccttgtagaccacccttcgtctccgacggcacctcctccgagctacgacgtcgacctctgcgcgtgtgtggtgaaggttctttttggcagtgggttgaagcttcgcggcggatccttgccagcatcgctctggtcccgacggccacggaccagcgttctccagcatccatggcctgtcggcgtcccctactggtgcgatcttggccccggcgctccggacgctgtgtccccttc

SEQ ID NO: 76101 - DNA, 701 bp, Triticum aestivum
  Clone ID: PAT_TA_76101
cggcacgaggcaagaatcaaatccaagtaagtagtacctaacgcaaatccaccatgaagaccttactcatcgtaacaatccttgcgatggcaacaaccatcgccaccgccaatatgcaagtcgaccccggctaccaagtacattggccacaacaacaaccattcccccagccccaacaaccattctgccagcaaccacaacaaactattccccaaccccatcaaacgttccaccatcaaccacaacaaacatttccccaaccccaacaaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctc

SEQ ID NO: 76102 - DNA, 142 bp, Triticum aestivum
  Clone ID: PAT_TA_76102
gtcacttatggacccgacatgctctcttgtgccaagctcgagtcctcagtgttcatttaggccgtgataacaatagcttcgagctgctggaggacctgcctctcgtctctccgcacttgacaaggatggaactttgcaacgt

SEQ ID NO: 76103 - DNA, 395 bp, Triticum aestivum
  Clone ID: PAT_TA_76103
tctgctcctcccccagaccgaaagcctcgccgacgcccttctccccctccgccggcggccatggacgaccagcagctgctccttggcatctccaggagcgatatgctcgccagaatagagcgttgcggccgggatcctgcgatgctggacctcggctcaaacatgctgctccacttcgcgtacgagtacctcccggacccgcccgtctcccccaccgcgcccctctcgctcgccggcgcctcgtgggtacccgacggcgtcgaccgcatcagccgcctccccgacgtgctcctccgcgacatcatctcccgcctccctgccaaggacgccgcgcgcacccccgccctcacctcgcgctggtgcccactctggcgctcggcgccccttgctcttgc

SEQ ID NO: 76104 - DNA, 748 bp, Triticum aestivum
  Clone ID: PAT_TA_76104
tcggcacgaggattcactcaacttgagaacaaacattatctaacacaaatcaaccatgaagaaattcctcgtccttgccctcattgtcatcgcggcgaccaccacggccgccgaaccctttactgcattccgtattgcttcggagccgcaacatccatcatctccagagcagcaaccaactctgcagccacaagaacatccagttccacatcaaaagttgaacccttgcagggatgccctcctacaccagtgtagcccagtagctgatatgtcgttcctccggtcacaagtggtgcaacatagcagctgcttggtaatgtgggagcagtgttgtcagcaactaaaagcgatccccaagcagtcaagatgtgaggccatccacaacgtcgtgcacgccattattttgcaacagcaaaaacaattggtacaaggtacttcaacccaacctcagcagcagcaacaacaaggtcaacaagaacatggtcagggttctagccagccacaacaccaacaacaacaacagcaactggatcagggttggatcgtggcgatagggacatgggtgattcagaccgttccggcaatgtgcgacgtgcatgttccaccatactgagaagatgagagctctagtatccgaaaaatggaccaccaatgtttagtcaatggtccgatccatatgtagcggtgaaaaataaagtgccatgcattatcatgtgtggactagactggcactagttcaaacttggga

SEQ ID NO: 76105 - DNA, 764 bp, Triticum aestivum
  Clone ID: PAT_TA_76105
tctaccacaacaaccatatccacaaccggaaccacagtatccgcaaccacaacaaccaatttcgcaacagcagcagcagcaacaacaacaacaacaacaaatccttcaacaaattttgcaacaacaactgattccatgcagggatgtcatcttgcaacaacacaacatagcgcatgcaagctcacaagttttgcaacaaagtacttaccagttgttgcaacaattgtgttgtcagcagctgtggcagatccccgagcagtcgcggtgccaagccatccagaatgttgttcatgctattattctgcatcaacaacaacaacgacaacaacaacaacaacaacaacaacaacaacaacaacaacaacaacaacaacaacaacaacaacaacaacaacaacaacaacaacaacaacagcagcaacaaccgtcgagccaggtctccttccaacagcctcagcaacaatatccatcaggccagggctccttccagccatctcagcaaaacccacaggcccagagctctgtccaacatcaacaactaccccaatttgaggaaataaggaacctagcactgcagacgctaccagcagtgtgcaatgtctacatccctccatattgctcgaccaccattgcgccatttggcatcttcggtactaactgagaagagaagaactctagtactagatatatgaaacactgttttcttagtccatggtttggtcattgtagcggtgagaaaataaagtgacatgcactatcatgta

SEQ ID NO: 76106 - DNA, 805 bp, Triticum aestivum
  Clone ID: PAT_TA_76106
gagtagaggtagagcgagggagttccagagcattcccctcccctcctgcgcacaaaagcagagcagagcaaatccccaaaaccctagaggagaagagagccatggcggccttgatgctcctgcgcgccacgcgccgccgagacctcgcctcgccactcgccaccctgaccaccaacgtccaatcaacatatgctgctgcaaatgtgtgctccagatgggctacttttgcaagagctttcagtgcaaagccaattggaaatgaggttattggaattgatttgggaacgaccaactcatgtgtcgcggttatggagggaaagaatgcaaaggtgattgagaattctgaaggcgccagaactacaccgtcagttgttgccttttctccgaaaggagagctactcgtgggaattccagccaagcggcaagcagtgaccaacccacagaacaccttctttggcacaaagcgtatgattgggcgtcgttttgatgacccacagacgcagaaggagatgaacatggtaccatataagattgtgaaggctcccaatggagacgcttgggttgagaccacagatggcaagcagtactcgcccagccagattggtggctttgtgctgaccaagatgaaggagacagctgagtcttaccttggcaagtctatttccaaggctgtcattaccgttccagcttacttcaatgatgctcagaggcaggccaccaaggatgctggccgtattgctgggcttgatgtccaaaggatcatcaatgaaccaactgctgctgctctgtcctacggaacaaacaa

SEQ ID NO: 76107 - DNA, 746 bp, Triticum aestivum
  Clone ID: PAT_TA_76107
gaggcgcgcgtgcacgatgctgacgtgccagctgccgctactgttcacgtcgttcctgctcatgtcgctcggggcgggcggcatccggccgtgcgcgctggcgttcggagcggaccagctggacaagcgggacaacagcaccaagaacgtcaggaggctgcagaccttcttcaactggtactacaccgtgctggggatctccctcgtcgttgcggtcctcgtgatcgtctacatacaggatcacatggggtgggtcgtcggcttctccgtgcccgtcgtgctcatgctcgccgctctcatgctcttcctggccggctcgcctttgtacctcaaggcggaggccgacaggagcgtgctggtgggcatcgtgcaggtgctcgtcgccagctacaagaaccggggcgagctgttgccgccggagacggccgaggcgtcgtgcttccacaacaaagctggctccaggcccagagttcccaccaagaagatggtgtccatgaaccgggcgtgcgtgctgaggaacccgagcaaggagctcaacagcgacgggtcggcgtgtgacccgtggcggctgtgcacggtgcagcaggtggaggacgccaaggccgtcatccgcgtgctgccgatatggtccacggggatcataccctggcgtgatcgtcgcccaggtgatgttccccgtgctgcaggcaggtacgatggatcggcagatgggcaaggcgaacatccccgccgcctcctacagcgtc

SEQ ID NO: 76108 - DNA, 667 bp, Triticum aestivum
  unsure (1)..(667): unsure at all n locations
  Clone ID: PAT_TA_76108
caagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcctaagtactcgaaggctcgttatgaggaaattgtcaaggaagtctcttcgtacctgaagaaggttggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggatgtttacaagattggtggcattggaactgtgcctgttggccgtgttgagactggtgtcatcaangcctggtatggttgttacctttggtcccactggtctgacaactgaggtcaagtctgttgagatgcaccacgagtctctgctggaggcgcttcctggtgacaacgtcggcttcaatgtcaagaacgttgctgt

SEQ ID NO: 76109 - DNA, 621 bp, Triticum aestivum
  Clone ID: PAT_TA_76109
agctccaccacccgctgcacgcaaaccatggccgaccacgggaaggagcgccgcgcggaggaccagctgccacccagcagcacgggccgccaccaactgctcgccatggccagggggcagggactcggcccgtcgcgtccaggggcatgggccgccgccatccttgcgccatggccagggccgccgccagccgagctccatggccacgggctcaggtcgccacgggagagagagagagagataggccgtgcggcgagggagctcgtcggcaggagggaggtcgcggccgccacgcacgctggaagggagctccgcggcggcgcgcatcggacgggcgacgggagggatctccgcagcggcgccatggcttctggccggcgcgctctttacgtcggctgctggccggcgggccacggtgacgggcgcgctcctctcgatcttgagcacgggagagcgcgcacagaggagcaagggcccgattgctttttccataaaacattcagggacccgattgcttttctaaaaaacttacagaaatactgacatgtgggccctacatgtaaggtaacagtcaaataaacggtcaaacaaacggttatcttaaaaaaaaaaaaaaaaaaa

SEQ ID NO: 76110 - DNA, 485 bp, Triticum aestivum
  Clone ID: PAT_TA_76110
tcggcacgaggagtcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcaacaaaacccacaggcccagggctctgtccagcctcaacaactgccccagttccaggaaataaggaacttaacgctgcagacgctgccagcaatgtgcaatgtctacatccctccatattgctcgaccaccattgcgccatttggcatcttcggtactaactgagaagagaagaactctagtactagatatatgaaacaccgttttcttaatcgacagtttgatcattgtagcggtgaaaaaataaagtgtcatgcactatcatgtaagaacccgaactatactagttcaaacttgggaataaaagacatacacatgtcttgtctgc

SEQ ID NO: 76111 - DNA, 463 bp, Triticum aestivum
  Clone ID: PAT_TA_76111
tcggcacgaggcagaaaagtcttcccgtacatgagattctacctcccagcaatggaagcagcttccacgggtcaggggtaatgagctggtgtttcaagtgtttgtcaagctctagctggggatgtggtagtagtgatagtattggatcatccggttggctgcttgcagttagtaaagttgctgtttcgctgcttggctgcttgcagtttgaaaagacctttgcagtcaccgtgtgatctagtgagatatggaaaccggctatggagaaagacccaaacatcatgtagaatccgaagcgtggacagttctctcgtttttcttctctctgtttttttcccagcagaagacttgacttcatctaaagcagtcacctgtgaaagaatgttcctgtttttcagtcttctttctctttgcgggagcagagcttaaaaaatatggacagtaaaaaaaaaaaaaaaaaaaa

SEQ ID NO: 76112 - DNA, 624 bp, Triticum aestivum
  Clone ID: PAT_TA_76112
tcggcacgaggggtcgccccctcgtcggaaccgcccgccccgcgcacctacgatccccgccgccggtggtcgcccgcgaggcgagtccaggcgagtcggcggtccgtcacccgcccccgcgccgtcgccggctctaccaaggagaagatccttatgagttggttggctgtgaattcatataaattctggtactgtgaaaatgggtcaaaaggtggcaggaagttcgtgacgagattaaccatagacgattgaggcctgagtggatttaggtattctgttgtgacagcttaagtggctcttcaacttgaagacgttgctgttgccttaggatatgctcttttcagcgaggaatacagccacacactcttagattgtaatttttcttaattggattagtacaggaagatcagatacagtgaaaagggagcgcagtcgtgatggacagagctgtcggtaaccaagcaggccaagtgtcgaagaaaggaaagaagaagcacgcgaaagacgagtcagaccggcagaagcaggctgagaagaagaggcgccggctggagaaagcgctcgcaaactctgctgccatcatctcggagctggagaagaagcggcagcagaaacaggaggagc

SEQ ID NO: 76113 - DNA, 540 bp, Triticum aestivum
  unsure (1)..(540): unsure at all n locations
  Clone ID: PAT_TA_76113
ccagtcagctcaactgaaccagcagatcctcctagacctccctcatcaccgactcaccgaccgatcgccatggcgcaggcggagcgcgagtgcatgcgcgtggtcatgttcccgtggctggcgcacggccacatcaacccgtacctcgagctggccaagcgcctcgtcgccgccagccccgacgaccaccacctcgacgtcgtcgtgcacctcgtctccacgccggccaacctcgcgcccctcgcgcaccaccagacggaccggatcaagctcgtcgagctccacctcccggcgctccccggcctcccgcccgcgctgcacaccaccaagggcctccccgcccacctcatgccggccctcaaacgcgcctgcgacctcgccgcgccacgcttcggcgcgctcctcgaccagctctgcccggacattgtcgtctacgacttcctccagccgtgggcgccgctcgaggccgcggcgcgcggcgtgcccnnnaaaaaaaaaaaaaaaaaaaaaaaaaaaaaaaaaaaaaaaaaaaaaaaaaaa

SEQ ID NO: 76114 - DNA, 718 bp, Triticum aestivum
  Clone ID: PAT_TA_76114
tcggcacgagggtatgaaccaattctaccacagcaaccaccattttcgcagcaacaacaactagttctaccgcaacaaccaccattttcacagcaacaacaaccagttttacctccacaacaatcaccttttccacaacaacaacaacaacaccaacagctggtgcaacaacaaatccctgttgttcagccatccattttgcagcagctaaacccatgcaaggtattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgccattcggcgttggcaccggagttggtgcctactgataaggaaagatctctagtaatatat

SEQ ID NO: 76115 - DNA, 683 bp, Triticum aestivum
  Clone ID: PAT_TA_76115
tcggcacgaggctacggcttcggcacggggctccccgtcatcgccgccctctacttggcctacagcccgctgggccggaagcaggcacgcgaccccgacgcggagccgtcgtcgtcgggcgaggaggcgaacggtcacggcggggcgccggagaacggcggccgcgacgtggagatcaggatatacaaccggtccgtggtggtgagcaggccggagtggagcggcgggctgtgcgactgctgcgacgacgggacggtgtgcgcgctgtcggcgacctgcaccttctgcgtcttcgggtggaacatggagcgcctcggattcggcaacatgtacgtgcacgccttcaccttcatcctgctctgcgtcgcgccgctcctcatcttcagcgtcacggcgctcaacgtctacgacgacgacatccgcgacaccgtcgtggccgtgggcgtgctcctctgcttctgcggcttcctctacggcggctactggcggacgcagatgcggaagcggtacaagctgccggcaggaggtggcgggcggcgggccgcggtgggcgactgcgccaagtggctcttctgctggagctgcgcgctcgcgcaggaggtccggacggctaacttctacgacttcgacgacgatcggttcgtcggccacggggcgcgcaacgaggagggccgcgccgtgct

SEQ ID NO: 76116 - DNA, 609 bp, Triticum aestivum
  Clone ID: PAT_TA_76116
ttgatcctgttacatggagacctttgacgaattctccagaaccattagccccatcgagcttattgatacctctgctctcaatgttgctaatcagcatggttctcaggaaattttgacacaagagagctctattacaatctgttcatctgaggaaagcagagatgacagcatagcatttgctgctgatgagattactagtggtgaacagaggtgcaacaaaggagtccttgcccttggcaagtttctaccacagaagcattcctctccggcagtggaatgcaaagaagtgaagcctaagaacacccctgacaacaacccattcaagaagaggaaattacccactgaccaaggtaaagtaccagatcaaaacgagttgctaatcgatctggatgaagaagcagttgtattgtgctcatcattgtcacgagagagtgttggtccagcagaatctcttgatagaaatggagtgtcagctggattgtgttggccattgacacaagaaagtgtggcgtctattccgaatgagagatcatctaagaggcaaagtcagcaggaagctttcaggaataaaaccaacaaaaataaagatgaaaggagtggacttttgaa

SEQ ID NO: 76117 - DNA, 762 bp, Triticum aestivum
  unsure (1)..(762): unsure at all n locations
  Clone ID: PAT_TA_76117
attcggcacgaggccccatgcggaaaaaacgccaggagcggcctccccgcgcctcccacccggcgcctgccaccttgcgcccgcgcggttggccgcgcccgcgcgccctcggcatcgccccgtcgggcgctggctccccacctgcgcccatttcagagctcgcctgccacttggcaccgcgcccccgtctccgattctccgcccgcccacccatctcgcccataaatgtgccccgcgctgccccaaccctagccgccgcatcctccgccttcacctcctcctcctcccggcccgccggcatggccgccatcagcagcagcagcagcagcagcaagcgccgctccccctccgcatccaccacctcctcctcctccggcgacggaatcggcgagtaccggccgcagctggtcacccggaagcggaggtccggcggccgcgggccccgcggcggcgtccggtggatgccggcgatccgaccagtgagtgcctcggaattcatggccacgtcctactgtgtgtaggtggggttgatcctccgtatatatgggatctccgaggaggtggtgggccgtggtggcgggctggaggcccaggggcaagaggagggcgatcgttcgttccttccttcctcctcctggncccggattttgagttttgattgatggacagcgatcgaggcgcctctaggtgttgacgtttgtggttgattgggggctctgatctgcccgattgccgatttgattggtgcattgttgcgagtct

SEQ ID NO: 76118 - DNA, 610 bp, Triticum aestivum
  Clone ID: PAT_TA_76118
tcggcacgaggcataactagagcacaagaatcaaatccaagtaagtagtacctaacgcaaatccaccatgaagaccttactcatcgtaacaatccttgcgatggcaacaaccatcgccaccgccaatatgcaagtcgaccccggctaccaagtacattggccacaacaacaaccattcccccagccccaacaaccattctgccagcaaccacaacaaactattccccaaccccatcaaacgttccaccatcaaccacaacaaacatttccccaaccccaacaaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccct

SEQ ID NO: 76119 - DNA, 791 bp, Triticum aestivum
  Clone ID: PAT_TA_76119
tcggcacgaggggtattccagaggttgctacatctgatggtattccagaggttgttgtacagcaagagagtcgtcctgcggtcactccagatgttgttactcccattgtccctcctgctgttatctttggtggtttacataatccagttgttctatctagctcttcaacaccagctaaagctgttgcaaaagaaggtcatgttccagtatgcgccttgttttccaaagttaaaacaaaagattcaattgctgcagtccacccaaaggtatttctccttcaaagtctaaatgtgatatcactgatgtcgattctttcgtgttgctttcagatggccctgctaaggattgtaatgagaaagatgttgttaatgcttttgggattccttcttttgctgagcttaatcgtgctcttggtattcagtctccttctaatgtctgcaattacaccccagttcatgctcatggaaaatctcctatggaagatacaaattcttttagagacctgtcaccccttgttccaattcgcttgtcgcagtatttccgtaatgagttgggtgatgtccagtgttctcagtatgttgccgacagatatctgaagtcgtttaattcacctaatgacgaggattgtattgttatggttaatgtcgatcactctgataattcaaagccaaccaatcatgtgaacttatgttctcctgatgtaatcttgaaaactactccaaaagctattgcgaaagctcatgaggcagtagttgatgtccataaagttggtagctcaaactttgcagcta

SEQ ID NO: 76120 - DNA, 750 bp, Triticum aestivum
  Clone ID: PAT_TA_76120
attcggacgaggcacactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaaca

SEQ ID NO: 76121 - DNA, 632 bp, Triticum aestivum
  Clone ID: PAT_TA_76121
tcggcacgaggccagggtactactcaacttctccgcaacaattaggacaaggccaaccaaggtactacccaacttctccgcagcagccaggacaagagcagcagccaagacaattgcaacaaccagaacaagggcaacaaggtcagcagccagaacaagggcagcaaggtcagcagcaaagacaaggggagcaaggtcagcagccaggacaagggcaacaagggcagcaaccgggacaagggcagccagggtactacccaacttctccgcagcagtcaggacaagggcaaccagggtactacccaacttctccacagcagtcaggacaattgcaacaaccagcacaagggcagcaaccaggacaagagcaacaaggtcaacagccaggacaagggcagcaaccgggacaagggcagccagggtactacccaacttctccgcagcagtcaggacaagagcaacagctagaacaatggcaacagtcaggacaggggcaaccagggcactacccaacttctccgttgcagccaggacaagggcaaccagggtactacccaacttctccacaacagataggacaagggcagcagccaggacaattgcaacaaccaacacaagggcaacaagggcaa

SEQ ID NO: 76122 - DNA, 303 bp, Triticum aestivum
  Clone ID: PAT_TA_76122
tcggcacgaggcccggctgccgcccacacgcgtctctcttgacggaggagctagctagctcctaactggatcgattggagctggctacggcggaggagctagctagctggctggctcctggattgattggagctcgctcctggatcgattggagctcgctacggcggaggagctagctagttagctcctagctcctggatcgaatggagctggctatggctgaggagctagctcctggatcgattggagctggctaccccgacggaggagctagctcctggatttggccgcttcgtgcgctcc

SEQ ID NO: 76123 - DNA, 599 bp, Triticum aestivum
  Clone ID: PAT_TA_76123
attcggcacgaggcttcctcggcgcgctcggccccgcgcgcccctccgccgccctccagctcccggaggccggggacgagccggagccccctgccgggcccgccaagctgggcgtcgccgtggaggacgccgccgcgctgccctcgccccccgacgagcagcgcgccgagcgcgtcgcgctccgcgtcggcgagaacctcttcaatttcatgcagtccttctgcgccgccgacggcggcaagctggtggtgcccacggatatcctggaccgctggttccgcaagttccaggagagggccaagaaggatcccacctatctgaaaagctttgacttctgaaaccaaagctttaggtattccttactccattcttaggttccttgggtgcgaattggtacaggaatgcttagtctcattgcagtactcctgtaccaattggtgcggagtaggagttacaagggcgacaccacctccctggtagtttaagatcgtgatctacaagaggggctgagagggagatgtcctaaaaagtgtagtgttcttgggcctcttagttcgtcagctatgagatctggtgttaattttcattgtttgtgcgag

SEQ ID NO: 76124 - DNA, 632 bp, Triticum aestivum
  Clone ID: PAT_TA_76124
attcggcacgaggcttctcagtgggtaggcagaccctcctctctccctcctccccctccgctcctcatctccacttgagaagaagaagaacacagcaggcagaaaaaggaaaaaagaaatatatagtttatccttttcgtttatctctttgacggatcaagaacaggggagggagattggagggggaggaggaggagcaatcgggagtaaattcgcagcaagagacgagggattcggcgtggatagatagatagataaatcagttctcgcatcggtttattgattgctcattaacccagcattcccgccgctgccattcttgggaggagtcagcatggttccgtccgggtacgactgcgccgcctccgtcctgctctgcgccgaggacaacgccgccatcctcggcctcgacgacgacgaggaagactgctcctgggcggcggcggccgccaccccgccgcgcatcgccgccgatgccgccgcggcggcggaggggttcctggtggaccaccccgtgcagtccgatgagtgcgtggcggcgctcgtcgagacggagaaggagcacatgcccgccgacgggtacccccagatgctgctgcgccggcccggggccctggatttggccgccgtca

SEQ ID NO: 76125 - DNA, 679 bp, Triticum aestivum
  Clone ID: PAT_TA_76125
tcggcacgaggacttgttgaagctttgttacagagaggtgaagctaaacttctaacagaagactgggaaggtgcggttgaggatctaaaagaggctgcccagaaatccccacaggacatggcaatccgagaggcgctcatgaaagcggaaaggcagctcaagctgagcaaaaggaaagactggtacaagatcctgggcatctccaagacagcatcggccgcggacatcaagcgcgcgtacaagaggctggcgctgcagtggcacccggacaagaacgtggagaaccgcgaggaggcggagaacatgttccgagagatcgcgtccgcatacgaggtgcttagcgacgaggacaagcgtgtgaggtacgaccggggggaggacctggaggagatgggcatggggggaggcgggggcggcttcgacccgttcggcggaggcggcgggcagcagtacacgttccaccacggcggtgggttccccggcgggggcttccagttcaacttcggttaattaaaagcaggccaggcttactcttttgttgatgatggtgatgtcctagttttctagtagtgtgtcctggtctttgctttaggagggagagcttaacggcaacatgtgttaattatactatatctctagctaagagcttttactaccgtcgtcaaaaaaaaaaaaaaaa

SEQ ID NO: 76126 - DNA, 718 bp, Triticum aestivum
  Clone ID: PAT_TA_76126
cctcggctgctctagatgttggcacgtacgtctgcggcgtcggtggatctagctattgcgtcgtgctcactcctcatgttcgacgcgggaggtggtggcatcagatcttgccccgcctcgcctgtcgctactcacggcaggtggcgcgcttcatggtcaggaatcccctatcctcgccccttcgcccacacgacacaggtcaacctccccgcctccgccatgatggccaccaacagcgccgcacccgtcgccacgtcgaagaggggcgccttcaccatcttcctctcaggtggattatccatctaggacctcaggaagtcggggtagccgccatacctggagacagcggactggagcaagttgaagacgatctaggttggcgagatggtcgtcccaaaggaccatgcggatagtaattccaagctcgaccctagatgggttacactcgaaggttttccccacgagttcttccttgacatattcttcttcctgccactgccagttctaccggtttagggctttaaatcttacctatggttatttagggcatttagaagacataatttgtggcttgaagtgatgggcggttgtggacaagtaagattataccattgcgtggatttcgtatttagctgagcatgttaactttggatacatttggagctatatttgagtgtgtatccatgccttgagagatttggtgagtatgaaagcatat

SEQ ID NO: 76127 - DNA, 644 bp, Triticum aestivum
  Clone ID: PAT_TA_76127
tccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaatacat

SEQ ID NO: 76128 - DNA, 529 bp, Triticum aestivum
  Clone ID: PAT_TA_76128
tcggcacgagggctattattatgcatcaacaagaacaacaacaacagttgcaacaacaacaacaacagcaactgcaacaacaacaacaacaacaacaacaacaacaacaaccgtcaagccaggtctccttccaacagcctcagcagcaatatccatcaagccaggtctccttccagccatctcagctaaacccacaagctcagggctccgtccaacctcaacaactgccccagttcgcggaaataaggaacctagcgctacagacgctacctgcaatgtgcaatgtctacatccctccacattgctcgaccaccattgcgccatttggcatctttggtaccaactgagaagagaagaactctagtactagatatatgaaacaccgttttcttagtccatgatttggtcgttgtagcagtgaaaaaataaagtgacatgcactatcatgtaagaacccgaactatactagttcaaacttgggaataaaagacaaacacatgtcttgtctaaaaaaaaaaaaaaaaaaaaa

SEQ ID NO: 76129 - DNA, 788 bp, Triticum aestivum
  Clone ID: PAT_TA_76129
tcggcacgaggccacaacaagcatttcctcaaccccaacaaacattcccccatcaaccacaacaacaatttccccagccccagcaaccacaacaaccatttccccagcaaccacaacaacaatttccccagccccaacaaccacaacaaccatttccccagcaaccacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctcttgcaacaatgcaaccctgtgtcattggtgtcatccctcgtgtcaatgatcttgccacgaagtgattgcaaggtgatgcggcaacaatgttgccaacaactagcacagattcctcagcagctccagtgcgcagccatccatggcgtcgtgcattccatcatcatgcagcaagaacaacaacaacaacaacaacaacaacaaggcatacagatcatgcggccactatttcagctcgtccagggtcagggcatcatccaacctcaacaaccagctcaattggaggtgatcaggtcattggtattgggaactcttccaaccatgtgcaacgtgtttgttccacctgagtgctccaccaccaaggcacca

SEQ ID NO: 76130 - DNA, 709 bp, Triticum aestivum
  Clone ID: PAT_TA_76130
gagtgcatcattaaaggcaagcaagcagtggtcaatacaaatccatcatgaagacctttctcatccttgccctcgtggcgaccaccgccacaactgcagttagagttccagtgccacaattgcagccaaaaaatccatctcagcaacagccacaagagcaagttccattggtacaacaacaacaatttccagggcagcaacaacaatttccaccacaacagccatatccgcagccgcaaccatttccatcacaacaaccatatctgcagctgcaaccatttccgcagccgcaaccatttctgccacaactaccatatccgcagccgcaatcatttccaccacaacaaccatatccacaacagcgaccaaagtatctacaaccacaacaaccaatttcgcagcaacaagcacaacaacaacaacaacaacaacaacaacaacaacaacaacaacaacaaatccttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccataatgttgttcatgctattattatgcatcaacaagaacaacaacaacagttgcaacaacaacaacaacagca

SEQ ID NO: 76131 - DNA, 825 bp, Triticum aestivum
  Clone ID: PAT_TA_76131
tcggcacgaggaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcaactgcaaccatttccgcagccgcaaccatttccgccacaactaccatatccgcagccgcaatcatttccaccacaacaaccatatcaacaacagcaaccacagtatctacaaccacaacaaccaatttcgcagcaacaagcacaacaacaacaacaacaacaacaacaacaacaacaacaacaaatccttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccataatgttgctcatgctattattatgcatcaacaacaacaacaacaacaagaacaacaacaacagttgcaacaacaacaacagcagcaactgcaacaacaacgacaacaaccgtcgagccaggtctccttccaacagcctcagcagcaatatccatcaagccaggtctcctttcagccatctcagctaaacccacag

SEQ ID NO: 76132 - DNA, 724 bp, Triticum aestivum
  Clone ID: PAT_TA_76132
tcggcacgagggcccaagttcactcgtgcctccgccggcgccgtcaccgtgcgccgcggccccatccgcgtcaggcgccgggcaccccgcgtacggtatgcaccttacaggccctcggcgacggttccattgcccccgctggcctggttgggctagcgagacttctcgtcgtgcccccaccgttccagaccgccgccggcctcccctgtctggccacatcatacatctcccgcctcgtcgccgtcagctgcatatgcggggaaccgcgagacgaggtcgccgaggagatctcggctccgttctcctcattcgcgatgcaaccgggcggtgggcgttggcatgtccaccgcgcccgcaaggtgttcggcgcattgcgcgaccgcgccctcgacgagagcccactggcgtcagcgcactcatgaacacgtgtgattcagctaatcacgtctacttgctccttgtgctgtcgtgcatttaccagggacgggaatttcagaagctggaatccggaagattgttccaataggtggaggaagatacagatgaagcagctggaagccacacagaggatctcttcctgcgttcatccagcttagtgctcccacctctagttccgtacctaaatggtttgattttgaatgtgctccatctgtttcaccgtgacaattttcatctcatggtagctatccattgacgtaatcaagactgcaattcacttttccca

SEQ ID NO: 76133 - DNA, 728 bp, Triticum aestivum
  Clone ID: PAT_TA_76133
tcggcacgaggcaggaacggaaccaacaaatccccagccaatctcgtctccgatcgactccaggctcgtcggatcctcctcccccaccgcctcaagatgcagatcttcgtgaagaccctcaccggcaagaccatcacccttgaggttgagagctccgacaccactgacaacgtcaaggccaagatccaggacaaggagggaattcccccggaccagcagcgcctgatctttgctggcaagcagctggaggatggccgtaccctcgccgactacaacatccagaaggagtccaccctccatcttgtcctgcgtctgcgcggtggcatgcagatcttcgtgaagactctcaccggcaagaccatcacccttgaggttgagagctccgacaccatcgacaatgtcaaggccaagatccaggacaaggagggcattcctccggaccagcagcgccttatcttcgctggcaagcagctagaggatggccgtaccctcgcagactacaacatccagaaggagtccaccctccacctggtgctgcgcctgcgtggtggcatgcagatcttcgtgaagaccctcactggcaagaccatcactctggaggttgagagctccgacaccatcgacaatgtcaaggccaagatccaggacaaggagggcattcccccggaccagcagcgcctgatctttgctggcaagcagctggaggatggtcgcaccctagcagacta

SEQ ID NO: 76134 - DNA, 553 bp, Triticum aestivum
  Clone ID: PAT_TA_76134
attcggacgaggccgcgacgaaaatctcatctcggagatcctgccggagaggtcactgtcccaactctcaaggttcgtgctcaccaacgccatctacttcaagggcgtgtgggagacccgcttccccgaaaatctcaccgagaagcacgagttccaccgcctcggcgacgccgacccagtcgacgtccccttcatgaccccgccgggagaatgcaagctcttcgtctcacacggcaaaggcttcaaggtgctcaaactcccgtacaaggtcgccacccctgccgccatgtcgtcgcggtactccatgtgcgtctttctcccggacgacaacgacgggctgcacgccatggtcaccgctctggcggaggcgggcggttctctgctcgaccacgtgcccaagcaccgcagcagcgtgaggaagctgatgctgcccaagttcaagatgtcattcttctgccgcctcaccaaagtcctacagggccttggactccgtgatgcgttcagcgagagtgcggatctctccggcctcgcgacgaagatcgactgcgacgtg

SEQ ID NO: 76135 - DNA, 676 bp, Triticum aestivum
  Clone ID: PAT_TA_76135
ctctctgatcagatcagccacagagtcacagtagcactagcttgagctagccaccttctgccactccgggcattttcttgcatccacgaaggcaatggccactgctgatgtccagaacccggcggtcgcgctgacggaggaggcgcccgcggtggagacacccctggtcgccgaggaggtcgcgaagacggaggaggcccccacgccggcggtggccgaagtcgaagcgcctgctgcccccgtcgaggttgaggagactaaggaggaggcgccggccgccgctgagacggaggagaccaaggagcccgagcccgcagctgcggccgagccggaggccgaggcgccagccgtggtcgagacagagaccaaggaggccgtggctgaggcagagccggcggtggtcgaggaggtgaaggaggaggcggcgcctgctgccgagccggaggttgcggccgtcgccgaggaagcaccggctgctgcggaggaggcacccgcggccgcggcagaggagccggccgccgcggtggccagcgtcagcgtgtgaggcgccggcgcgcgcggacgaggagctggctgtgtcagcgtccacggcggcagccgtgtgctcctacgtggcacggcgtgatgctcagtcagccagtggagtggactggagtggagtgctactttttactac

SEQ ID NO: 76136 - DNA, 582 bp, Triticum aestivum
  Clone ID: PAT_TA_76136
caccttggcggtgcggcatgctggagcaccttcgtcttctttgtacgaaacgccaacgctggctatgcgggatcccgcgacgaccgcttgccgtgccgcttaggcggtggtttggccttctatgggccactgtcgaccggcccatgccctccagcaggccgtgtgagcgtgaagacggcgcgacagacaatggtcttcgcggcggcagaaggaggccgtggcggtacagagtggtctccggttcgccggagaagcagcaagaagatggccggaaggaagggcggcgagaggaagaaggcggtgacccgctccgtgaagtccgggctccagttccccgtgggccgcatcgggcgctacctcaagaagggccgctacgcgcagcgcgtcggctccggcgcccccgtctacctcgccgccgtcctcgagtacctcgccgccgaggtcctggagctggccggcaacgcggccaaggacaacaagaagacgcgcatcatccctcgccacctgctgctggccgtccgcaacgaccagaagctcggcaggctgctcgccggcgtcaccatcgcccacggcggcgtcatc

SEQ ID NO: 76137 - DNA, 754 bp, Triticum aestivum
  Clone ID: PAT_TA_76137
attcggcacgaggcaactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaataaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctc

SEQ ID NO: 76138 - DNA, 463 bp, Triticum aestivum
  Clone ID: PAT_TA_76138
ggaatggggggagttgggaagacagagttcctactacaatcgaggtggtggacccaaaactttccgtgcaatacgtttgtgaatggcacgtataccttccaactctgcttcattttctgcattatgtgggagagtttgttgacctggtcctttgctctgaatcttctcgagccattgagtacgaaagcccgcatcaggaccgcagaggtccggggccaccgctaagagcacgttgaagccgtacactcagaaccctagcccgtgtgttgtagggtgtgtatcaggccattatgggcaaaatggagattgctctgtccgaggcggctgaagccgtgagtgaggaggttgctaagaggtccatggccgataccatcgaggccgcgtagctgcacatgtggtcctcggagatgaggtccgttgactcgaccgctgcatcggtgtcttccccactccccccattcca

SEQ ID NO: 76139 - DNA, 677 bp, Triticum aestivum
  Clone ID: PAT_TA_76139
ccgtggtcgccatgctaagctccgaatcgaccccatcctgccatcgcttcatctggacgggaaccaagcctcctcagccagcgccatgcccgcgcctcccgaggagttcgtcgcctccacctcattcccgccagagcaagccccaccgcgccgccctgcgcaagccgctggagcctgcttccacccgcgcggctgcggcatctgctgcctcggcccctcgccgagctccttgagtcccactgctgcctcaagtaccccgccatcctcgtcttcttgcgtggccagtcgccgtccaagccgtttcgggccagatccgccgtcctggagacctgcgcccctgccggacctcatctgcatcgcctctgcctcgaacgtcttcgttgaccgcgtccctgcgtcgtagctccctcctgtcaagcatgggctcgatcccctgttttccctgcagcgaaggaaccaggcacgttgacctctcctgggccggcctcgcctcggtctgcatccgcagcccagccggtccacctcaccaccgagcgggccaaggcccactgggtgaggccacaccccagcgccccactcttttgttttttttctattgggcttgtctcagtttcgacccatatagtgtttttccctgtctgcaaatttgagctattatccagagtttgcccgtttta

SEQ ID NO: 76140 - DNA, 814 bp, Triticum aestivum
  Clone ID: PAT_TA_76140
attcggcacgaggcacgcagtcgagtcgctcgcccttcatatcaagggcactcggccgcccaagctggtggtcaggacggtacgcgggcgccgcgcagtggaggagcttgtcgctcggatggcacatcgccgcaggcgagagctcgctgcgctcgcggatcgacacgccgtctctcggttcgggcacaaaggcaggatccagtccatgcttcgtctaaagctgctgcgtcacggagatgctattaacgatgaagtgtggaatctactaagaccggttaggccacacccaccaaaatgcagacctgaggcatcgagagacgatagcagcaagacagattcacaagatgcaaatgaatgtagtctgcaaaataatagggctgatgaacaacatagtgatgatagaaatccatctgcggagaagtctattgggctagcaattgagagccttgttaactccgacggttcaggaaatcgacaatatgatgagaagatagacacaaagggaaatcaatgtcaggaagatcgtgtaaacttggtaaactcgtgtgttcactatcaagaaagttctaaagcttcaaactttgcaaggtacgatgatcatcgtgttgtctacgataatcaatatatggatgatatctccccaagtaccataagcacatcgtgtgaactccaagaaactccttcatcaagaggtgaaactttacgagaagaagacaaccaaagtctgaatggttcttgggacgagagagcactatggatgagcagtcttggttggcctgcaccagtagattccatgagtccggacagctggcat

SEQ ID NO: 76141 - DNA, 258 bp, Triticum aestivum
  Clone ID: PAT_TA_76141
ctccccaacccctcagacctagggttccttccggcgagcccccgcgccaatgtcgagcggcggcgacgattacaagcgcgaggagtcggtggcgctcattgtcatcgtctccctcgctgcgctctcgctcctctctctcatcgccgcctttgcctactactgctacatcacccgcaaggtctcccgccgcctcaactcgcacccactccccaagcgctcctcctcccctcccccgctgcccctgccggctcccgtggt

SEQ ID NO: 76142 - DNA, 672 bp, Triticum aestivum
  Clone ID: PAT_TA_76142
ttcggcacgagtagacacccaccaccatggccatggccaagctcgccctcctcattctggtcgccgccttcctcgctggcaccagcaacggggattgccgctaccaggtcgaggtcaagatgacggcctgcctttgcctttgagtgccacagatgcacaaatctacctccagctgtacaaccaggaaggcagcggcgtgatccacgttggcaaattcgactacggcagcaacacggtcaccttcagggactcgaaatgtttggagccgtgccgcctcatcttccgcctttcaggaaacggtttgctgaaccagttattctgccagtatgtcgacatcaccgtcgttggggttgggggcaacccgtactcccggcgtttcctagtgtatcagccggttctccttggccagcccatccagaaatcaatgtgctaactagcacggcggcgccttggactgtacgtcgtgattgcactgcatgtatttccgcgcttttttcatcctcgttgtcgtcgtcattgtttttgttgttgctgctgcttgcattgctaccaactttaggttagtgagcttgattccatattgtctgccgtcgtttgtattcaaatcaatcattgttattttctcatttgaataataagcggaaagattctacaaaaaaaaaaaaaaaaaaa

SEQ ID NO: 76143 - DNA, 715 bp, Triticum aestivum
  Clone ID: PAT_TA_76143
ttggttaattatatcagctgccacaagttttttacgtggcgcgcatggccacggcaatggacgccggcgtgctgcaccccggcgccatcgtggtgacggtcgtggcattggcctcggcgtacatggtgtggttctgggcgctgtcgaggcggctgtcggggcccccgatgtggccgctggtgggcagcctccccagcgttgtggtgaaccggaagcgggtccacgactggatcgccgacaacctgcgcgccacgggcgaggcggcgacgtaccagacgtgcatcctgccgctgccgttcctggcgcggcggcaggggctggtgacggtgacgtgcaacccgcggaacctggagcacatcctgcgcgcgcgcttcgacaactaccccaagggccccatgtggcaggcggcgttccacgacctcctcggccagggcatcttcaactccgacggcgagacgtggctgctccagcgcaagacggcggcgctcgagttcaccacccggacgctgcgccaggccatggcgcgctgggccaaccgctccatcaaggaccgcctgtggcgcatcctagccgaccactgccacgccgccgccagcgtcgacctccaggacctcctcctgcgcctcaccttcgacaacatctgcggcctcaccttcggcaaggaccccgagacgctgtcgccgggcttgacggagaaccccttcgccaacgcctt

SEQ ID NO: 76144 - DNA, 815 bp, Triticum aestivum
  Clone ID: PAT_TA_76144
ttcggcacgagatcacgcacaagccagccaggaggacgcacacgcactagagcgcgcgcgcgcgcgcacgccacgtattggtgaacagaacaggcgcagcacgacgcgcaggatgagcctgtcgccggcgccggaggagagctacgcgaggctcggcatcggcttcggcttcgggcggaggtggcggcgggcgagggggttccgactcggcgcgaggaaccggttctcggtgcggcggctgcgggccaagctgctgacgttcatcggcctcgtcggccggcacgcgcgccacctcgccaggaggatctccaggagaggcggcggctcctgcccatggagcggcagcgcgaggacgctcgtgggcggcaacgggtcccagcggtggtgccctccgggcggcgaggcggcggccaagaagcagcagcaggcgccgaggagggcagcgtccttcatgcggaccaactccttctacgcgcaggccatcgccgagtgcctcgagttcatcaagcgcaactccgtgccggtcgaggactacggcagcgccgtcgtcgcccgcggcggcggcgccgtcgggagatagaccgcatcgatcgggactccgtttggatcgcgtgggcagtggaacaactagctggaacaaatgtgtgtacgcacgtcccggtctcccgagtcgatcgtcgatggagtctcgggatgtgaaactagctagcatagtgtactgatagtacataccgatggagtacagaggtgtaaacacgttgtgaaatttgagttgcgtatgttgaaatttttgcggggctgtgattacttggccg

SEQ ID NO: 76145 - DNA, 711 bp, Triticum aestivum
  Clone ID: PAT_TA_76145
attcggcaccaggcgggcgcgagggtgtggccgcgcacagggtgcaccttcgacggcagcggccgcggccactgcatcaccggagactgcgcgggtgcgctctcctgccgcgtgtccggcgagcagcccgccacgctagccgagtacacgctggggcagggcgggagccaggacttcttcgacctgtcggtcatcgacggcttcaatacgcccatgagcttccagcccgtcggcggcgcgccgtgccgtgcggcgacctgcgccgtggacatcaccagagagtgcctgccggagctgcaggtgcccggagggtgcgcgagcgcgtgcggcaagttcggcggcgacacctactgctgccggggccagttcgagcacaactgcccgccgaccaactactcgaggttcttcaagggcaagtgccccgacgcctacagctacgccaaggacgaccagaccagcaccttcacgtgcccagccggaaccaactaccagatcgtcctgtgccccgcccgaaatgatttgcacatggatcagtaagtagaggatgtattactcctagtagtcttcctcttacttattatgatcatccatcattctgcgtgtgcccatattatatactccgtatataatgtcacatatgtgcgtgcgtgcatggccggtgcgtgccattcagcgaataaatgtataaataaaatggaagtgtaatttcta

SEQ ID NO: 76146 - DNA, 658 bp, Triticum aestivum
  Clone ID: PAT_TA_76146
tggtgtgtccatacatatgtctatatatacagtggaactccaagtgagtacgaatcaaatgaatgatgccccaagagctcgggtgcatttcaaaatgttctattcctcccacattcagccaactggagtatcctgctctcccttctagaggttctacagttcaatcgctattttacaaatcagcaacgcaagggcgaaggaggcagttgtcaccgactgcggggccggatgtgtcggacgcgcgcactcgcccgcagtcaacgcagacatacttagcgaccgtccatggcgacgagcggctccggggtgtggctacggggttgggtggttcaagcggccacttctgcagctacatgggatttcttcaggaccatcagcagaattgttcaggaagcataccgagcaggccatatattcaacaaacctctgtaacgatgcactctgtcttttcttgaacacgcaccaggtacatctcaaaaccattttctgtaatcgtggaaccaagtttggagctgaaatgtttccagttatccagagacaaaaaaagggcagaattgagtgtacgtgcttgtaactatgagccttcttctgtataaagatgtacactacacacacatattatacaatttattagaagacaattcttctaaaaaaaaaa

SEQ ID NO: 76147 - DNA, 521 bp, Triticum aestivum
  Clone ID: PAT_TA_76147
tcggcacgaggagcttcagcccgtcggcggcgcgccgtgccgtgcggcgacctgcgccgtggacatcaccagggagtgcctgccggagctgcaggtgcccggagggtgcgcgagcgcgtgcggcaagttcggcggcgacacgtactgctgccgtggccagttcgagcacaactgcccgccgacgaactactcgaggttcttcaagggcaagtgccccgacgcctacagctacgccaaagacgaccagaccagcaccttcacctgccccgccggaaccaactaccagatcgtcctctgccccgcccgaaatgatttgcacatggatcagtaagtagaggacgtactactcctagtagtcttccttgcttattatgatcgtcgatcatttctgtgtgtgcgtgcgtgcgtgcatggctgctttatctctttttatctgcttttatctaccttttgtgtatcttttgtagctaagacaaagaggtagctgcacgttgctatccaaaaaaaaaaaaaaaaaaaaa

SEQ ID NO: 76148 - DNA, 606 bp, Triticum aestivum
  Clone ID: PAT_TA_76148
tcggcacgaggcgcgtacgagggcgagcggctggagttcggggacggcgcgttccggagcctgcagaagctgaggctggggctgccggacctggaggagtgggcggtgagcgcggggtcgatggcggcgctggcccggctgacgctgctccggtgcgccaagatggagatgctcccggaggcgctgggcgggatgaaggagctggaggaggtggtgctgtacagcatgcccaagatggtggggaggatcaaggaggacggcggccaggaccaccacaagatcaagcacgtccccgtcatccagaccatctggtagacccgatcggcgttcgtctgtgtcatcggatcaaggaaggagaaggggggcattcttgtcgttctggtgttgttaccatgacccttcttctgtatcgtcgatccaagcacgttgtgtgttctgtgtccgtctctgctgttcttgacaggaacgcgaaagcctctgcagttttaaaactttgtatctgtgggagtgactatagctccgacactggttaccagcacgaattgcaatttttatatggaccatcgtcgtagagaaaaaaaaaaaaaaaaaaaaaaaaaaaaaaaa

SEQ ID NO: 76149 - DNA, 766 bp, Triticum aestivum
  Clone ID: PAT_TA_76149
ccacctgtacgagctcatggccggcgtgtacagaggagcttgttcccggtggttcctagctcatggccgcatccaaggacccccgccggggccggagctccgccaaccgcgtccatcgaccagatctgggcgtcctcagtaacccctacgctgcctgcctccgtatccgcttcaagcccggccgccgagatccagagatcgagcggatcgatcgatccgccgagcatctgccaccgcaatccacgcggacctcgctgccggcgcctccctttccacgggcggcgacaagctcgaagtgcctcgcccctgcccacgagcagccgatgaactcgcagctgcgccacatctgacaagtctccggtggcacctgggcgcgtgcatccaccacgggagcgagctcctccaacagaacagaggaccctagggacgcgcatggaggttggcccccatccacggcgtcgagcggcgctgggcgtccccggcagacggctgaggcgcggccacgccatcccggcgggcaccgccgtggcttgaaggcagagctcccggcggctgcctccgcgaagtccacgccatggacgctggacgggagctccagctccccggcgggcgttggattccatccatccacagccgcccccacagctcgccgccgccagttcatctgtgcgccgggaaccaccgccgccccctcttcgtcccctgtctctctcccttctcccttctctctctctctcatgcagctcctcttctctctgcctccagc

SEQ ID NO: 76150 - DNA, 767 bp, Triticum aestivum
  Clone ID: PAT_TA_76150
aacggcacggaacgctgcagttttccaatcagcccctgaccgaccacatatttggaaaagctttcccacttgtgctatcccttttacgcgtagcccccagcatctcgcgtgtgactttcgccggagctacaatatgaatggtcaaaccacgatggggctcgccgccgccgcgaggccatgccgccagcgcctcctcacctccgcctcagccgcggccgcgaaggcctctgtgatccggctcttcccaagatgcccccacccgcaacaccaccaccacggccgacgcctcccgttcctcgtgtcggcggcgtcgcatacctcgcagcccgacccgagcaccacccccacccccacccccgtaacctccgatccccgttccgccgtcgctggcaacctccccttcttcgaccgcgtgctcttcccgggctccttccctccggagaccccgcctgtggaggacccagcgccgccggctgatgaacgtccggcgtctgcttcaccggtgagagaggagacggagacggagagggaggcatggaggctactgagaagggctgtggtgagctactgcggcgagccggttggcacggtggcggcggaggaccccgagtgtacggagatgcttaactacgatcaggtcttcatcagggactttgtgccctccgctcttgccttcctcatgcgcggggagaccgagatcgtccgcaatttcctcctccacaacctgcagctgcagagctgggagaaaactgttgactgttacagcc

SEQ ID NO: 76151 - DNA, 302 bp, Triticum aestivum
  Clone ID: PAT_TA_76151
ttcggcacagatagccactgcccagcgagcggcccagtggtagcgtagctaagctaagcaagtgagtgtgcactgcgtgtgacacgacgaccggttggtccatcactagcgcgctagctagacgcacgctcgcacgtgtctaagctacccatctcctccgtcgaccgaccatgccggccttcgccgagccagccattgatccgcctctggcggacagctaccgcgcgctgctgcgcaccgaccagctccgccgcggcggcattgcgcccgcgctgtcgccggcggtgccggagagcgtggcc

SEQ ID NO: 76152 - DNA, 674 bp, Triticum aestivum
  Clone ID: PAT_TA_76152
tcggcacgaggagagagagagagagagagagagagagagagagagagagagagagagagagagagagagagagagagagagagtccctgactgacagagagagagagagcctgccccacgccaactccaccgaggacgagctcctccgcgtgttcgcagccaagggcctgggcgcgggcgacctggtggcgctgtccggcgcgcacaccatcggcttcgcgcactgcgcccatttcctgggccgcctctacgacttccgcggcacgcggcgggcggacccgttcatggacgcgcggctggtgaaggcgctgcgcatgacgtgcccctacaccggcggcagcgcccgcgcggtggtgccgttcgacgtgagcacgccgttccagttcgaccacgcctactacgccaacctgcaggccaggctgggcgtcctgggctccgaccaggcgctgttcctggacgcgcggaccaggccgctcgtgcaggagctcggcgcggacaaggcccgcttcttccgggccttcgtcgccagcatggacaggatgggctccatccgggtcaagaagggcaagaatggagaggtcaggaaaatctgtagccagcacttgtactaagtagattgccggtcgttaaacgatagtagatgatgagctgatgatctcttctgttcacggcta

SEQ ID NO: 76153 - DNA, 659 bp, Triticum aestivum
  Clone ID: PAT_TA_76153
gattcggcaccagaaacaccagaaggggatggcaagcccacaccacatcgcgatggagctcgtcggtcccaagcccggcggatcctcctccgcggtcgccgtccaccacatgttcgtcgtcttcgtcgacggcgtcgagacggacatccacgagggcacgctccacggcagtcccggcaaggtcaccgtcaccagccccgggaacctctccgccgacggcctccggagcgtcgtcgtgcgcggcgggggagggggcgccgtcgtgttcaccctgtgcggcgacgcggccgccgagggcgtggggtccgcgtccttcgtccagtgcggcgcgacgcgcgtcgacggcgcgcgggaggtgtcggtctcgcggtgccggtccctggacgcggagcaggccggcaaggtgacggtcgagaggtgccgggaggcgcggctccgaggcggcggcctcctccgcgtgacccgctgcaggcgggcggacgtcgagagcttcggcgaggtccgcctggcgcgctgcaagggggtgcgcgccgactggtgcggcagcttggaggtccagatgtgcagggccgtcgacgccagccggtgcggcgccgtgagcggcgaccggtgccgccgcgtgaacgtcgccggctgcggcagcgtcgccgtgacccacg

SEQ ID NO: 76154 - DNA, 702 bp, Triticum aestivum
  Clone ID: PAT_TA_76154
ttcggcacgaggcaactcggccgccggcggcgcggtgcagctgcgcgcgtgcttcgtccgctacggcaacgactcgttcctcgggaagccggacaacacggtgctgttcaagaagtgcggcggcgagagcggggacgccggcgtcgcggcgctgcgcgacgcggcgctcggagcgctccaggccgcgtcgtcccccgcggccggcggctcgtaccgcgcaggcgcggccgggtacgtgcaggccatgtcgcagtgcgtgggggacctcggcgccaaggcctgcaccgactgcgtctccgtcgccgcctcgcagctcaaggccggctgcggcgacgcctccgccggggaggtctacctcggcaagtgctacgcgcgcttctggtccaatgccggcaccggcaccggcgggaccacccccggaggaggcaacgtcatcggcggcggtaacgccggccccatcggtgacggcggcaatggcatcgctggcggaggcaatggcatcgccggcggcggcaccgtcggcgtcccgggcgcaggcagcggatacggatacgggttcgtgccgcgtccgtacggcgacgtccaagatggttccgggaagaccctcgccatcatcatcggcatcgtggcggcggcggccatcatcatcatcttcctctccttcgttcgaagagcccgcgccgccaatggcaaaagctaagc

SEQ ID NO: 76155 - DNA, 660 bp, Triticum aestivum
  Clone ID: PAT_TA_76155
tcggcaccagatcgggttcgcgccaatgttcgccggccacgccgccgcggccataccggggctggagctcggcctgtcgcaggagggccacatcggggtgctcagccagttctaccaccaggtcggcggcgccggcgccagcgggcagctgcagcacccgcacccgcaccagcaccaccaccacgaacagcaccaccaccagcagcagcagcagcaggaggacggggaggacgagcgcgaggacggcgactccgaggaggagtccgggcagtagcaggctgttgtccacttgttatcaccacagctgtctctgttaatttctgcagaaggagaaacaaaggaaggagagaaaactgtatgcacgcagctatggcgacgctttgattacctttaggttgttgttgtgatgagtttttatgtcgatttttttcacttgtgctgtccaaactcaaaagaggcttcttgctctggggttttagtggaatggatcagggtcatcctcagctcctactcctgctgctcctttgatcatcgccagaattctccgcattccggttcaggtgtataatagctgagagctggatgatttcgatcgtccgcccttgagtgagtgccttatttgttgttattgcaaggtgtgtagatattcaggtaattttg

SEQ ID NO: 76156 - DNA, 787 bp, Triticum aestivum
  unsure (1)..(787): unsure at all n locations
  Clone ID: PAT_TA_76156
tcggcaccgcccttgtatcccacacaccgccgccacccaccacctcctagcctccctcctccatagctcaccgccggccatcccccgcccctcttctcacctcgcagattcagcagctgccagatccaccgcatccccaacccatccacccctctcgcaacccatctctctcgctctctctctcggcgaccaacatccggtgattccagcgatgactgccgccgcgcagcaaactaacgagctggtctacgacccctccgtcctccattctggctggatccgctgctcccggtctatggcgctctcccgtgacccctagacatggctagggtttcagctgctgcgtagcatccatcgccgtttcatctctggcggatcctcgccgtcgcacagcgcggccctcacgccctatccgcctcctggatggcgctccctagctcggtgcgctcgtgcgtgttgggctggacagcggcgacctcgacctcttctgccacgtctccgccccggccgtgtatctatggcgacctcctctgccgcacgccggcggtggccggcttgcactgcaacccgtgcatcatctacaaaccacttcagcactgcnggttgtgattgttatgctgggtacgatgctcctcatggtcccagtaatgcggctagtatggaagaggcactagatccttgtggtcacattccttgagctctcgctgatggaggataaatggaaacaagtgatcatctagtggagaaaaaggggtaccaagtagagacaaactgcagggtacctagt

SEQ ID NO: 76157 - DNA, 700 bp, Triticum aestivum
  Clone ID: PAT_TA_76157
tgcccccgtccacgtcaacctgcgccagggcacccagatcctcaactacatccagagccgttcaaggccacggccgaccgtgcacatctcgccgagcaggaccgtcgtcggcaagacgccggcgccggccatcgcctacttctcctccagagggcccagctccatttctccaaacattctcaagcctgacgtcaccgcacccggggtgaacatcctggcggcgtggccgcccaagtcgtcgccgacgatgctccctctggacaagcgctccacggagtggaacttcgacacgggcacgtccatgtcgtgcccccacgtcaccggcatcgtcgccatcctcaggtccgtgcacccgacctggtcaccggccgcagtcaagtccgccctcatgaccacggcgtacgtgcacgacgacacgtcggacgccatgctggccggtggcacgcagaaggccgcggacgccttcgacaccggcgcggggcacgtggacccgctgcgggcgctggacccggggctggtgtacgacgcggacgcgcgcgaccacgtgcgcttcctctgcggcctcggctacacggaggcccaggtgcggcagatggtgctctcctccccggcgctcgacaccagctgcgccggcggcgccattggcgacgccgacctcaactacccggccatcgtgctccccgagctgcgggctgcggcg

SEQ ID NO: 76158 - DNA, 762 bp, Triticum aestivum
  unsure (1)..(762): unsure at all n locations
  Clone ID: PAT_TA_76158
attcggcacgaggtctcgccgaccctccgctgttgcaactcgaatccatggaggactctgggggcgtgctggtcggcgccctcggcagcaagatcctcgccctgtggcagccgacggcggacgggcagctcacgacccacgccgtcgcgtatggcaccgacaccgataagctggccgtcggccccccgcacccggacgcgctgctgaccatgcgcttcgtcgtcgccgccggggagcggctctacgcgctgcacgagggaggcctgcactgcttggagttggtatcggagtcggactcggactcggacgagacgctgccgtctggcgcggacgaggcggaggagcaccggtgggcgtggacgagggtctcgtcgccgctgcggctgccgggctgcggcggcgacccggaggaagacgacgagcccatcgagatcacctcgtacgcactgcaccccgacgggcgcaccatcttcgtgtccgcccacgcaaccgcgccgtggcggctacgcgggcaccttctcactcgacacggctggtcggcggcggggacgccgagtggacgcctcgcgggcgagtggctgctgccgttccagggccagggccactacgacgccggcctggacgcncctgggtcgggctccactcgccggggtacatgtgcgcctgcgacgtcccggcgcctgtcaccaacgggcaccacagcggcgacgcgccgcggcagccggcctgggagctcgtgagcgcggccagcctgctctacgc

SEQ ID NO: 76159 - DNA, 414 bp, Triticum aestivum
  Clone ID: PAT_TA_76159
cggcgtgcatgcgctggaggacgctggtggccgacccgtccttcctccgccgccgctggccggacggcgcgcgccacccctcctcgctcctcggcttcttcggccaggagtggtgccgccgccccggcggagaggatcgcggggacgtccctgattcgccgggcttcgtccgcgcgccggggtcggtcctcgggtccgaacaccccttcctgggctccttcgtgcccggcgccgccggcatcttcgaccgcgcggtgccgctcgcctcgcatcgcggcctcctcctcgtgcgcttcgtcccagccggcggcgcgggcgcggacccgagcgccgacgtggaccgcctggccgtgtgcaacctgcactccggcgcatgcgacgtgctccccccgctcgagcgcgggctggttcttc

SEQ ID NO: 76160 - DNA, 392 bp, Triticum aestivum
  Clone ID: PAT_TA_76160
gccctcggcccaaaaccctacccgcccaattcggtccggctccgagccgttggccccgcccggggaagtcccgagcgccaagaggaggcggcggagggccggggagatcggatcggcgggggcgcgggccggagtagcattgggcgatggccgcttcataggatgcagctttactccgccggcggccgcttagtctgctgctgctgctgttgccgcttctgcttcggagtgcgctgccgtgatcccaacaggagcctgggctggtgcgggttgggctgacgtgttgttgttgctgctgttgttgggcacttgatctctgcgggcgctttgcgcctgcctgttgggacgtggtcgcgtgaggcgaatggaggagactgggagggagaggaagg

SEQ ID NO: 76161 - DNA, 646 bp, Triticum aestivum
  Clone ID: PAT_TA_76161
gagccagaacgccgacatgatcgccgacaatgcccagatgctccccttctttctcgccctgcgcgagcttgccggcccgttcgaggcctacgtgcgcgcgctggtgccgcgcccgagctgcatcatctccgactggtgtaactcgtggacagccggcgtcgccacttacctcggcatcccgcggctgttcttccaggggccgtcgtgcttcttctcgctctgtgacctcaacgccgccgcgcacgggctgcacgagcggatagccgcggccgaagaccgggagccgcacgtcgtgcccagcatgtcggtgtccgtaaaggtgggcaacggcaggccccacggcttcttcacctcaccggggtgcaaggagctgcgtcacgacgccgtcgcggccatgcgtacgtcccagggtgtggtgatcaacaccttcctggacctcgaagaaaagtccgtggcgtgctacgaggctgctcttggcaagcccgtgtggacgctcggcccgttctgccttcacacccgtgacggcgacgacatggcgtcgcgcggtggcaacaagagcggcgtcagcgagagggcgatcgtcacgtggctggacaagcaagcgccggagtccgccgtatatggcagcttcggcagcgtcgcacgg

SEQ ID NO: 76162 - DNA, 395 bp, Triticum aestivum
  Clone ID: PAT_TA_76162
ggccctggcccaggcgacgagggctcgggggaggaggaggaggaggagtctatggcggagtgggaagaggatgaagacgatggggccgatgctgagatcggtgatggcggcaacggcggcggcgtcgccctgcgggacgtcaagtggggcgcgcgcgctcttgcggcggccgaggaggttcttggcgagcactttggcgatgacattgccatgttcgccttcaaggtgtcgcccaaggggtacgtctacgtgcggctggacaagctcaccaacaggtatgggtgccctggtatagaggaaatagagaatttcaatagactctataagcagaaattggatgagataattgaaagaggcgaaatacccctcgacctggctcttgagatctcatcacc

SEQ ID NO: 76163 - DNA, 309 bp, Triticum aestivum
  Clone ID: PAT_TA_76163
gccagagcgcggcggcgccctcctcgcggaggacgcgggcgaaggcgtcggcgatcccgcggtagggccgcgtgagggcgccccggcgcagcatctcggcctggttctgcagcagcagcttgacgcgctccaccggcgccgcccccgtcttggccaccaccgccgccgcgccgcccatggcgaagtccgcggcgaccctggtgggcgaccggaggcgatgcgggtgcgggcgggcgtccgcgccgtccttcctcgtggccgccgcggcggcagcggcggccattggtggcggagcggcgccgcgggcga

SEQ ID NO: 76164 - DNA, 572 bp, Triticum aestivum
  Clone ID: PAT_TA_76164
gacaatgaagttgcaaacgcaactactactcttggctttcatcaccgcagggctgatcatgagccgcggcgtcctcgccggcggcacccacacgatgccggtgcgcgcgctacgccgcgtcgaggacgaggacgtgggatttctggagcgtgaggaggcggcgtacccacggaggagggtgctttacggcgaccagtacatcagctacaaaggggtgcaggcgagcaggccggcgtgctccggctcctgctctggccgggggcagccctacaccggtagcggctgccgcgggcgttaattatctagaaggtactacgattcctatttgcttccctggccaagaagctgcgtggagattatgaaatgtggttaccgtataagctcaagtggttatacatgtatttgtgttgttcttgattgtaatttttcttttggctggtgttttcttgtgctaaggctagtgctatgctgtctatttaggcttgttggtgtttatgtggtttgtattatgatccttatactaaattaaggagatgtattaccatgaaaaaaaaaaaaaaaaaaaaaaaaaa

SEQ ID NO: 76165 - DNA, 586 bp, Triticum aestivum
  Clone ID: PAT_TA_76165
cggtgtatataaacgcattgttgcatagcacgcgggtgatactatatggggagcagcagcgtcgacggagccggcgagatgtgcttggaggctggcgccggcagggcggggaggcgcggcgggaagaaggcggcggagatgaaggccgccaagcagccgcagcgcgggctcggcgtcgcgcagctggagaagatccggatgcagaaccagatgatcgccgcgtaccgctccggcctgcctccgccgcctccgccgcagcaggtgccgtacgccgcagtcccgacggccggcgccgcatcgtctttccagccctatctagctggttgctttgaggcgatggaccggaggatcgctgacgtgcagtacagccagtactacgcggagaacctgctgcctaacagctccagccggccgccgtcgacgtcgccgctcttcgtcgtccatgactcgtcgtcgtcaggacagaggcagcagcagacgcctcacgagtacgactactggatgcgccacagccacgagtccagcggccgcggcggcgccggaagcacggaagagctagatctggagctgaggctgtaggagacgc

SEQ ID NO: 76166 - DNA, 330 bp, Triticum aestivum
  Clone ID: PAT_TA_76166
tttgcgcccaaggctggccgtgacggccgccgcttcccgggccacggcgaggtgcagctgtaccttaaggacttctgcgacgcgttcgggctcatggaggcggtccggctcaacacgcgtgtcctgcgcgtcgccatggcggtggcaccgacgcggcagtggatggtgaggtccgtacacgagggcacggaggaggaggaggaggaggtattcgacgccgttgtcgtggccaacggccactactcgcagccgaggctgccaagcatccagggcatggaggcgtggagggggaggcaaatccacagccactcgtacagggtgccggagccg

SEQ ID NO: 76167 - DNA, 537 bp, Triticum aestivum
  Clone ID: PAT_TA_76167
gtactccactgctacggcacgcagcggctcgacggcagggcaccaacacagcagctacaccaacagccttccttcgcctgctcccccaactccactgctccgctgagccgccatggcggagctcgaggccgggtccatctccatggcggccgggggcggcggccgactccggaacgccctgagcggcatgctgtgtgctttcgccctcctccttatcggcgtccttgccttctccatccgcctcttctcagtgatcaagtatgagagcgtgatccacgagttcgatccctacttcaactaccgcgtcactcagtttttgtcaaagagtggaatctacgagttttggaactggtttgacgatcgaacatggtaccccctcggacgtgttattggcggcaccgtctatcctggtttgacactgacggcaggcacgatatggtggttgctaaactccctcaacatcccattgtcggtggagactgtctgtgtgttcactgctccgattttttcggcaaatgcttcctgggcaacttatct

SEQ ID NO: 76168 - DNA, 466 bp, Triticum aestivum
  Clone ID: PAT_TA_76168
tctccctccatttccggccggaggacgtcgccgagctcgcgcacaacaaggtcttgattgcggcgacggtggccggtgtgatcgggcagctggccaagcccttcacttccggcagggatgggggcaaaatcgacatcgtcagggtcgccgcccagtcaggggggatgccctccacccactcagcggcagttgtggcagtgactacttcgcttgcgctagaaagggagtcagaagagaggtgggcaagcacgcaaggcttttgaacaagctatgggccctgcgagagcagacgactcaagatcaggaggacggtggcgaccaggtgcattccacccctgaacccgtccccgcaaacctcgagatggccacagagctcgtctccgttcctcaggacgcatctatgtcgcagcgttcaaacgccatgccttcctcgacgcgtggcgctgcgaccagattgccgagaccg

SEQ ID NO: 76169 - DNA, 126 bp, Triticum aestivum
  Clone ID: PAT_TA_76169
ggcaagaatagttagcttttcttttctttccagctcggtcggccactgatcgagcaaacctatgcattttcgggttggggactctcggttgaaaaatagaaaaatactgaaatttccgggtattaa

SEQ ID NO: 76170 - DNA, 481 bp, Triticum aestivum
  Clone ID: PAT_TA_76170
cccaagcagaacctaagatgggggcgacaaatatgaactcatcatcctcagaactacaatatagccaattcacaatcaggtagctatgttcctcggtcattccaaccatatgtaagtaggagttattgaggctctcgcgaccgcggctgcgttgggtgagcgcgccggcggcgctgccttgatctcctccccgcagcctcccctgcggccgtcggcaccggatctggaatctcctcggtgctctctctcttctcccccgcgaagctccgctgggcgccatggctcctctctcccagcccgtgggagcagccatgcctgcattggaacgctctggcgacaacggccctccgccccaccagccccctgcggcggccgccgctccgtccccgtcggcctccctcacggatccgcgcgtcccccgtagctcgcagcagcctgcacccgcgagcaggttcagagcggagaatggggggcgtgcgcg

SEQ ID NO: 76171 - DNA, 724 bp, Triticum aestivum
  Clone ID: PAT_TA_76171
aggttcctcaacccgatctactccactcgttcagggagctgcaggatcaacctgtccttgagtgaaggataagatcatgggaatcacaaaggttggaccgttggacactgaggaggacaccttccatcgcgccgggccgacgcatatgatgtccaaagctggcgccggatcgaagataaagattgactggtccaaggaggggcaccgccggtgcgttatgtcctgccttgtcaaagccacttacgtgatggagaacgacatactcggccgaaggttatacaataatgatgggctggcgccagcgtggtgggagagcttcggtttccgtttggtggaaacgtttgttgacgactcgaatccgaacgacaagatgatcttcggcgccaccttcgagctcatggcactgagccggcaccggtccgccccacgctacgtggttgccttccgaggcaccatgctaggtcactacaagagggctcaagagctgatgcaggactgcaaagtcatattcaacgaactgcgcggcagcaagcggttcgagatcgcgcaccccaaggtccaccagctgatcggcagggacgccagcggcgtctggctcacggggcattccctcggcgcgtcgctggcgctggacatagggcgggacctgatggagatcgaggggcacaacatccggaccttcctcttcaacccgccgcacgtgtcggcggcggcgccgatcgac

SEQ ID NO: 76172 - DNA, 699 bp, Triticum aestivum
  Clone ID: PAT_TA_76172
cgccgccgccgctgccgtcgaccttccagtcccggtcctctccacttgcccccaactaccgataagcatttcccttgccaaaaatctctcaaatgaggacacggagcatggcgtccaaacccgaaccagtcccctccacccacgggacggcggctcctgccccaccgccggcctccgtgagtgcccccacccacgggacggcggttcctgccccaccgccggcctccgtgagtgcccccacccaagggacggcggctcctgccccagcgccggcctccgtgagtgcctccacccaccggacggcggctcctgccccaccgccggcctccgtgagtgcccccactcgctgtgccaccgtgcagagatgcgttgcgctccttgactggtggccggtgaggggtcaaggcggcaagatccgtgttgccgggtacatcgacaacgtcgagaacaatcgagcaggtcgagtattcagttctggttccattacgatgcggcatgctgatggtactcttgagactgcagatcacaaaattgtattaaccaggggtccattaaatatcgaacagatgcattggaatggattttctcgtgaggttacggaacagttcaggcttggttttcctattcaatgggagaaatatgctaattctaacataaaacaggcgaatgaacacacactatctccagcaaaatcaactg

SEQ ID NO: 76173 - DNA, 551 bp, Triticum aestivum
  Clone ID: PAT_TA_76173
agtcgagaactcataagcaaacctcgagactcgagatccatcatggaggtggtaagcgcgatcgtcaaggtggtgcaggagatagcaaaggcggtggagacggaccgggagaacagtgagagctgccttgacctcgccgaccgcgcgcgcaccgtcggcgacatcatccaccacctcgactcctccacggcgagcacgaggagcagcggcagcggccgcacggtgatgataagagagccctcgctgaagaggctgaaggccgcgctcaacgacgcgctcaagctcgtcgagtcccagcagccgagcggcttccttggcggccatgtcaacaggctgatcaacagcggcacgacggccgacagattccaacgtgtcgaggcgaggatcaacgcctgcgtcaacgacgtcggcctggcggagcagttcgccgctcgccatcgtgccctccgtgccaacaggaggaccgtctcggcaccctcccttgctccggagcgtcaccaccagagctcgcaatctgcgccgccgccctcgcagcaccagcaacgcttcct

SEQ ID NO: 76174 - DNA, 216 bp, Triticum aestivum
  Clone ID: PAT_TA_76174
gcagccatggcgtccagagcaccagcggcggtcctcgtccttgcagccttgatctgcgccgcacactcgtcggcggctgctgaggggctttcgcggagcttccacgcggcgtcgtgcccggatctggagaacatcgcgggatcgctcgtggcggagaccttccgccgcgacgtcggcgtcgcccccgccctcatccgcatcctctttcacgactgc

SEQ ID NO: 76175 - DNA, 358 bp, Triticum aestivum
  Clone ID: PAT_TA_76175
accgttagtcttccagccagccggcatcctccgagctagacgggatcgccatggccgcggcgggcaagtccaaggaggcggacgcggcgcggtgcaggaggcacccgagccaccggcacgcggccggcgtctgccccttctgcctcagcgaccgcctctcgcgcctctccgccgccgcgtctgccgccgcctccgagccgtcgtcggcgtcctcgtccggggcggcgagcgtcgcgtcggcccagacggcgccgccctgccgcgaggcgcgccgggcgaggctggggatgctgatgcggcaggacgtgccggaggcggccgcgggcggtcaccacggcaagaaggaggttgggactgc

SEQ ID NO: 76176 - DNA, 449 bp, Triticum aestivum
  Clone ID: PAT_TA_76176
gccgaatctccagccccacgatctccccacgcgcacccaccaacgacccccgtccccaaaaaccctacgccgcgcaaaccctagccgccgcctcagcaatggccggcctcctgcggctcgccggcgccgccagatccttctcccgcgcgctggccccggccgcgccgcaccaccgcaggctcgcggcatcggcggccgccctggcggaggacgatgcgtgctggaccgagtgggaggaggaggaggaggaggcgcggcggcagcgcgcccgcgcatcggcgcccgccgaggagtcttgcccggcggacggcggtcccaggggcgtgcagtgggtggtgatgggccgccccggcccgcagaaggacgcccacgccgcgcgcctcgccgaggtcctcgccgtgccggacatctccatgggcacgctcgtcaggcaggagctcagccccaca

SEQ ID NO: 76177 - DNA, 423 bp, Triticum aestivum
  Clone ID: PAT_TA_76177
agaacaagcccaagccgccggtgatcatcacgcgggagagcgccaacacgctgcgcgcccacatcctggaggtcgggagcggctgcgacgtgtttgagtgcatctccacgtacgcgtgccggcggcagcgcggcgtgtgcgtgctgagcggcagcggcatcgtgaccaacgtgaccctgcggcagccgtcggcccccgcgggcgccgtcgtgaccctgcacggcaggttcgagatcctgtcgctctcgggctccttcctgcccccgccggctcctcctggcgccaccagcctcaccatattcctcgccggggggcaggggcaggtcgtcggcggcaacgtcgtgggcgcgctctacgccgcgggcccggtcatcgtcatcgcggcgtccttcgctaacgtcgcctacgagcgcctcccgctgg

SEQ ID NO: 76178 - DNA, 407 bp, Triticum aestivum
  Clone ID: PAT_TA_76178
tcgtcgtccgggctctccctcgtcataggctggaccgctcccggtgcggccattgctcgctcgcgcccgggtgcagaccgatcgctcgcgcctggacagaccgagctgctcacgcccggcacaggaccgagcttgcttgcacccgggcacagacggtgatggagccatttttgggccggccctttgggtctcgggccgggccgccggggtggaaggacgactttccactctctctttggtgggagcacgggctcggggcggggtgcaggtcttggatgccgggcggggcttggtggggacgcgggctctgggcgagcccgggcttgggtgccggaccatggccgtgtgggcggatggggcagggtggggctcggggcgggagtgttgctggggaacctgctctatcc

SEQ ID NO: 76179 - DNA, 423 bp, Triticum aestivum
  Clone ID: PAT_TA_76179
aagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatcgtgtgagagtatacgtgaataacgagcgtccctctgatctgatggagtcgagcaagggtgcgtgtgcgtgtgcgtgtggtttacttgctcgctctccgcctatgctctgcccttggtgtcctt

SEQ ID NO: 76180 - DNA, 625 bp, Triticum aestivum
  Clone ID: PAT_TA_76180
acgagagaggaggaagagacgggggcgactagctccaaggcgatggcgaccaagctcgccgccgacgagccccccacagcgcacccccgcgcggcggaggaagcactcgcaacggacacggcggacgagagctgcgcggccggcgaggcgggcggcatgaacgccgtcgacgtcctctgcgccgccgacaaggcaccgtcgcgtggctctgcccgcgagctgtgcgccgccgacatgatctgcagcatcctcgccggcccaccgtgcactgcagccgaggcgcatcaaaagccagtgagcagcacccctctcctcccctccctgaaccctgcttgtttttgttcgttcacattgttgaaatcttactcaaaattgtggccgtccaactcgaattagtcctggcggtgtgtgtcatgtttgtgttctaaaccggtggactaggtgtgtgggtagcacataggcgagtggaatgacaggaggcgactagctatgttctgaatctgcacatgaattgttttcagtttaagatgtgcagtctgtatccacataggtgcagcctccaggcataaactccagaagccatcaactacactagctgaactggactgatgtttctttgcctgat

SEQ ID NO: 76181 - DNA, 500 bp, Triticum aestivum
  Clone ID: PAT_TA_76181
tcgagtatggtgcatacatgtcaacgttggtagtcagaacttgatgctgagtgcggatgggaatgatggggtgaggatgggcatgctttagtccagcaatttatcattgccaaatggttcaatcccggtgatgtcattgctggatatgcaaggtctcattgggcaaggtattcgaagttcttaagtgcctaggaacctcgctgtgcttttgtattgacgtgattagcaagtgtatttaccgaagcatacatgtaatgtgggttatgtgtagcaccgaatctgagatggctgcaatccagtcggttctggcattggagagttacgagtgaatcagacttaatcacatggcatcaacactgttaatcattggaaggtctgccgagcgtttgagacgagaagcatggtgccaatacatacttttggttcttaacccagatgatctcatttaaagctgctggcgtttgatataatcattcttgatgagctgcacaacgcttcat

SEQ ID NO: 76182 - DNA, 713 bp, Triticum aestivum
  Clone ID: PAT_TA_76182
attcggcacgaggactacaccagttcccaattagcaaaagagttggacactcagcagtctataaatgacaagttgcacaaattgtcaaccatattgaagcttataactgaaactagagaaaggattgcgaagatttcggataacacagtaagtgagagtggatctgatggcttgagatgatggcaaactacaaaacattgaattcatcatgtcaagctctgtctctttctttggtaccaagttgacaatggcttatcaaccttctgatcttgcaagttggtcctccgctctctggggtgatccatcggaattaagacagtgccatattctgcaggactccgttctgcaactggagtgtggacatgtcaatttcttgtggtgctcagatcttgttgtcggtgagggaggtacgattgcgccgcctaaaagcttctcgagctgaaggaacttggttccgggtcatctatgtctcttcgagtggtcggtgtctgtatggatcatacgatctggacagaaggctgtaggcaaaactgtacgacttcgtgcagattttaccgaagactggaagatttagaggtcccaactccgaagcaagcagtcgagcttctgacataaatgtacataatgagactgcgccatgaatatctttatcctgtatccagagtttgtggccacatcactcattttataggctcctgtgtaaaagtaggtgc

SEQ ID NO: 76183 - DNA, 465 bp, Triticum aestivum
  Clone ID: PAT_TA_76183
tcggcacgaggccgcctttcgagtgacatatggatcgagtttcacgacttgagaagcttttgctccgaaaggctagattggcaccttaccgaacaggtgccggagtcgtcatcaggagagcctaaacacatggctgccggcagtgaagagggcctaagatcatttggggtgttccgggacggatctctcgggatataagataatttcatgtgttggcaaggggccatgcagagacctaggtttgcatgtttacaaggacaagacatggctgactgtaaaggataaaccttttatggttgtgtttaggaaaaagactatataggtgtttttttgcttgcttcttgaggtgatccctgtaggcgagttcattgtatcgccactgtggtgttcatgttatgtaatgtgttcccccactttgcaataaagcgatactaactatattatgtgaaaaaaaaaaaaaaaaaa

SEQ ID NO: 76184 - DNA, 637 bp, Triticum aestivum
  Clone ID: PAT_TA_76184
gaggcctccctcccgcatcgccgccgccgccgccaaccacgtcccatagtcgccacaaccggcgatctcgtctccccccatcacaagagaatacaagagaagaggagaggtaggtcgggcatccaggtcggtcaggtggcggccagatccaccaggagatgataggaatccttctgcctttttctcgctccgcgccctcgatgccatgccatggatcgagcttcacgcgccccagccatcaggaagaccaaagcggaggtggcgccgtgggggatcgagaagtggtggtggacgcacatcgcctcaccaccggaggtctcgaggtaagcagagacggtgcctgctacggtccccggccgcggcggcaggttcaattcccgcaccatccatgtatcaccgctcccgcaccatccagcagcctcgctagtgtgtaataagatgtgctaatgactactcgatgatctgtgagctgttccacttcattcactgcaccatatatgtgcctaatcattaacattgaaagattagcacatgagcacagtgttgcatatagattctgatggatcctacggagaaaggcagaagttcagatatggggttgtatgaaactgttgcctccctgtacatggatgtacga

SEQ ID NO: 76185 - DNA, 416 bp, Triticum aestivum
  Clone ID: PAT_TA_76185
tcggcacgaggcaataagtgagaagatgagagagcgtgtgtgtgagagagagaagagagatgaagaatccatcagctgtccagcatgtttacgagaagtatacacatagcgtctaaggtggtgctgaaggggaagagccgagccatttgtctggagaatattagcatacatatggttaccagacttcatacaacgatgatggggtttatctgctgacagagtattattctagaggagaaatctagttttccgagattcagacgatgcaacttaagtatgcccagaagatgtcatagaagaataggctggaccagtgggtgggaagcgattatagattgatttatttgagacgtttgtaaatgtaaagaatttgtaaaagcagatatatgagcttttgtgatccaaaaaaaaaaaaa

SEQ ID NO: 76186 - DNA, 729 bp, Triticum aestivum
  unsure (1)..(729): unsure at all n locations
  Clone ID: PAT_TA_76186
gaggggtgcgcaagccgccgcccaggaaccgggaccggcacaccaaggtggagggccgcggccgccggatccgcatgccggccgcctgcgccgccaggatcttccagctcacccgcgagctagggcacaagtcggacggcgagaccgtgcgctggctgctgcagcagtccgagccggccatcgtcgccgccacgggcaccggcaccgtgcccgccatcgccaccaccgtcgacggcgtgctccggatccccacccagtcctcctcctccgcctcctccgccgtcgtcgacgacgaggcctccgccaagcgccgccgcaagctgcagccccgnctgcgccgcggggccgctcgccaccgtgccgcccgccgccgcctactactccgtcctcgccgaccccctcctgcagggcgngcgcccgggggcgcggccatttccgtcgccagcggcctcgctcccatcggcggccagcagggcctcgtccccgtcttcgccgtgccgtccgccgctggggccggcggcggcaaccacatgatcccgcaggccacctgccgtgtggatggtcccgcagccggccggcgcccccaaccagcccacccagtactgggccttccagtccgcgccccagctcatcaacctcgccggcgcgcagaccatgcctggctggagctgtgttccccaacgtcgccgccgactaccatcaacagcagcagtctgcctctaccgtggt

SEQ ID NO: 76187 - DNA, 691 bp, Triticum aestivum
  Clone ID: PAT_TA_76187
gcgcgtccctatccgtttccccacctccgccgctagatccgggcatggcgacctccaggacggacctctccttccagggcagagaacgacgcccgaaggtacgtcagcgcctgtagagggcgagggagagcggcgacagcggagatttcttcaccactgcctctgcatctctctgtctctaccatggccctgcctactcttctacagggcaagaaccaaatagggcccatgactggcagcatctgccctcgagctccagctgaagcaaataatccccaaggtgttgttcaatccatcggttgcttgcagtgtgctgtgattaaggaggacatgttattttagtgtgcgagagagatcttgcaggctggcatctgggaggatcattcacctgaccaagcacagtatgatggtagtatcaaatatgagattattaaagcatcttttgtattcctcaagcactggcagggctgcggtaatggggagtgtcagcaactaaaattaattcatttatccttggaagtgggataacaagaagggaaaatggcatgcatgatcactcttttttaatgagttggccaatgttggcatgaagccataaaagttagctggttgtggaggatttttggtagtgggtgatgaattggcaccttttcttgcttgccatcatgccatgattcgaaatttggttctc

SEQ ID NO: 76188 - DNA, 675 bp, Triticum aestivum
  Clone ID: PAT_TA_76188
ccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaatacatacaactccttctgttcaaaaaaaaaaaaaaaaaaaa

SEQ ID NO: 76189 - DNA, 801 bp, Triticum aestivum
  Clone ID: PAT_TA_76189
attcggcacgagggcccaactgtagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcaactgcaaccatttccgcagccgcaaccatttccgccacaactaccatatccgcagccgcaatcatttccaccacaacaaccatatccacaacagcaaccacagtatctacaaccacaacaaccaatttcgcagcaacaagcacaacaacaacaacaacaacaacaacaacaacaacaacaacaacaaatccttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccataatgttgctcatgctattattatgcatcaacaacaacaacaacaacaagaacaacaacaacagttgcaacaacaacaacagcagcaactgcaacaacaacgacaacaaccgtcgagccaggtctccttccaacagcctcagcagcaatatccatcaagccaggtctccttccagccatctcagctaaacccacaggctcagggctccgtccaacctcaacaactgccccagttcgcggaa

SEQ ID NO: 76190 - DNA, 761 bp, Triticum aestivum
  Clone ID: PAT_TA_76190
gaggccgacgactacgcgttcgtccgctgcgcctccggctgcgactcctgggccccccaccacgtccgcctcgacggcgactcgtatcgcctctgctcctcctgcgtcctcctctccaaccccgaggcctactgctccgcctgcctcctcctcctctttcccggcgcctacgccgcctcctcccgtgaagcccgcgtcgacttctcgccaggccccaccgccgcctgctccaactgcggcgtcttcgtcgcccacctctcctgcatcccggacccgtactccttcatctgcccgccgtgcgccgccgccgtcgacaacgtgcccttctcgtacgatctcgcgggagtggggcgctccgcgcgcgtcctcctcaccgcggcgctgctttcgcacgagtccgccttgcacgacgccgccgcggcccgcgagaaggcggagcgtagcctacatgaggctgcggccgcccggaggctagcgcgcgacatgctagacgccgcgtttcgcgccgcagaggcggaggcctacagggacgccaaggagcaggccacgccgtccgcgcccgcagtcgtgcatctcaagaagaagacgcctaataccaacgggcacaagaggaagacccccaagagcaacgatgccaacagggagaaggacaagctgctcaagttcaacgacatgcagcagccggcgctggcctttgccgcagcggcggcggccgcagccagctcaatgccatcgccatcgccgatgcaatcatcaagact

SEQ ID NO: 76191 - DNA, 645 bp, Triticum aestivum
  Clone ID: PAT_TA_76191
attcggacgaggcggctagcttgacagaatccagcggcggcgacgacgaatccatggcgggggaccaccgccgtgaccgcgcccagcagcagcggccaggcgtgctcatggtggcggcgctcgcggctctcggcctcctcgccctctccggcacggcgctggctgcctcggtcgcggggctggccgtggcagcgccgttgctcctgctctgcagccctgtgcttgtcccggcggcgctgctggccactctgacggccggcggcatggccacttcaggctcagctggccgtcggggcgacggcgctgctgtcacgcttggcgagcgcggtgaggagggcggccgcaaccccgccggactacgtcgagttagggaagcggcgggtggcggaggtggccggggagcagacggcgcacatcgacgccgggccggcgatcaatccggagcaagtggcccgcagccgccggccgtacggtggctcacacgccctgatctcctagaatatactgtattatctatcctgtctagctcctctagtagtaatatgagtgcttaatgtagtaatatccaacgatgttcatggagcatatgagattatgcaataaaatctatcatcgtgataatccctaaaaaaaaaaaaaaaaaaa

SEQ ID NO: 76192 - DNA, 820 bp, Triticum aestivum
  Clone ID: PAT_TA_76192
gattcggacgaggacactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcagcagcaacaacaacaacaa

SEQ ID NO: 76193 - DNA, 693 bp, Triticum aestivum
  Clone ID: PAT_TA_76193
tcggcacgagggtagagagagagagggagcagcagcagcgatggagatggaggcgcgcggcgacctgcgatcgatcctgccgcagctgccggtggtgctgcgcggcggggcgctgttctggccggcggcggcgcaggagcagctgagggcgctgtccctcggccccgacgtgagccgggtcacatccggcgacgtgctcgccgacgcgctcagcgacctccgccaggccctcgccctccgggcgctccccgcgcgcgccgccgagggctacgcgctcttcttcgacgacctcctctcgcgggcgcacgcgcgggactggttctccgacgtgctcccccgcctcgcgcgcctcctcctccgcctccccgcgctgctcgaggcccactacgccggcgcccgggccgcgaccgggctccgcctcctggggccccaggacgcgggcttcgtgctcctcggccaggagctcgccgccgcgctgctcgcctgcgcgctcttctgcctgttccccaccgccggccgcggcgaggcccgcctcccggccatcaatttcgacgccttgttctcggcactgactaacaatgcgaggcaaagccaggagcacaaagtgaggtgcattgctcactatttcgagagggtgaccgcgtcgatgcctgccggttttgtgtcgtttgagcgcaaggttcttccgcgcgg

SEQ ID NO: 76194 - DNA, 569 bp, Triticum aestivum
  Clone ID: PAT_TA_76194
aagatcacaagttttgcaacaaagtacttaccagctgttacaagaattgtgttgtcagcacctatggcagatccctgagcagtcgcagtgccaggccatccacaatgttgttcatgctattattctgcatcaacaacaaaaaccacaacaacaaccatcgagccaggtctccttccaacagcctctgcaacaatatccattaggccagggctccttccggccatctcagcaaaacccacaggcccggggctctgtccagcctcaacaactgccccagttcgaggaaataaggaacctagcgctacagacgctacccgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtgacatgcactatcaggtaagaacccgaactatactagttcaaacttgggaataaaagacaaacacaggtcttgtctacaaaaaaaaaaaaaaaaaaaaa

SEQ ID NO: 76195 - DNA, 841 bp, Triticum aestivum
  Clone ID: PAT_TA_76195
attcggcacgaggaactagagcacaagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacgaactattccccaaccccatcaaacattccaccatcaaccacaacaaacatttccccaaccccaacaaacatacccccatcaaccacaacaacaatttccccagacccaacaaccacaacaaccatttccccagccccaacaaacattcccccaacaaccccaactaccatttccccaacaaccccaacaaccattcccccagcctcagcaaccccaacaaccatttccccagtcacaacaaccacaacaaccttttccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagcgtcgcgcattccatcatcatgcaacaagaacaacaacaaggcgtgacgatcctgcggccactatttcagctcgcccagggtctgggtatcatccaacctcaacaac

SEQ ID NO: 76196 - DNA, 684 bp, Triticum aestivum
  unsure (1)..(684): unsure at all n locations
  Clone ID: PAT_TA_76196
gcgcccgctcgcgtcgcctccccccgggcgacttgggtgcccacaaaccctagccgccaggctcctccgtccatcgtcccctccctttgtcgccgccgtaggacgccgtcgggctaagctgggtggccggcggtgttggcggaggatcccctcctactcgtgatggaggaggtggggcggacctcatcccgcgaggaggcgcggccgatctagatctgggcggcgggatggccggctggtggcggcggcgtgcagaggatgtcgtggaggatcgggcagatcgggccgggtacattcggtggtggcctcgngtcatggcttgcccggggtggtcgcctcgctgccgccgcggcagcggccccgggcagtggtggacggtgaagcccagatcgtcctcgacggcatagcgtggacgtacccatgtccaaagcggagctgctacggttggttcttcttgcagctcgtgcctgattccccgagcttcgtctgtggtattgccgctcgttggcgtcatgcttgctcgtccggcaccatgtttgcttcgtccgccaccgtgtctttgcttctttgtttttttaccgtttgcttcgtccgccgccgtgtcgtttgctgctttgtttttttagagagacagctacttttattcaatcaacgattgttcattacaaaaaaaaaaaaaaaaaa

SEQ ID NO: 76197 - DNA, 708 bp, Triticum aestivum
  Clone ID: PAT_TA_76197
tcggcacgaggtgactccctcaccctgctagggttcctagccccgtcctccgccgccgctgcgtgttcccgtccgacctcgcccgagcgatttcttgacctcgccgggagcaggcagctggatcccgccgccgtgcctccctctctcccttctcttcttttcccctacctctctctctcctctgaactgagcgtcgttcctctctgcaggtgccgccatggccgcgtcttggagctcgccgccgtgggctgcgtgcccctccgatgacggccttcctcgcccacgtccaggtcccctggccggccatcttccattttctctattcccgccccatgcccctccccaaagatccctccctctcatgggcgtcaccaccatcactgcacccagcctccctcatcgtggtgcagtcagttccgttccgtggcctctatcgtgtcttcgaagaaggtcgtgatacgccacaagtgggagcggaagctgcgatgtcaagatctacaagcaggacatgaaccaccttgccatgtatttcctcgtcacattaggattcgtcgacgccgccaacaggttctgtatcaattccggcacccaacgtactgtatgcccacacatttaaatcatgccggtcttactcctgcaatactcctcgaatagtacttgagatttaggcagcggtgggcatggtcattcacctggttggcctctttg

SEQ ID NO: 76198 - DNA, 798 bp, Triticum aestivum
  Clone ID: PAT_TA_76198
attcggcacgaggcaagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacgaactattccccaaccccatcaaacattccaccatcaaccacaacaaacatttccccaaccccaacaaacatacccccatcaaccacaacaacaatttccccagacccaacaaccacaacaaccatttccccagccccaacaaacattcccccaacaaccccaactaccatttccccaacaaccccaacaaccattcccccagcctcagcaaccccaacaaccatttccccagtcacaacaaccacaacaaccttttccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagcgtcgcgcattccatcatcatgcaacaagaacaacaacaaggcgtgacgatcctgcggccactatttcagctcg

SEQ ID NO: 76199 - DNA, 612 bp, Triticum aestivum
  Clone ID: PAT_TA_76199
gagggttcgccgtcgtgggcctccccgcccgcggcgagatctacgtgatcggcggcgtggaggagggcggcgacaaggcggtgagcagcgtggcggtctacagcgcggcgaccaacggctgggggcaggtggccggcatgaggacgcccaggggctacatggcggccggcgaggtgggcgggcgcgtggtggtcgccggcgaggacggcgaggcggaggtgttcgacccggagtcggcgcggtgggcgcccgcggcggcccggggcggcgcggccgtggcgaggtacgacgcggcggcggcgggcggcaagctgtacgtaacggaggggtgggcgtggccgttcgagcgcgcgccccggggcgcggtgtacgacgcggcggcggacgcgtggtccgacatggcccgcgggatgcgggaagggtggacgggctcctgcgccgtgtccggcggccggatgtacatcgtggccgagtacggcgagtggcgtctcaagcggtacgacgagccgcgggacgagtggcggatggtggccggcggcggggtgccgcaggaggtgcggcggccgcacgtggtggccgggcagctggaggaggtcggcggcggcaggcgca

SEQ ID NO: 76200 - DNA, 637 bp, Triticum aestivum
  Clone ID: PAT_TA_76200
tcggcacgaggctcacatcccacccaacaagccccacctccccacgcgctccagccagcagcacccatggcacccaaggcggcggagaagaagccggtggccacggcagagaagacgacggcggggaagaagcccaaggcggagaagcgggcgccggcgtccaaggaggccggcggcgaggggaagacgaggggccggaagaagggcagcaaggccaagaagggcgtggagacctacaagatctacatcttcaaggtgctcaagcaggtgcaccccgacatcggcatctcctccaaggccatgtccatcatgaactccttcatcaacgacatcttcgagaagctggccggcgagtccgccaagctcgcccgctacaacaagaagcccaccatcacgtcccgggagatccagacctcagtgcgcctcgtcctccccggcgagctcgccaagcatgccgtctccgagggcaccaaggccgtcaccaagttcacctcatcctaagctggcctcgtcgtcgtttcatgacgagttgagggcggcaggcgtcgtgtgtgtagttagcagtagtacgatgttacaatctttgtaagaattgttctgcttgcttgtggccttgaaggaatagttgatgttgctg

SEQ ID NO: 76201 - DNA, 645 bp, Triticum aestivum
  Clone ID: PAT_TA_76201
cggcacgaggttttatttttgctgggctggttcacacaagaaaagcctctagtcctccgggcgtcatggcggcgtcgcgacggcgcacgtcggcggagttccaaggggacggcagcctaatgccgccgtcggcgcacgtggtcgcttctccccgcggcggtggcgcgcccagccgggaggagcacgcgaacggcggccgcccggcgctccggggagcaaatccaagaggcggcagcagcgtattctcagccaccaagctcaccggcaggaggcggccggcgaggcgcatgccactacggcgagtcgccatctttgcctccctcgcattgaatgtcgccgcactcgcgctcctacgccaccggtacgtcgtcagccacccgcaccatcccggtgtcgtctctcttgatcagcagcaccacgtctgcgccccgcagccgggcaccagcggcgcggcggcgagtgcgccgtcgaccgggaagccgggagtgacttccgactctgttattaatctggaccacggggacccgaccatgtttgaggccttctggagggagaccggcgacgcggcggagctcgtaatcccggggtggcagacgatgaactacttctccgacgtcagtaacgtgtgctggttcatggagcctg

SEQ ID NO: 76202 - DNA, 676 bp, Triticum aestivum
  Clone ID: PAT_TA_76202
tatccgcagccgcaactaccatatccgcagccgcaaccagtttcgaccacaacaaccatatccacaatcgcaaccacagtattcgcaaccacaacaaccaatttcgcagcagcagcagcagcaacaacaacaacaacaacaaaaacaacaacaacaacaacaacaacagatccttcaacaaattttgcaacaacaactgattccatgcagggatgttgtattgcaacaacacagcatagcgtatggaagctcacaagttttgcaacaaagtacttaccagctggtgcaacaattgtgttgtcagcagctgtggcagatccccgagcagtcgcggtgccaagccatccacaatgttgttcatgctattattctgcatcaacagcaacaacaacaacaacaacaacaacaaccgttgagccaggtctccttccaacagcctcaacaacaatatccatcaggccagggctccttccagccatctcagcaaaacccacaggcccagggctctgtccagcctcaacaactgccccagtttgaggaaataaggaacctagcgctagagacgctacctgcaatgtgcaatgtctatatccctccatattgcaccattgctccagttggcatcttcggtactaactgagaagagaagaactctagtagtagatatatgatacac

SEQ ID NO: 76203 - DNA, 761 bp, Triticum aestivum
  Clone ID: PAT_TA_76203
tcggcacgaggcctagatctctcctactgttccccacttagccggcgccccacgcccgaccgccgcctgcggctaccgacgaccggcggtctatcccaccgttgccccacgcgcccttcctctatagcatcgctccacgccgccctgcccctacagcgcaacctaactccgtcctgcctttctccgccgccggctccacaccctcgtgctctctctctggttggccgcctctctccagcatccctggcctgacctccccatctccaccgtccagctcacgaagacccacgcaacggcagatttggatcggggcagcgtgcgcctggtcaagggcatccctctctgtctttggctgggcaggggcaccgaagcggctgaggagggaaaatggcaagcacaagcggaaaagctaaagatggtgggatcatggaggaacaacagcggtagagtataaactacagagaagtaggaccatagaagaaaatgaatctcgcagtgctatcaccaaaaagaatcgcgccaatgaagtgcctcatacatccgggagcaagagtcacaaacaatatatatatgataattttcttgtagcctcctagatcttctcatgaggtttttgtcaatgttgtgatcacaagggatgcaacgctgccttatgaatatgatggtttacgatttgtcgccgatgttgtcacaaggtccattgcatggccatctagcaagatgaaaccctacaagccagggcatcttcctcatcccgccac

SEQ ID NO: 76204 - DNA, 813 bp, Triticum aestivum
  Clone ID: PAT_TA_76204
tcggcacgaggatcgttcaagccaagcaagcagtggtcaatacaaatccaccatgccctccttgctatcgtggcgaccaccgccacaactgcagttagagttccagtgccacaattgcagccacaaaatccatctcagcaacaaccacaagagcaagttctattggtgcaacaacaaccatttctagggcagcaacaacaacaatttccagggcagcaataaccatttcgaccacaacagccatatccgcagccgcaactatttcctccaaaactaccatatccgcagccgcaaccatttacaccacatcaatcatatccacaaccacaaccacagtatccgcaaccacaacaagcaatttcgcagcaacaaggacaacaacaacaacaacaacaaatccttcaacaaattctgcaacaacaactgattccatgcagggatgtcgtcttgcaacaacccaacatagcacatgcaagctcacaagtatctcaacaaagttaccatctattgcaacaattatgttgtcagcaactgtggcagacccccgagctgtcacagtgccaagtcatccacaatgtcgttcatgctattattctgcatcatcaataacaacaaaaacaacaacaacaaccgtcgagccaggtcttctaccagcagcctcagcaacaatatccatcaggccacggctccttccagccatctcagcaaaacccacagacccagggctttgtccaacctcagcaactgctgcagtttgaggaaataaggaacgtagcgctgcagacactaccagcaatgtgcaatgtctacatc

SEQ ID NO: 76205 - DNA, 817 bp, Triticum aestivum
  Clone ID: PAT_TA_76205
attcggacgaggctctgttttggagtatgtttttggtgtgttagccctttatctgctgggttccgctcatgctattcagatgtatcagctttttaccttggacacgaagatggagctcctaactgtcctgatgactattatgccaagctgcatcttctgcattgtccaggcaattgttacctttattagccacaagaaccagcgcatcatggtgatctcatcctctctaaacttggtgtgctacggcttggagatactgctgttgattcaagttcacaaaaagttgaaggctccagaggccataaagaagttaaaatctactgttggcaggtcattccgcaggagacaagacgaagctcatttggaggatcgagatcaacctaatgaagggaatgatagtgactccaatgttatacctcctgcgccgccgtcaacacgcactgatttacaaagggttgtggtcgctatcagtagaatggaagcgcgaaacgatggttgtaagattgagatcgttgaagaagggggagatgaacagaccaatgagatgcacgcgctaggaattcaaagtccaaatcgtattattcctttgggaggggacaatgctggtcaacataatgtgacccctccagttccagcagtctcactcccacatgcacccaggaagcatagaagaaagggaggggtagcgaaaaatggagtgtctcgaaggggtgttgaagtgaccaaggaatcagctgggcaatggtggcagttcgggtgcaagtagatcaagcccttctctcttctttcgcaagctacatatggccttgcaatttac

SEQ ID NO: 76206 - DNA, 666 bp, Triticum aestivum
  Clone ID: PAT_TA_76206
tcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaatacatacaactccttctgttcaaaaaaaaaaaaaaa

SEQ ID NO: 76207 - DNA, 736 bp, Triticum aestivum
  Clone ID: PAT_TA_76207
gattcggacgaggcctttcctgccgctgccgccgccgccgccgccgctgaagggcgctcatggcgcggtggtcgtctccgaaggacccgtctctggaggcggccctccgccgcaaccggcgctggatcgtgaacaaccagatcaagcgcctcctcctccgcttcccgtcccgctccgcccccgtccgcctcctccagtcccgcttcaagacgctcgacctcctcggccgcgccgccaactggctccgcaagtacccctcctgcttcgagctcttcaccggcgaaggcccggccgggagcggcggggaactctgcttcggcttcaccaagcggatggcggagctcgtcgacgccgaggaggccgccgtcaccgcgtccgagccggccatggccgaccgcctcgcgcgcgtgctcatgctcgctcgcgggcgccgcctcccggtctccaagctcgccgcgctgcgcggcccgctcggcctcccagacgactacctcctccgcatcctccccgcccacaccgatctcttccgcctcgccaacccgtaccctcaccgccgcaatgccgcagagctggagctgctccgatgggtcccttcccgcgcggtctctgccgtcgaggccgcagcctcggcgagcaacaccctcccgcggttcacctgctcgttgccgtcctcttgggccaagtcccacgagaagatggaggacttcaactccacaccctacatttcgccctactc

SEQ ID NO: 76208 - DNA, 177 bp, Triticum aestivum
  Clone ID: PAT_TA_76208
ctgcgggcgggcggcttcgccgatgcatcggtcctccgcggatctgatttggccgcacgcgatccggccatcgaggggatgcggggggaggaggggcggaggtggaggcgatgagcggcgccgcctcgctggggctgcgcaccgggagctgcggctccctgcccgctgcgggcgccg

SEQ ID NO: 76209 - DNA, 696 bp, Triticum aestivum
  Clone ID: PAT_TA_76209
ggagaagcgataatggcgacggagaggcggcagcagcagcagggagaaggaggtggtggcggtgcctgtgggacgcggaggaggcggcggggcaggtggcgttcgcggcgcccatggtggccaccagcatggccttctacgccatcccgctcgtctccgtcatgtacgccggccgcatcggcgacctcgagctcgccggcgccacgctgggcaactcgtgggccaccgtcacaggcatcgcgctcatgactgggttaagcgggtctctggagacgctttgcggccaaggctatggcgcacaggtgtaccgcatgctgggtgtgtacctccaggcatccatcatcacgtcggctctcttttcggtcctcgtctcgctcctgtggctctacaccgagccactcctcattttcctgcaccaagaccccgaggtctcaagaatggcagcggtgttcctaagatacacaatcccggcacagtttgcctttggcttcatccagtgtatcctcaggttcctgcagacacagtccgtggtgatgccactggtggcgttctcgctcctgccacttgtgttccatgtcgggattacccatgcctccgtgcactacctggggctcggcttcgcaggcccagccatgtcaacttcgctgtctctctggctatctttcattatgctcgcatcctatgtgatgttgtcga

SEQ ID NO: 76210 - DNA, 673 bp, Triticum aestivum
  Clone ID: PAT_TA_76210
cagccgcccgccgcattccgaggggttcgagttcgccggagagggaggagagatggccaggaagggcggagagaggaagaaggcggtgacccggtccaccaaggccggcctccagttccccgtcggccgcatcgggcgcttcctcaagaagggccgctacgcgcagcgcgtcggctccggcgcccccgtctacctcgccgccgtcctcgagtacctcgccgccgaggtgctggagctcgccggcaacgccgccaaggacaacaagaagacccgcatcgtgccgcgccacctgctcctcgccatccgcaacgaccaggagctcggcaagctgctcgccggcgtcaccatcgcgcacggcggcgtgctccccaacatcaaccccgtgctgctccccaagaaggccctcgagaaggccgagaaggagtcccagtcgcccaagtcgcccaagaggaaggcccccgctcccgcccccgccgccaagaagacccccaagaagaaggccgccgacaagaagaccgccgccgctgacaagaagaaggccgccgccgacgccgaggaggaggccgccgccgacgagtagaaagggccaagttgcgtcgcgtagttctgcatctgagatgggagagaaagagagagatcatgtgatcctgtatgtaaaaaaaaaaaaaaaaaa

SEQ ID NO: 76211 - DNA, 609 bp, Triticum aestivum
  Clone ID: PAT_TA_76211
taccactgcaccagagctcaccaacagcgagtagtgttccggccgccctcttccttgtcggggatccaccagggagcagggtccccggggcgacgccgttgaggcgccattcgtgagcccggcggccaggctccaggtgccagcgcggtggtcgtggctgctcgttggcgagtctgccggcgggctggctagcgggaggccgatggccaaaaggcggcggtgagcgcctgcgtgcggtggaggaggtggcgtgtccggagttggagacggcaggcggagcacattggcatcggcgcgcggcgatgacggagatgcggccagggcgctcgtcatgctcctcacaccggagccgaaggtgaacatggaggccccggtcggcatggatacatgggcgagggcgtcgccttcaatctcaacaaccgcaggggtctgaggcagaaggcgtggcgccatggcgttggcatcggcgaccgcggcgctggtcgagccaaaaccgaaaacggatgtgcgcgactgcccaacagcgtccacgccagcggcggagccgtactcgtgcaaggggcagataacccacccatgcgtagagcaccaaaatgccggtggtggcgc

SEQ ID NO: 76212 - DNA, 722 bp, Triticum aestivum
  Clone ID: PAT_TA_76212
tgatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgccggagagccagccaagctcatcaggcagcggtaccgtgaggctgcagacatgatcaagaagggtaagatgtgctgcctcttcatcaacgatcttga

SEQ ID NO: 76213 - DNA, 744 bp, Triticum aestivum
  Clone ID: PAT_TA_76213
ttttttttatttttttgcaactacaacgatgtatattttctgattccatttgttgttgatgcagtggaaagcgggatcaacagctgaatattgttaagctaacacatttcttgctggtgtgtgcttttatcaattaaaacgcatgtttctcaagagacgcaaactgcaagtgattcagaatgagagtagcaacttttgcctttgcttctgctacatacttctgtatattggcattcaactattttggtcgttcccatttagtttctaaatcccagttaagccttgtggaagtctagcagatcataaatttgagacatggatccaactttcttacggtgcatggagaaatatacttacgacttcagatttcagatctggactttagacttcagaagttcctctggcccattctgtcaagtctttttttcttcttctcttccattaggatccagatttggacttctgtacatttgctccccatcttagatcattaagtgttgtactttttgtgcattctatatatgacattctttgtcaagtctttgtttcttcttctcttgcattacatttcagatttcgatttctataaatttgctccctatcttagatcactattcgttgtactttttgtgcatttttctatgtcgttacattggtgcattgatttcttttccacttcattcttcctaaatagccctacgaagtttctacacaaatctggaaaacatgttttccttcactttt

SEQ ID NO: 76214 - DNA, 706 bp, Triticum aestivum
  Clone ID: PAT_TA_76214
gcacgagggctcaaggaagttctcatcttcgagaaccttgacgtgtccaagaaaggcgcttacatgtttggccgaattgatctgtgcgatttcgtgctggagcatcccaccatttcccgttttcatgcagttctgcagtttagaaatgatgggcaggttttcctttacgatcttggaagcacacatggttcttccatcaacaaaactcaggtcaagaagaagatgtacacaccgattcatgttggagatgtaattcgatttgggcaatcatcacgtttgtacatttttcaaggaccatctgagctaatgcctccagaaaaggatatgcagaaactccgtgatgctaagattcggcaaaatatgcttgatcgtgaagcttcccttttacgagcgaaaactcaagcagttttagcagatgggatctcatggggtatgtcggaggatgcacctgaagaagacggggaggatgaggcagatgagatcacgtggcaaacctacaaaggtcagcttacggacagacaggaaaagacacgcagcaaattaataaagcgaatggaaaaggttgccaacatgaagaaagagatcgatgcaatacgagttaaggacatttctcaaggtgggttaacccaaggtcagcaaacacagattgcacgaaatgagcaaaggatatctcagatcatggaggagctagaaaatctagaagaaa

SEQ ID NO: 76215 - DNA, 704 bp, Triticum aestivum
  Clone ID: PAT_TA_76215
ggcacagccccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatccactgccggtgggccatgttgggcgctctcggctgcgtcttccccgagctgctcgcccgcaacggcgtcaagttcggcgaggccgtgtggttcaaggccggctcccagatcttcagcgagggcggcctcgactacctcggcaaccccagcctcgtccacgcgcagagcatccttgccatctgggcctgccaggtcgtgctcatgggcgccgtcgagggctaccgcgtcgccggcggcccgctcggcgagatcgtcgacccgctctaccccggcggcagcttcgaccccctgggcctcgccgacgaccccgaggcgttcgcggagctcaaggtgaa

SEQ ID NO: 76216 - DNA, 728 bp, Triticum aestivum
  Clone ID: PAT_TA_76216
tacgactatataccctcccgggcctcgttctgcgtgcgggagcgaaccctattccttgttcttgaatctcgtccaaatctgtagcagagattgatcagagagggaaaaagatctctagagagagaaggatttaagagggcggccgaggggggagaatagaatgttcccggctgctgcagctgcttcctccaagaagcccggcgtgagcccgtcgtcagtccacgatcgggccgccgccgccgcgtgcgactccggcctcgtcctcaccaccgaccccaagccccgcctccggtggacggtcgagctccacgaccgtttcgtcgatgccgtcgcgcagcttggaggcccggacaaggcgactccgaagactattatgagggttatgggagtcaaggggctcacgctttaccatctcaagagtcatcttcagaaattcaggctagggaagcagcacaaggagttcggtgatcactcggtcaaggatgcaatggagatgcaacggaatgcagcctcttcgtcttcgggtatgatgggaagaagcatgaacgaccgcagcacgcacatgaacgagtcactaaggatgcagatggaggtccaaagaaggctccatgagcagctggaggtgcagaagcatctccagatgagggtggaggcccaggggaagtacatgcagtccatcctggagaaagcgtaccaaaccctcgcgtccagcgattgcgccacatggc

SEQ ID NO: 76217 - DNA, 667 bp, Triticum aestivum
  Clone ID: PAT_TA_76217
gccgagggttcccctacctgcgcctacgctgaagcttataacggtgaacgctgcacagtagctagcggggtatcactagtggtgtagcactgctgtagttgcatggcatcttcgggcagcgcggggagagacgtgccggcggcgagggcggtgaacgacctgatcgaggcgcgcgagggggcgacgaggctcaagggcatgctgcaggagcagtcgtcggagttgacagagctgatggacgggatgctcaacaagctgtccagcgctctgtcggcgttggacaccggctgcacggccggagcgtccgcgtccgggtcggccgatggggtgatcagggcgagggcggagagctcgaccgggaggacgaggaaacgcagcttcagcagaaggttaataaccgaactctcttcaggagcacacggtcgatctgaacagtgtgttgtgctgattaacttcttttctttggcaaaagccagctgagttcctttgatcgatgctcattttgattagtttgctcatcaacctttatatggcagattagaaggcttctctggcaagcgggtgactgacacgctggttgatggtcacatatggcggaaatacgggcagaaagaaatccaaaactcaactcatccgaggtacgtacacttgttttgcgatggaaact

SEQ ID NO: 76218 - DNA, 423 bp, Triticum aestivum
  Clone ID: PAT_TA_76218
aatctttggaaacatatgtacgttcacccacaacaaaaaaccacaagattttttccttttgagtatacaatatcagctcaacagttgcaacgcgtatgccagtggtcagactagtagcgtgtacgtatgtcattaaggtgtcacctctgactaataactagatataaaattgaatccagatcttcttatttctctgtgtctgtgtgtgtgtcaccgagatctttcgtgtgattaggcgtcaggtatatgtatatgcatgtatatactttgcacttttgcagctcccacctaagctaccttttacgctttgatttgagggttgatgtctgggagttgttgtgccagttgcgcttcctctgattgatgaaccagctgttgatttgcttcagctgcaggccagtctcttcaaccagcttggcctta

SEQ ID NO: 76219 - DNA, 646 bp, Triticum aestivum
  Clone ID: PAT_TA_76219
ctcccacaactccacctcctaccagctcaaccacactaccaacgcaggcagcctccatggacgctgtggagtcctcgtcaccgtactctccgccctcgctgcgccacaagctgcggaccaccgtctgcgcctgcttcggctcgccgggcagcggcggggagaggccgcacacggggggcggcaggagcaggtggaggcgacgcgtggcagccacgggggagttcaggtacgacccgctcagctacgcgctcaacttcgacgacggcgccagcgacgacgacgcggaggacgccgccttcaggcacagaaacttcaactcgcgcctgcccccctcgccgacgcccgcctcccgagccgtcgcaattgcctgaactgaatgttggcagcgatcgtccgttttaactttttgtagcttccgtctctctggatttccttcttctctgagcgagactgaatgtctgaatcagtgaatcactacatctgtaaaagcagtttatacggccggggaaacgtacgtaccgaggagtagcaaactagcaatagcaacatgtacttacacatataaggatcaatcagtccattttaatgttccatcaattctcaatgcaagccaacactacacggagataaagaattggtttcgttc

SEQ ID NO: 76220 - DNA, 706 bp, Triticum aestivum
  Clone ID: PAT_TA_76220
atgccttcctccgagaaagcccgtggccggggccggcaaacagggccgcagccgcctgttatgcaagtgcgaagccacgtcacgtggtgccggcaccggcgatgacgacgacctggtgcttcgccgcctcgaccgccgggacgtgctcctcggcctcaccggggtcggagctacgggcgccatcaacctcggaggcctcgcgctggccacggacgacgccgtcctggccacgtgcgtcaccgtgcccgtcacggacaaggtcatcaggtgcgtctcggccgacggcttccagtgccccggcgtgtaccgccccgaggacgtcgtcgacttcagcgcgctgccgccaccgaatggccccttgcgcgtgcgtcggccggcccacctcgtcgccgcggacgcagagtacgtgaggaagtacgaggccggcgtccgcatgatgagagatctggacgcctccggcgacccgcgcagcttcaagagccaggccgccatccacgaggcctactgcaacttccactacaaggtcaccgcggcggcctcgagaacgccggagatcgacttcgacgtgcacttctcgtccatcttcgcgccgtggcaccggatgtacatctacttcttcgagcggatcatcggcgagctcatcggcgacagcaccttcgcgctgccgtactggaactgggacgccccggatgggatgatgctgccg

SEQ ID NO: 76221 - DNA, 699 bp, Triticum aestivum
  Clone ID: PAT_TA_76221
gcacgaggcagtcctactgtcagcctcagctcgcccgaagcaaagctagcgagtacgcagcgcgcgatggcggccgcgaccatggcgctctcctccccggcgatggcgggcacacctgtgaaggcctccagggcggcgcccttcggggagggccgcatcaccatgcgcaagacggcgggcaagcccaaggtggcggcgtccagcagcccgtggtacggctccgaccgcgtgctctacctcggcccgctctccggcgacccgccgagctacctcaccggcgagttccccggcgactacggctgggacaccgcgggcctgtcggccgaccccgagaccttcgccaagaaccgggagctggaggtgatccactgccgttgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcatgcgcagagcatccttgccatctgggcctgccaggtggtgctgatgggcgccgtggagggctaccgcgtggccggcggcccgctgggcgagatcgtggacccgctctaccccggcggcagcttcgaccccctgggcctcgccgaggaccccgaggccttcgcggagctcaaggtg

SEQ ID NO: 76222 - DNA, 546 bp, Triticum aestivum
  Clone ID: PAT_TA_76222
ccaagggctgctgggtttggctgctattcggcccagcagcccgctcgagtctccgcgtccacttcaggtaccctgtccatggaggagtccgactccgagcagggttcgaccagccgaggcggcggagtgattggcacgtcgccgtccgccactccgcctcgggttccccgttccaaggcccttcgagctgctcagcttccccggatcccgacggttcccgcggcgcagcgcccggacttcgcttctcacccttcggaccaagtgctgatcaagtcctacctcaccccgcgtgtcgcctccggccaacacccgtgccagttcacgcacgatgtcgacgtctacaccgccagcccgggcgccctcaccaggaagtactccccgacgatggcaagcgacggcgagaaggcctggtacttcttcaccctcctgccggccaagagcgcccacggccagcggcggccgcgcacggtgggcaccggggaggggtgctggcactctgaggccggcgtgaagcctgttctcgacggcgaccatccgatcggatgg

SEQ ID NO: 76223 - DNA, 616 bp, Triticum aestivum
  Clone ID: PAT_TA_76223
ctggccgttcggcctctcgggattctcggaacgaggtaggaggagagaggaggaagacgccctattggccgggagccgccctgcctcactccctccgcgcccagtgtaggaagctatgagtggcatgggatcacggccgggcgagagcaacctggtggagccgagagggctgccgtccgccggcatggcgatgcagccctggtggacgggcaccgggttcggggccgtctctccggccgtcgtggcgccgggaagcggggcggggatcagcctgtcgagcaacccgttcggcggcggcgcgccgcaggggaagaagaagacggtggacgacgacccgcgggccgagagcagcgacgacgactccccgagatcaggggagcctaaagatggaagctttgacgaagagaagcagcacgccacatccaggatgcctgcattggcgtcagactatttacaaccatactcacagctggaactaaaccaaccgatggcttcggcagcgtacccgtaccctgatgcgtactacacaggcatggttggtccctatggagctcaggcagtggctcacttccagctacccgggctgacccaccctcgcatgccgctgcctctggag

SEQ ID NO: 76224 - DNA, 604 bp, Triticum aestivum
  Clone ID: PAT_TA_76224
ttttttttttttttttagtaatatataactttattttcttattagcatgtaaaacatgcaaaaacatgaaatgacatgtgttgttgaacaaacggagtacttaatacaagtaacatttagaaatacacaatacaaacattggtcataatttgatcacatttttccatgatagataccacatagttatatctgcagtgtatcaataaccatcgttccctgagagaaatgttcatacagcccggcaatatagtccttgaccttcactttcatgtacaatgctggtctcttctcatcgatcagctgagccgatggctcaatttctctctcatggtcaacagaatagtctagagccactgatagcctctctttctttgcatttgtcacgaccctatgcacagggctcttgaagaagccgttgctcattatctcagtctgatctcctataatgaccaacagtgtgtgaggtacgatcggtacatcccaccacaccccatctcttagaacttgcaggccaccgacgctgtcatcgaccatgagaagtgtaagaacggttccatcgcagtgaggcttgagaccaaatacaagctctggccttggacactct

SEQ ID NO: 76225 - DNA, 629 bp, Triticum aestivum
  Clone ID: PAT_TA_76225
cattggagaagtcggtggaggaaatcgtggagagctagatgttcgctacttaccctcaatgttgtggcatctcattgttcctcaaaatttgactttgtttggtgagattggcaggatggaagccctccgtactctgcatcagcccttcattatacatgtggagatcttgaagggactcggtaatctgaagaacttaagggagttaaagctatatctctttggattcagtgattttgaagatgccctactcccttcgctctgtaggctcgacagccttcgatccctagccaccgatgggtacaccttaggatatgattgtttgacttattggaacccacctccgcgccatcttcatagactgcatgcactgaacggccccttctccatggtcccagattggattgtgcaactcgaaaatctcaaaagcttggagatgcaactcgtgtcactgccaagggttggtgtcgaggttcttgccagtctgaccacgctggttcaccttatactgcgtgtaaggggcagtgtaagggatcatgctcccgaagaagacgtcgttgttgtccgtggtgcgacattcccaaacctcaagaatcttgtctttgtgtatgaagtgccctgcctcacgttcg

SEQ ID NO: 76226 - DNA, 565 bp, Triticum aestivum
  Clone ID: PAT_TA_76226
gaaggaagggcggagacaggaagaaggcggtgacccgctccgtcaaggccgggcttcagttccccgtcggccgcatcgggcgctacctcaagaagggccgctacgcgcagcgcgtcggctccggcgcccccgtctacctcgccgccgtcctcgagtacctcgccgctgaggtatgcgccgatctctcccctcctcgagcctctgttactctgttcttgccctgttcgacggtctgatctggttcttggctgaatcgcaggtgttggagcttgccggcaacgcggccaaggacaacaagaagacccgcatcatcccgcgccacctgctgctcgccgtccgcaacgaccaggagctcggcaggctgctcgccggcgtcaccatcgcccacggcggcgtgatccccaacatcaactccgtgctgctccccaagaagtcccccgccgccgccgagaaggaggccaagtcgcccaagaagaagatctccaccaagtcccccaagaagaagaccgccgccaccaaggagtagccgcccccatagactactatcgtgacaggatgaggtgtt

SEQ ID NO: 76227 - DNA, 740 bp, Triticum aestivum
  Clone ID: PAT_TA_76227
gtcccctaccccttcgacttccacggcgagctcgcccccatcatgctcggcgagtggtgggacatgaaccccatcgacgtcatccgcaccgccacgcgcaccggtgcagctcccaacgtctccgacgccatcaccgtcaacggccaacccggcgacctctacaactgctcctcccaagacacggccgtgttcccggtcaagtccggcgagaccaacctattgcgcttcatcaacgcggcgctcaacaccgagctcttcgtctccctcgccggccacaccatgaccgtcgtgggcgccgacgcctcctacctcaagccgtacaacgccactgtcatcgtgctcgggcctggccagaccacggacgtcctcgtcactttcgaccagccgccgggccggtactacctcgccgctcgcgcctacgccagcgcgcagggcgtgcccttcgacaacaccaccaccaccgccatctttgactacggcgccggtggcacggcgagcccggcgatgccgaccctcccggcgtacaatgacacagccacggtgaccacgttcacgacgagcctgcgcaacctccactcggtgggcctcccctcggcggtcgacgaggaccttttcttcaccgtcggcgtcggcctcttcaactgctccagcggacagaactgcggcggccccaacaacacgcggttcgctgcgagcatcaacaacgcctcctttgtgctcccctccaccggctccatcct

SEQ ID NO: 76228 - DNA, 703 bp, Triticum aestivum
  Clone ID: PAT_TA_76228
tcagcttctcgtctgtgaagcccatcttcgagcggaccagggagtccgacgaccacctggggtgggtgttcccggccagcgccggcgaggtgcccggcgccgaccccgaccccttcaacggcgccaagagcgtcagggacctgtacgagatcgcgagcaccaactacaccggcaaacccactgttcccgtgctgtgggacaagcagctgaagacggtggtgaacaacgagagcagcgagatcatccgcatgctcaactcggagttcaacggcatcgccgagaaccccgggctggacctcaacccggcgcacctccaggcctccatcgacgaggtcaacggcctcgtctacgacgccatcaacaacggcgtctacaagtgcggcttcgccaagaagcaggggccatacgacgaggccgtcacgacgctgtacgaggctctggacaagtgcgaggagatcctgggcaagcagcggtacatgtgcggcaaccagctcaccgaggccgacgtccgcctcttcgtcacgctcataagatttgacgaggtttacgccgttcacttcaagtgcaacaagaagctgctgagggagtaccccaacctgttcaactacaccaaggacatgtaccagatccccgggatcagcagcacggtgaacatggagcacatcaggaagcactactacgggagccacccctccatcaaccc

SEQ ID NO: 76229 - DNA, 565 bp, Triticum aestivum
  Clone ID: PAT_TA_76229
aatcggtttcctctcctccctgccgcgtccacccaaaccctaaccctagctgctccacgccgccgccatctccgtcgcccagcctgccggatcctcgccgtctctcgtcctctcccgtcgctgctgctaccccttgcgccgcccccagcctcctcacccggacacggcgaccatgagcgccagcgagagcaggaaggctggcgactgggcgctgccgtacaagggcctggcggccacctctgcgagtgggacgacttgtgcgcgtgccatcgccgggaggagcgtcggaggccgagaacacggcggcaataggaggcgacatgaagatggcatgtggaggatggctctccgagatggctgctgcggcaccgtcgccgtcgttctttccatggacaaccaggagtggcccgtgcaaacaatgtacaggaagcaagccaagcaggaaaatgcattgtatgatatatattggagaaaaaaaggcataaaagcagcactacgggatcacctaatagtacaaggtagtgctctgatgaagccccacgaatgcttatcaacagaagacttt

SEQ ID NO: 76230 - DNA, 687 bp, Triticum aestivum
  Clone ID: PAT_TA_76230
tcccgtgcgccgctgtgttcgccatcgtgcgtcctcgcttggaccagcaccggcgccgcccaatttctgccggccaaaccgctgccagtggccccaccaccacgtggggttgttagattagggttaaactttttttgtgagttagattagggttaatccatgatgtgggtattaattagttaattaatctgttaatggcatattaaatcaatctaaaataatcaatccaaaataactaacctatgacaagtggacccattcccttgttgacccagtcaactgctgaccatttgtccttgacagtgggtcctacatgtcgctgacaaaaggaggcagaggcaaaatgtctagaaaacatcaagtaaacggtcaaacccctttgacctaacggaaacggaacagaagggcaattctgtaaggggaactaacggcggaggggcatttttgagcaggctttggaattaggggtatatctgagtaggtggttcgagttagggacagaaatgtaaatggccctattatctatggattcattcgatttaccgattatgtgtatgtctaagcacttttcagtttgcatttggccatccatctttttactcatatcatagtatcttgggacaatttgcattcttttcacaccgaaaagggtacaatttgcatttgatcagtcggtttttcacctca

SEQ ID NO: 76231 - DNA, 686 bp, Triticum aestivum
  Clone ID: PAT_TA_76231
gcatcgaccggcggaacgacgccctccccatcgccgcgcctggatctcgcccctttctcactacctcgccaatgaatctcggtgggcagtggcggagacagggggaccagcaggggccctggcccccctggcattaggagtttgctgctaattcactgatgaacagtgcgtaattagcaattttttatgcttaaagtctgttttttctatgctttggccctccccaacctattttggctgcaatcggcccccctaattcaaatttcctggctccgccactgtcggtggggagtcgttcacggatctcctgatcagagcttctgttcccagccggtcgcaaccgagggtgtcccagatctggctgtgcaagaggagggggaggacgacggcgagtgcgggcatggagggaaattttctgttaccgattctccttcctcaagttctgcatcacaagttcatgaggccacggaagatttaatcaatgtcccggatattgacaacactgacaatcccagagagcccccatctcaatcgcaacgcactccaactccgtggcctcaaagggtccaacttggcaagatacccgaccatattatgtgatattgttttcattatccggaagaataagtgctctggagaaggccatatttgggtgggccgtgtggtgcaggctcgcgcctgatcca

SEQ ID NO: 76232 - DNA, 424 bp, Triticum aestivum
  Clone ID: PAT_TA_76232
gagggaggtcgtggagcggctgtttgccggcggggacatgccggacgtcggtctcggcgaccgcgagagcgaccacgacttcatggccatctgcaaggaagcgtacatggtgcccacggacaagcgcgcaccacgggccgccgccgacgcgctgctgtcccgcgtcgtgttccacgacggccgcctggtccgccgcccagacccggcgcacgcgctcttcgcgctggcctaccttcccgttggcttcgccctggccgtgctccgcgtcctcatcagcctccccgtcccgccgcacctcgtgcgccacacgtaccgactgaccggcatccggctcgccgtgcggggcacgcccccgccggtgccgcgcggggggtccccgggctccctcctcgactgcaaccaccgcacggtgctggaccccatc

SEQ ID NO: 76233 - DNA, 535 bp, Triticum aestivum
  Clone ID: PAT_TA_76233
tctctccctcagctccggcaagcaacaccagctctcctctcccctcgcttccctgctgcaatgtcgaccgacgtggccgccgatgtcccggcccctgaggtggaggtgaccgccgaccccgtcgtggagaccacggccgaggccgccgccggcgacgcgaagccggccaaggagaccaaggccaaggcggccaaggccaagaagccctccgccccgaggaagccccgcgctacccccgcccacccgacctacgccgagatggtttcggaggccatcaccgccctgaaggagcggacggggtcgagccagtacgccatcgccgagttcgtcgaggacaagcacaaggcgcacctccccggcaacttccgcaagatcctgtcggtgcagctcaagaagctggtcgcctccggcaagctgaccaaggtcaaggcctcctacaagctgtcggccgccgcggccaagcccaagccggcggcaaagaagaagcccgcggcgaagaagaaggcgccagccaagaagaccgccaccaagacca

SEQ ID NO: 76234 - DNA, 544 bp, Triticum aestivum
  Clone ID: PAT_TA_76234
cagggtcctcccagaggggcgcacgacgcggatgctgagggcgaggtcccctctcccaagccgtcccgtgcccgaagtgttcaaggaggccaaatcagccagcaagaggttctccacgccgccgccgcgccggaaatcatcgtctccgccacgcgcgccgccggtggacgcgccactcaaggcgccggccaaggtgaagcaccacaggaaggagcactgggacaaccaaagggccaaggcggccgcagagaaggtgctccaaaactggacggtggatcgcaagcagctcctcgtcgggcagaagttcgcctatggggcgcacagccgtctgttccatggaatctacaaggaggtgcccgttgctgtcaagttcatcaggcagcctgacgttgaggaagacgcggaactggcgtctcagctcgagaagcagttcaacacggaggttgtcacattgtcccgcctccagcatcgcaacgtcattaagctggttggaggatgcaccagtccgccagtcttctgcgtcatcaccgagttcctttctggt

SEQ ID NO: 76235 - DNA, 716 bp, Triticum aestivum
  Clone ID: PAT_TA_76235
gatgaatgacggtacgaattggataactttctcatgaaatatacgtcgtgtggagggcaacatccagaattacttgaagatgcacagaattgctcatcggcaccaacagcgacagtgactgaagttgctccgacccagaagatacctgaagtggctattattgctagcaaaccaaagaatgtcaaatctcttcgttggcttttagtgctcttactggctgtggtgctaataggattgcttttttggggtactcttgagctgaagaaaagaagagaagctgggagagttggacctcaaactcaggaagttcagttaggtcgcagagtgaccgtgcaggcacggcaaactgcagatgattcaatacgtaatcaacacgtcgacattcctattcttgaagatctgccgtttgttggtccgatgacgagaaatcgtttcaattcactgaaagagagagccgcgggaactaaggaatcaactagtgactgagcttgaacacacacgggtctggtcagcttgaacttgcatttcttgcacgcagtagtccgtcgtaggcagtccagctagctgctcaggcaaggacacagggtttcagtcctcatctatgttgctctcaagaagttcatctgaccatatcatcattatccctgtcacaatgcagaattttgatcaatttcagtacttccagcagacgcacatgatcgttgtacactatccct

SEQ ID NO: 76236 - DNA, 676 bp, Triticum aestivum
  Clone ID: PAT_TA_76236
tttttttttttttttttgattatcattagtattacttgctatcaagccgatttcctacataggaaaatgacgataaggcatgaaagttaccaccaagactagaagctccagaatactgccatatgctgattgggcatgggatttccagaaagattggtccaaagcagaacatgccaattgaacacggtttccttgagaagaccaattcaaagcaaaaccagtaaacacggcactaacgcacaatattcggtgcagattgcaagagaaaccccataaaacaaaaacaaaaactctgcactggaattggttgctgaagcaattgactttgtcatacctgatactgcactgttactgctagtatataaacatcggtagcatcaaagctcacaagggcacagctgcacaccgctgctattcccatactccaacgatcgcagatccacaatctaccaaacttactagcaccatggttgctgagtggtcagttgggcttttcgactgctttggggatttccgcacctgtatgcagacctggcttttgttctgttattcttgcaccccttgtacatgggtttcataagcagcatgcaaacttgcaaagtactcatctatgttccattccatttccaaacattgcaggttgcttgactttctggtgcccctgtgttacctttgg

SEQ ID NO: 76237 - DNA, 630 bp, Triticum aestivum
  Clone ID: PAT_TA_76237
atcgactgtaagtatggatctcgctcctttcaagctggatattgacgagctactagatgattatgccaaggaaaattgcatgtcattcaccgatttcaagagagtgtggatggccaagaagttttcttatatctatgaaggccgacccaagacaaactcaggcgtttttatgcaatccctctttttgcattgtattggccatatgacttcccaaagttctctacttcagaggttgcctggtctttactgcctttactgcctttatgagtgccaaccatacaagccacactacaaaatttatctgtctcttgaggagtccaagaaactcaaagactttgtcattgaggctaagcagaatgggcttgcccttgtaccagcacttgtcaaaaggatgctagacaagggcatgtttctgtttgggttcataaatttgcttggtgacaatgaggcaaaggaggttgatgaaatgaatgcatcccagaataaacgggtgaaatttgcctgtgacaagttgtttgcaaatactcaaatagggagttatacgcacacagacttgggagtggagtttgaacttgacagcatcaagaaattgtcaatggactatgctaaagccaaagaatcagcctttgc

SEQ ID NO: 76238 - DNA, 746 bp, Triticum aestivum
  Clone ID: PAT_TA_76238
ttctgtcccacgattagctgtttagtagtctgcctgccctcatacgcgattgagatctatttagtcctattggcatgaaacggattcaaccattttctcaaaggttgccttgttgtgttaagcgctgcaggacgtgatagactagctctagaatgcaatcgctatttactgataattgattttagttcgcgatttactattttgtctcaccaatgtctcagtgttgtaatttgtgacaatttatttgtagttgtagttatagtccacttgtttttaaactagcacccagcattcaagtgttgttagtcgtttgtgtttggtctaaccgattcctctgactgtgttcctatgtcgtatgtgtagcagtaggcacactgaatctcgtttttaagcctttgcatttacattcatttaggaatttgttcaatgtttgtttgttgttgtaaagttgactgtattagctaactgcacagttcatctttattttagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcacccctgacaagctcaggtctcttgtgaggaagtggcagacactcattgaggctcatgtggatgtgaagacactgacaactacatgctccgcatgttcaccattggc

SEQ ID NO: 76239 - DNA, 629 bp, Triticum aestivum
  Clone ID: PAT_TA_76239
atcagcgcggaaaccctcacaaacagttcttcagcttcctgtcgattcgcctccacttgaactgcacgacggtgagcgcacaactgtcttctcctcgctctcttgccatgtgccctgctgccgtgcattcgctgtgtgcggcgtgcttcttgcttgcgcggcgggctgttgcgtcgcgtgcgtgcagggcttacgtgctgctgctgcatgtgtgatgtgtgggcttgatgcatgcgtgtagtagctaggtgatggtctcacactggatccgtatacggatggtgtagatacactatttcttattaactcgagtacatagctctttgtttcttatcagaagcaaactcatgatggctcctgaatattaggtgccatattgtatttttatacaagtcaccgcatgttgctttatttaattatttcattgttgatcgcactagggaaacactaggtttgtatcatccaatctaaaccagttctgataatctctaatttatattctactgcctggtggtatggtcattaaattccctatcttggaatagcagttgtaggctaaggaggctataaaaatgaagagttgatagacagcaccattttaatgttatgtcattcttttttttttatga

SEQ ID NO: 76240 - DNA, 641 bp, Triticum aestivum
  Clone ID: PAT_TA_76240
ccgatagtcgttgcgatgccggcaagagagttgtgtgattccattttggcaagatgtcagtgtgatgctgacaaacaaggcacttggtgtgatgtcagtgctagttgagatgacgtggagccgtcatgagaagccgttgttgaagatgcgagtgatctgcatcggtgatttgaagggaacaagattaggggagtgattgttggaaataatcttgttacctcgaaatatctaggccatgtagctgcgacggcaagaagcaaatgtagcagtacaaaatatctgtagcagtcaaaatatcaggacatcatagaggagcatttgctacagcagctagaagcaaaatatccaatgcaagtcggcagaagcttagctagtaaggaatgacgtgtcactagtagaatggtgcatgcatgagctgtacatgcaagtggtaaattctagtacgtagtgtagcttctaggatctgtgtgctggatgtgctaggtctgtgaggtgggtgtacacgtgcatgtactagttgcatagtcggtttggtgcaaggcggttcaggagtactatacaaggagccgcatccatcgttgtacaaatcaagcttgtgaccattgagaaagcaatcaagcttcaaaaaaaaaaaaaaaaaa

SEQ ID NO: 76241 - DNA, 360 bp, Triticum aestivum
  Clone ID: PAT_TA_76241
tcggccaccttgtgatggagatgcctccctgcttcaccaatgctaggctagaccccctccccacccaacaggtttacgcgtgcttgtttccttgcctgatgcggaaggggaggcttgcaagcaaccccaatctgaatgaattcagtcagggtcatgcaggggatgcttgcttatgtggttgcagatcgacttgcgatatgttaagcgaatcaccatgtcacgcaatgagcaattagagaagagtgtttcacaaaggtgagataaatgatgatgtaataatggatgccttctgaatgctgcatgtgcggttcccgaattggaccgtatatttttgcgaagatcttcaagtaaaaaaaaaaa

SEQ ID NO: 76242 - DNA, 662 bp, Triticum aestivum
  Clone ID: PAT_TA_76242
ccccatgtaacgcatccctcgatgctctatgcgacggacgtggttacaacaactacaatgttgaggtcgttcagcgactcggtgcggactctttctgcccagactctggtgtcatgatcagcaagaccaagaacagcgatcgcgtgcagccgttccaatggacgattgatgcaaacccgcaggatgcgcgtcagatcgatttctatcttcccaacggtaccgcaagatactggaccattggcgactacaggcaactagtcgatgccttgttccacgctggtacaaactctggctcagaatacgagcacatcgatcacgagaacggcctgcatctgtacatcctcgagaagatgactgatgacaatggagtattgcactacaccgtaggcgcggcctccactgcgaccaacgttaccacgtccgctcaacatggcattgagctcggatctggcaaggtcgtcagtaacggaaacgctactagtcccgcggacggcctctactgcactttcgagctgaagaacactggtaaagccgcctcgcttgcgacaaaccctcatccgcaggatctgtccgcctacctcgggtcggatatttaccgtttgaaggccgaggtcgaaggcgctggttggaaggccgctgtccccaacgcgttggcttacgcc

SEQ ID NO: 76243 - DNA, 254 bp, Triticum aestivum
  Clone ID: PAT_TA_76243
gcacgaggtcgcctccgaacttggcaggccgtaccggaattgcgcacttccttctgcctaggcaagcctgaaagaggaaaaacaagcacccatatttttatgattgtagtggtaacaggatagtgcattatgatatcagcatgtaacttctggaaaggcagagggttttacatcctttacaacaaactccgttgtctcggcatggcaactcccaaggcaactcctgctagaacttctacagtcctcgaccggat

SEQ ID NO: 76244 - DNA, 726 bp, Triticum aestivum
  Clone ID: PAT_TA_76244
gcatcctgaatgcgacacctcttccgtacctggtcgcaagtgttcccttcttctgtccttcaagggatcgaggatgagcttcagttttctccttcagagaataagcgtcctgccacaacgactattccgcgacagtcagagtcgttatctcctaggccatctcatggcatccatgtaaatccaaagtatctagaagcgcaacaccaactcaagaacggtaccaaggtggatcagctagcaactcgaggcaggcaaatgcttgacgtggcggaggatcatattaatgggttaacaacaaatagtttgcggggatttccttccacttcttcaaagctccagagatctatgatactgtatactgaaaatcctgatcaacaagaaacatttcaatcacgtattggattgataagaagagatatgtccagatcaccacctcctgatgtgctccctaggaatgcatccccaaaaagaccactagagatgccgcggctgtctcattctgcattggggcatgatcctagaagattgcctggtaggaatggttggtttgaacggcaacgtgcttttgaggatagtgcacaacggccttcgatgagcacgcttgatgaagaatataggaaacaaagtgcaagagaacttattgatgcctacggaaattctcaaggcaatggtgctgatgataggcttcccaagatgcaacggctagaatcaaatggcatggcaagt

SEQ ID NO: 76245 - DNA, 746 bp, Triticum aestivum
  Clone ID: PAT_TA_76245
agatagggcttaatacatcatcaaggtcgataaaaagtgacatgtatgcttttcaaatgaagtggagagatgaaatgtctaatttaggctccaatttaaaatgtttggttgatgctgctgacaactatcacaaagttctcgctgaaaaccagaagttatttaatgaagtgcaagaattgagaggcaatataagagtgtattgtcgcgtaagaccatttcttcctgggcaagataaacaatcaactactattgattacattggtgaaagtggcgagcttttgatttcaaacccattgaaacaaggaaaagatggacagcggatgttcaaatttaacaaagtgtttagctcatttgcttctcaggcggatgtattttctgacactcaaccgttgattcggtcagttcttgatggattcaacgtgtgtatttttgcatatgggcaaactggttctggaaaaacttacacaatgagtggacccagtacatcaaagaaagattggggtgtcaattaccgggctttaaatgatctatttgatatttcactaaataggagaaatattttctcgtatgaggtgggagtacagatggttgagatatacaatgaacaagttcgtgatcttctgtcaaacaaaattgcgcagaaacgacttgggatttggagtacttctcagcctaatggactcgttttaccggatgcgagcttatatccagttaaatcaacatcagatgttttagatttgatggaa

SEQ ID NO: 76246 - DNA, 300 bp, Triticum aestivum
  Clone ID: PAT_TA_76246
gaagctccatggcatcttccaagcaaagaacaaaaagtcacagctcctgctcgtgctccacttgtccacaagatcaaacctacccactatccaagcccaaatgttagccaaatcagtgcagtacgtagtaaaatgttctatgaccaccgagcgagggcaaatcctgcaacagctggtcacctaatttagcctttcccatcagtagtgtcgtaatcatggggccatctttgagtggaagtcatgtggaacgtgctaaaaaaaaaaaaaaaaaaaaaaaaaaaaaaaaaaaaaaaaaaaaaa

SEQ ID NO: 76247 - DNA, 749 bp, Triticum aestivum
  Clone ID: PAT_TA_76247
gacgggttatggatgaaaaattgtcagtggtggtaggaagaaggatgaatcaagatctgcattgttgagcaaagaaacccaagagcgcagcaaacagaatgagcctgggaggagaggtcaaggtgcagaagaaaacaacacgcagaataaagggcgagctgatgtgcgtccacgtgatgacaatcccaataacaatgaaaggaactccagacaagataaaataaacaagacccatgacaataatcgtgtatctagcagttctgatgctcgccaggctaatagggataagcccagggagagcacaagaaagggcagaggctctgtgccaaatgagcaagatcttcacagatctagcaagagaagacgggaagaccatgaaagccatcgtagtgggaaggttgaggtgaaaggagggagggagcaagaaaatggtagggatcatgctacatcatccaaaacgagcaagaatcctcaacgacatgattcatttgtgaaacaaggggaagaagaagccatgtcagacgatgagaacaccgatgattcaagaaggggtcggtctaagctggagcgatggacaagccacaaagagattgactatagtactattgataatgagaccacacatgcatttccttccatcaaagctgatgttcaaccccccactgctgatgcgtcaggtaaatctgatgttcctgctatagttgtcagttcggacatgaagaacagtggtgataatgggcaagcctctg

SEQ ID NO: 76248 - DNA, 208 bp, Triticum aestivum
  Clone ID: PAT_TA_76248
aatcatgcctttcatgtgagataattgagcatgtttgctttactggcatacaacgacaacgcatgtccatttcaaatacggtacaagtgtgtgtggttatagagccacaatgttccaaacatttggcagataagagaagtcctgataagcatgttgctttttctgcaggttccgttcggttgcttatctgtcgcaaatctggtggttt

SEQ ID NO: 76249 - DNA, 500 bp, Triticum aestivum
  Clone ID: PAT_TA_76249
gacgagagactgaccggctgggcccgacggcggcggcatctcctgcaagagcgtgtgcggcgcgtttgggcagcctaaggattgctccatggtggtggggaagcgcaggtgcatcggcggggcgtccacggcttcagctgcttgcggctatggtgacagcttgtgacgccggagcttaggacgccgacgtcgacgacagagcgctgcacggcggcggtcaccaggaacgttttttttttctgtacacatggtttgcccagtatcccagggagacggcacccggcttacgagtcatgtatgccacagcccagccaaatgtaagcccagaggagggccctcggttttatatataaaccgtgtgtctctttagccctcggcttacataaacggacacgtggcattgccgttaatatccggctgccgtcctttataaaccgtgtgtctattggcgctcggcttacacagaactactcggtttatgtataaatcgagtgtttttc

SEQ ID NO: 76250 - DNA, 703 bp, Triticum aestivum
  Clone ID: PAT_TA_76250
tagatggggttctgatgagtggagatgaaacattaagtaattcatttactgccttttgatctctttcgagtttaactagccttttgatctctttcgagtttaactacaagtcattgtttaggaaggttctttggtccatcttggcaaagctgtgacgtctcaaaggcaatgtcctgctttgattgcttatggactaagaataaacgtctctctgactgttcagcaccttggacaatggggttctgatcagaggagatgagacagtcaacatatattctgcctttttcctgttttgagttgaattagtggtcgttctttgccgaagttgttttgtagtccatcttagcaaagtggtgagccttaattggtaatgtcttgcttcaacggggttgtcctcaatggaaggggcgcagatcagcagagatgtaaacatcttagtcaaagattaccagaccgctgaaatgaaaggtggctactacagcagctttggtatacctttgttgtggtatctgccgaagtggttgcaattatttgtgtacttcattggttttggcagtaacctgatttagtttttgacagacttgaagcaaatctctgttatttggttctgcacttcggtatattttgttgaacaataccaattacagctactatctttaactgcctagcctgtatagtacgtcaatatcttttggttctgcac

SEQ ID NO: 76251 - DNA, 697 bp, Triticum aestivum
  Clone ID: PAT_TA_76251
tggtgtttttcctgtgcgagtgcagctacagaatttgccccagacatcaccattatatctgcaggttttgatgcagcaaggggtgatcctttgggttgttgtgatgtcactcctgccggatactctcagatgacgtccatgttaactgcttgctcagaaggaaaattgttggttatacttgagggagggtaggtacccttttcttatctgaactcatggagataataaaagaagacaggacctagaatttatatttttaagcaggatttgtgatatgtaacttgtacactgtaagctggacaccaaaccccgtgtcaccatggtgctcatggttttttgttgcattcgtgctttgtatatggcatgcgaaatttctaacatcaccagaatgtggatatgtgttcatctaatgctagtgtggacagatgtacttcttttcctagatctttgcaatggatccaaacattcttataatctgtgtagccaatgttcttataattttgtgctgttgtggacactaatataacatcacaagagatgattgcctgtctgttgtggaaacttagatgcataccattatgcttgtatttgaacttttgacatcacaagagatgattccctgtctgttgtggaaactaagatgcataccatgatgcttatatttgaacttttgagccagtgttcttatacatttttt

SEQ ID NO: 76252 - DNA, 735 bp, Triticum aestivum
  Clone ID: PAT_TA_76252
atggacttgccgcaggctatctgcaggtatctgtgcactcgtatgttgtggtacatacagtaggacggccgcttctagacatgtgtgttctacagaattgtctagtagtggtacgtagtaccatgaatatttaggatgctctggttttgaagattacattatattttccgcaaaaaaaaattacattatatctatatatatatgcaacagggaaggtaagcagataacaaccattcaggatgctgcgcctacgatcatgtgatctttctccttgattaaagaaaatttagtgtggatatcatcgtgattctcacttggaaagagcatcctgtatacacgtgattactatatatgcttctaatattcctaagaaacaagacaactttaacacatgacaattgtggatagaattgacaacaagtagtaaagtaagcagataaggaaggacgtgtcattgagtcaataggctggtgggacttcacttcaggtttagtaagctcacacggcttcttttctcttgcgtgttttatttatttataattcctgtgatgccatggtcaatcgttgtcaacgaataaaatagtccattgccttgcctccaaggtcagttagactaacccggttgtgcttccaaatttatttcgaggagattctatacattcattcttctagggccaccaaacttaattttgattgttaccgacgcagtttgtagatttccctggaggaaagctt

SEQ ID NO: 76253 - DNA, 699 bp, Triticum aestivum
  Clone ID: PAT_TA_76253
cagaggagtcggcggagatgtcgggagtgacggcggacgaggacaagaagcccgcgggcgacggtggaggcgcccacatcaacctcaaggtcaaggggcaggtatgatccaatccgatgtccgtcttcccctctttttttctcgatggagtactggttctgttagttgtgctggcggtcggatcccaggattggggttggtgtggtagtttccagctccgtgccgtcgatttagaatccggatctctgtttctgcttcgaggccgatgggtttgtttagatgcgtggctctgtagtctgcagatgcgtgtgcctagtctcgccgactggtgtcccctcgttagttcgcacttgaggctcctggtgctcgccgcgctgtgtttgtaatgtttgagtctgcttcgtcatcgatctgtaggcctacttaacagtcatataggcctacttaacagtcataaaggtgcattctttagccactggcagggtaggatacgcccaaatgtggtcagtatagtgaacctaagtactaggcaaaacttgagctcctgtaatcctgtttattagtgattatgatcttgttttctaattttgcattggtattcagaaataaaattcatatgttcttcagaaagtatgtcaatacataactagtgcaagatcagaaaataaattgttttattgcttcgtagtcagttttcag

SEQ ID NO: 76254 - DNA, 799 bp, Triticum aestivum
  Clone ID: PAT_TA_76254
aggcgctcagcagctcggcggcgatgggactggtagggcaggagttggggtccgccgtcgttcggatgcatctccgacgaggtcggcgcactcacagagtcaatctagaggcacctgggtggacaaaaaggttacggctgagcagtgcgccacctgacaggacatcacgtccctctcggatgagcgctttggagcaatcgattcgcaaatacacagaggaacctacaatgaggactgtacttccgctagcaagaggtctactctggcagcatgcaatgtgatgaactattttcaataaacgcttaggtcaatcgcgcaaatatatgccgattttctagcaaatacaactgcaactctatttggccaatctcagagcaagctaccaagacggaagtacattttttagcatggttttgcaactgacccattgggacggggggttgtgccgcatccaccacaagctgccaccaccgaccttattgtgatattgtcacacatttctgcaaaacttcagacaaggaacttcataggtactattatcttattcatgccactccaagaattattcgcatttctggggttgccatgcgtcagcagctaattgggactcagaatcttgatcatgagctggcctcaatcattttcagaagatattctcagtctgaccaggaagctaatagtgagtgcccatgcctaaattggaggcacaacatggaacctgattttgcgaaccaactcggcggcaaggacttcccttatgaataatctcctcccagatgtttttcataccagtacctct

SEQ ID NO: 76255 - DNA, 747 bp, Triticum aestivum
  Clone ID: PAT_TA_76255
atgccaattcaggccaaatcagcagatggtagacgatggatttatggccctgattcagggctgaacacagaggttccctcatatgacctcggaatagacaacgatgaaccagtcctgtcgtcgggcagggaattgacaattgtggctacaaaacaacacccggttcacattcagcatgacattacccaggctggtccaagcagattcaaattactggtccaagcagattcaaattagatttcacaggtttttaggagcaaagacccgatggatgatttcagcgaagcggtgacactagaaggtaaaaaaactgtcccatgagatgtatgacacctcaccattcaactttcgggtcaacaccttgttgtcggatgtttcagaacccagcatgatagaccgtcatctgaacccatatataagactaactttggcttgcagacccaagaatgtctccacatgaactctgtatacagtccttgctctttgcaagtgtgttcgtctgaatgattgaggcaaaaatgatgaattttttgctgcaacaaattaataatgcttagtggtagcacactgatatccaaactatgaccacatatccgaagtataacatcttagctcgcgcatgcgagaacaagattgagaaataggaagtggtttgcatgaaaacaattaaaggaattgctccaaaaacagagcagtcggaggtgtataaattatctccctgaacttcagctaaaacagggcgacaga

SEQ ID NO: 76256 - DNA, 500 bp, Triticum aestivum
  Clone ID: PAT_TA_76256
gcccgcatcatgttcaactccagcatcaaccctgcggagaacgttatcgaggttgatggtaaagaattcaattttgcatgggcatccgaacggggtgagttatgtgatatttatgaagaacaacagagtggagagggtggaaatggcttgcttgtggaacgtggatctgcttggcgcaaggtgactgtggaccgcactttggatgaatcagcaaagaaccttgtgaaagcgcgctcagaggaggctgaacgtctcgcgaaatctcgaaaatcaattgtgctggaccctgggaatccatctgtcaggaatcaggccaagtcaatggttgcagccggagaaggtaatatgcggagggggaaatggaaccagaagaaggacaatttcaataagaagcaagctactgtcattccaaccaaatcaatttctaaagtaaagctgcctaacagtattcccaaaggaagtatctcgacttcacctgtgccttctcctgagcaacctgg

SEQ ID NO: 76257 - DNA, 238 bp, Triticum aestivum
  Clone ID: PAT_TA_76257
ggaagatcggatcgggtcatcttccccaactccggcaaccacggccgccgcctctttctcgttcatgtcgacgccattagggcctccccctctccactctcttcaccaacagcaccctggagcacccacgaatccaacccacctctcgattctgctcaggagccgccgtaggcgaaagctcaatcccacccgacgccaccgtccaccgaagagctcgccgccggtgactccgtccact

SEQ ID NO: 76258 - DNA, 642 bp, Triticum aestivum
  Clone ID: PAT_TA_76258
actcatatgacgaacaatcaggcacatacacagaaatgcacggggaacaaaccggcatgcacaaagaaatagagggagaggtggtcaaggagtagccggggtgtaacagttcgcccccaagataggtggtttctaccccccagtgttttgttgatgcggtgtagcttcagtatgcagtagagctgtagaggcccatctcaactatcatggcagaattatcatgttgacgacgaaaagagctggttacttatgattgtaggatgttaattgaagttcatgcgatcatccacggagcgtctgcccagttctgtgttgtcgtttttctctaaccatttgccgactggcccaccatgttcatgcagaaagaaacctgcaacatgtgttataatacatcgccctttgtgaaattggaacctcactgtaacttgtgggatcatataggagcaagacgattgttggtcctgattgaagttgttttgacagagaaggttttgtagctttgaatgttgcgtacttggcataccacgagcacttattctccgttgctctatacatctgggtttcccacatggaaattctacattttttttgttaatacataatcaggattaacggcatgtatctacagtataagaaaaggca

SEQ ID NO: 76259 - DNA, 643 bp, Triticum aestivum
  Clone ID: PAT_TA_76259
aatcaaacgcgtgcccgcgcctgcgcctgcctttacacacgcaaagttgcaccgaaccaaagcaaccgcatcgcatctcatctctgcctgttttggttggattcaccacctctctgctccgtaccgcgcgagtccagtgagtccgtggccgatagccgggtggtggtgccgtcgctataagggcacccagctagccacacgcacggctccgtcgccttggatcgggctcgtcagtgagtcagcgagtcagggccttggcacggcgcggttcacccatgggcctcgccggcggcattgtccggagagtcctctccaagagcccctgcggctcctcctcgtcggccggcggcggacgcggcggccacagcgaaaggagccccggcgaccacaagaggaggtggggctctctgaggctgtacctgtacctgtgcggcgacgagaacggcgcgggtgccgaggacggggaggacgacgatgacgggacggtctcggccaggagctttgagacctgcgcgatgacgcaggacgcccaagctccggcggcagccgatcagcgtcgccgtgacgtgaacggcggcgcacacggccacgctgaacaagtgcacgttcagtggagccccggcgagcggacgaagccgttcac

SEQ ID NO: 76260 - DNA, 545 bp, Triticum aestivum
  Clone ID: PAT_TA_76260
ggatggacaactcctgttcacggcagcgcagtggcgggcgcgggagcggcagcacggcggagcacgggacgacgacgacggacgtagcgtggcgtcgaggagcggcggcaacaggcgcaggcgctgctacgagtgcggggagcacgggcacttccggtacgagtgcccgcagctgcggaaaggaccagcggcggagcaggctctcttagctggtgccaacgtcgacgacgacggacacctctaggtcgtggcttagggtgtgtgtgttggaataagccacgtcgcatagtgtggccgggctcgtcgggcgcgtcggatgcgcgcgtgacgggcgggacgcactggtggtgtcgggctcgtcgggcacgtcggatgcgcgcgtgacgggcgggacgcactggtggtgtcgggctcgtcgggcacgtcggatgcgcgcgggacgagcgggacgccgtggaagtgtggcgtatgtgtgtgtatggcggtgtgtggccgtgtcaggtttgtagtgtgcgtgtgtgacgtgcgcgtgtgtgcgtgcgtgg

SEQ ID NO: 76261 - DNA, 694 bp, Triticum aestivum
  Clone ID: PAT_TA_76261
ctgccaccgcgccattaactgcgcgcattcaagccaccccgctgcgctccaactaacgtccgcagctctacgccttaaatgcgcgcctcccctcgtcccgatcccctttccttcaagcaagcaagcaagcagaggagagggaccgggaccgggagtgagaggaagttgagctcttggcccctgactgctggttgagatgtcgaagatggcggacgagaaggtgatctcggcgccggcgaccggcggaggggaggacgggctgatcgcaggggacctgtcagccgcggaggcgcgggtccgtccgttggagacgctgctgcgcgccgcgcctctggggctctgcgtcgccgccatggccgtcatgctccgcgacacgcagaccaacgagtacggcaccgtctcctactccgacctcggcggattcaagtacgttgttccctcgcatcttgactcccccgcccctggagttcattagctccttaatttcccctctttgccgtgctccctcaccaattcatgtccctgtgtcttttggcacaaaatcaaaggtacctggtttatgccaacgggctgtgcgcggcctactccctggtctccgcgttctacactgccgtgccgcggccggcgacgctgtcccgctcctggatcgtcttcctcctagaccaggttattcactggttcctctcctctgcct

SEQ ID NO: 76262 - DNA, 526 bp, Triticum aestivum
  Clone ID: PAT_TA_76262
aaagatcttggctgacggcgcctctttcacctacgactgctgttgaccgtatggaatctgttttcactgaacccttgagtactgacagcggattagacagataccatcaagttgcacagaagcttgaagccttgattgccaatgatggtaaagatgtagaaattcagtctgttattgcagaagttcctgatattttacacagatgtgttaagcgggatgaagctgcattattgattgcacaaaaggttttcagaagtttgtatgaaaatgcatcaaagagtacttatgtcacatggcttctggcaactttagctgcaatacgtgatgtttgcaaacttatcgttaaagagataacaggctgggtaatttattctgaggaagaaaataagtttaaccttgacatagttacaggactaattcgttctgagattcttaatgttggggattatgatgttcatctagcaaagatcattgatagtggaagaaacagtaagttgaaacatgtatttctgtatttgaatattta

SEQ ID NO: 76263 - DNA, 735 bp, Triticum aestivum
  Clone ID: PAT_TA_76263
agccccctctcctctcctggtcctcggcagaggcagcacaagcgaccgccgcaccacgcaagagagcgtcctctcaggccacatcggggaggacccggacgtcgtgttgtggatcgtgtgctgccaagacggtcgtccttggccacctgtgcgacgacctgcgtgtcgccgctgtcaccatcggcgcagggccaaaaggagacggccgcacgccagcatcaccaggaggagcaacagggagtagcgacggccaccgagatggccgtccacgtcgccattgtcgtcgtccttcatctgaatcggcgagctatgacacgttcgatgtgcacattaattgctgtcaccgaagagacacgatctgtagttgctcctcctctatgttgtgttgttgctgcctcttaaagtgctgctccttctcgcccagctcctccgccttgtgctctcctcctcaagttgccagccaccctcgatctactgctcctcctatcaccacacctccccaacctcctcgactagttgaagaggtgcaaaatagaatcatgcgtgataatagagagaaggatcctgctcttctctcgaagaccacatgattcctgccttttgttgattgattttgccgactcagaacgatgctttgtatgctttatagtatccatcgcctttgccaagtcatttgtccttcgagttgtatttggaacattgccatctctagccgacctgcgcaagcagaaagct

SEQ ID NO: 76264 - DNA, 775 bp, Triticum aestivum
  Clone ID: PAT_TA_76264
tcatcctatgccttcatgtttgttagggacttatctactatgataccatatacatgcttatggaaggcactcaacagcatattctagaaaaaaatagaggtttattatccaggtatatttatctactattgtacttgagacctgacattcaaaaggaaaatttcaatattaatagctgataaagaaacgctccacagttagtcgatacacatgtaccaatctggagttagtatacatgcttgagatatggtcctattgttagtttggtttgctattgagtacattggttataattagaattgcaatagtttcgttataggatctaagggacatttagaagcttggcaaaagacgtcatctactcatgaataatctcatcatctgaaaatggattcagagttaggccacttacacatcatggtaaacctcctggttcccattttgtctgtatttttaaaggggtgctaaaatcctggatggtcattggatagtggattagcatcagtgcttaactaagtccctggaaatttggataagcagtttttctttgaagtgtatatggttctagactttctttttgtggtaaaggcagaatcttggatgatcattggacagtggattagcgttagtgcttaaataagtcccgagaaatctggatgaacaatttttctttaaatgtatatggttctactggtaatcattaatctgtaaccttgtgcttgcttgtgaccagtaaggttgtgacgggttgtcatcccatggtttttctgcagca

SEQ ID NO: 76265 - DNA, 663 bp, Triticum aestivum
  Clone ID: PAT_TA_76265
caggctcgccgccgcccgcctcgacggccgcgtcagggtgtccaccgcgctgtcgtcggtgcctctcgccccgtcctggtccgccgccgtcgcggggctcgtcctgcggttcctgagcgagaccggctcgccgctcttcctcaagcaggctcgcgcgcgggaggccaccgacgacgacgccagagtcggcgacgcgtacgccgcgatgcgggcgctcggcttctcgggcgtcccgctgatcgcggccgagttggagctcgacggcgcgctggtgtaccacagctacttgcatcatgctgccggtggaggcggcgggaggcggtcgctggcgtcggggacgttctgcgtggcgctgcagaacgcggacccgacggcgctgcaggcggggctgagctgggcgtgcgggcagggccaggccgactgctcggcgatacagcccggcggggcctgctacaagcagaacaacctggcggcgctggcctcctacgcctacaacgactactaccagaagggctccagcaccggcgccacctgctccttcaatggcaccgccacgaccaccaccaccgatcccagctcaggatcgtgcgtcttcgcaggaagcaccatggcggggggctccaactcgaccgtgccgagtgccagcccgccgacgagcctcgc

SEQ ID NO: 76266 - DNA, 793 bp, Triticum aestivum
  Clone ID: PAT_TA_76266
tgcagttatggagatttctttggtgcaaacctgtctctttttgcacatcatgtgctactcaaggttcttgccatgattcctactatgtattgtgcaaaagtagcaggctctgaagggatatatcaggatatctttatatgttgagatactagccttccttgcgtttcttcttatgttgtttacaaaattttcgcggcggaaatcctgttcggtgacagcagctggacaaacaacctgaaagggaacactgaaagccctgtcataattcaccatactgtacttattataatgtcttgtgcatctattgcttttacacttttcctggctgtgactccaataaaatcagccagcagtgaagctgaaactcaggagtggcatgtgcactctccgaaggaagcactggacactactcatcacagagtagatacttatccggaatatattgcacacgaagaaattcaaagaatccgataacggggctcaacatatggcgaccattcctgaggctgcccccggaatgtcaagcaacatcgaggagtcaaaatcagttgttggggctgactttacaggttcaacgccaaatgtctctactgccaccgcagtaggacagagttcagcagagaataaccaaatgaagagcacagctgagaaagatgttcaagtagaagcagatgtttgcacagacaaggacaatgagacttcacataatgtgagctccagtaataagtccactggaggcaaagcaccctctttatcttccggtgatccaccaccccttgctatgagcagatat

SEQ ID NO: 76267 - DNA, 746 bp, Triticum aestivum
  Clone ID: PAT_TA_76267
ttatagtggaaaagtcaaagagtatcatactcagggtcagttacgtagttggaatatttgtaaccacgcactaacctgaaagttcggcacactaattaagcttgattgtttttgaagcccgttcaaagggatatcttcctaggtagtcaaatgtacaatgcacaatataaaactgtcgttatctttctcatctcgtcccaattgcataatcattctttgttattaatttcaccacaacagaactattgtaataatttgcatcttcatgattttatatatttacctgtgtggttactctggttaacaaaataatttgctagatgcgcttagaaatattatactgttatatatggtgtgtggcttgcacggttacatatgtacatgttcattgaggtcgaatggtcattatcaaatttgaaattatcaaatatgtggaaggtatgtttcaaccgctgaggtgtatccctagcaggatcttcctaggagagtggcgtaaacctcagacctcggtaagatcggaaggtgaagattctgatggagaaacgaaagagagggggcgaaattaaaggactgtggcatattaaaccacaaacattggtaagattgaaaggagaagatgcaagatggaagtagcaacacgaatgagtcgctcgacgcataagaggattttgttccccgttgcaacgcacgggctcttttgttagtatagtctacatctctatatgtttcatgcacatgaaaaatct

SEQ ID NO: 76268 - DNA, 701 bp, Triticum aestivum
  Clone ID: PAT_TA_76268
gcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgctggcctgcatttcgtctcgccctggacagtgtggcagagctgatgggtacatcctggagggcaaggagctggagttctacatgaggaagct

SEQ ID NO: 76269 - DNA, 632 bp, Triticum aestivum
  Clone ID: PAT_TA_76269
ttctgcaagagctttgatgagatattcgatttctttgaagttgagcctgttgggtctgcttctattgcacaggtgcatcgagcgaggcttaaatcatccaagacagatgttgctgtcaaggttcaacatccaggagctgaacaattgatgatggttgatatccggaacatgcaagcatttgccctgttcttacagaaatatgacatcaactttgatctgttctccgccacaaaagagatggaaaagcagatatgctatgagtttgattttgtgcgagaagcaagagcaatggaaagaatacgagaattcttacgtgttagcaataagaaatctccggttgtggtgcctcgtgtgattcctggaatgattagcagagaggtcttggtcatggaattcatacaaggaaccccaataatgaatctcagcagtgaaatgtctaaaagaggaattgatcctgctggtaagcttgcagcaatggcaaagcagaagattctaacggatcttacacttgcttatggccaaatgatcttgaaggatggctttttccatgcagatccacacccaggaaacatccttatctgcaacaacacagaggtagctttgcttgactatggacaagtgaaagaaatgcc

SEQ ID NO: 76270 - DNA, 637 bp, Triticum aestivum
  Clone ID: PAT_TA_76270
atggacgggatcgacgcggagctcgcgcgcgcgcaggacgagcgccgcaagttggaggaggccctggcggccggcgcgcccatggccgtctcctccgtcaccttcgacaaggacctctacggcgggggcggctccggctccgaccgcttcgccggctacgacacctccatcccggcctccgaggacgacgcgcccgaggacgacagcgccgagccctccgccaccaaccccgcggtgcgccgcctcgcgtcctacacgggccacgccgtcgccgccgccgacatcccccgctccgaggacgacgacgggatgcccgccaagcggtcccagcgcatcatcgaccgcgaggacgactaccgccgccgccgcctcgaccgcatcatctcgccccagcgccacgacgccttcgcgtccggggaggccaccccggacccctccgtccggacctacgccgacgccatgcgcgagagcaaggtgcagcaggagaaggagcacgtgctgcgggaaatcgctaagaagaagaaggaggaggaggagaaggccaaggagaagaaggctgcgcctcaagcgcagccagccgcgaccaaacggcgcaataggtgggatcagtcgcaggacggcgatgctgctgctgggg

SEQ ID NO: 76271 - DNA, 738 bp, Triticum aestivum
  Clone ID: PAT_TA_76271
gcacgaggcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgctgccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcttgggttcacagtgtacccatcaccccaggtctccacctctgttgttgagccatacaacagtgtcctgtccacccactccctccttgagcacactgatgtgtctatccttcttgacaatgaggccatctatgacatctgccgccgctcccttgacattgagcgcccaacatacaccaacctcaacaggcttgtttctcaggtcatttcatcgctgacagcttccctgaggtttgatggtgct

SEQ ID NO: 76272 - DNA, 745 bp, Triticum aestivum
  Clone ID: PAT_TA_76272
tggttgttgagtctgcacttgtagacctttatgcaaaatgtggctctgtagactatgcttatagagtttttgaagcaagcagtgtccgtaacacaattacttggaatgccatgatcggcggcttcgctcagaatggccatgctgagcacgctatcaatttgttcaatcggatggtcagcgaaggggcgaaacccgactacgtcagtttcattggtgttctttttgcgtgtaatcatactggaatggttgagcaaggacggaactacttcaaatctatgagcaaagactatggcattgcccccggaatcgaacactacaattgcattgttgatcttctcagcagagtagaacttctggaggaggctgaagatctgataaacaagtcacctttcagagatgattcgtccttgtgggcaccaatccttggtgcttcttccacacattcaaacccagatgtagcagaaagggttgccaagaaaatgatggagttaaagcctcagtaccacttgagctacgttcttcttgaaaatgtgtacagaacagttggacggtgggaagatgctttagagataaggaggctgatgagatcaagaaaggtcgaaaaggagcccggaatgagctggattgatgtaaacagaagcaaacaacatatgtcaaatgttaatggggcaccttcagaactagtagcctctgaggacatcatcacatatgacaactgaccttaacattttctgtctctgctttt

SEQ ID NO: 76273 - DNA, 666 bp, Triticum aestivum
  Clone ID: PAT_TA_76273
ggcaccaggtcggttcaggacggcgttcccgctccgcggcggctcgacggccgcttagttctcgccgggctggctgccagcgttctgactcgccggcgacgtgctcagctctacacggagataaccacgtctgcttggcggtggctctccacgccagcgcccgttccttcttcacccgacgacgatggcagcgccgtgatcgcatagcctgcggccttccacagcgagcggcccgccgatcacgctcgaggtcgccctggtaaccgacttatcgccaacgacgtcgatgattgcggcgagctcgcccacggagggcacccagtgcagccctacaccgttccacggtcgtggagcgacggcgtctgcaccagaccagcccagaatactgctgctcctctaagtcgcagttccagtttctcagaggggcgccacagtggggggagacgtcgacgacgcggcatgcggcgcagagcaggggggtgccgccagcggaaggagaccgtgttgccgttgtggatatggcggtcgcacggcaagcagagccccactgtttccgcccggaagtataccacggccagcgcgacggagcattagcactccgttgtgggcaccatgtcggcggcaacccctggcaccatgcatgtattactccacggagggagtatg

SEQ ID NO: 76274 - DNA, 826 bp, Triticum aestivum
  Clone ID: PAT_TA_76274
ggccgagcacccgatgtctacctgacagacatcacatcaccgagtcccaaaaaagaagaagaggaagaagaagaagatgaagaagaagaagaggaggaggaggaggaagaagaggaaggatggacggttgcagcacctgatgagcattcatctgctggcatgctcaatcatgcatcagagcttattcaagagcacactgaggatatacataccgaaggtgcttctgaaaatgcatctgatatgggtgaagatttgaaagaagtctgcatttgcgaagagcgtgtcaatgcggaagatgctgatggatgcagtgaatctgatgaatatgcatcggaggaagaaatcacagagaacacaggagaacatgcggttccagatgatgtgatctcaccgatttcatccaagcaatctgatgatccttgccaagtaactccattcactctcaaagatgcagatttggcagcagcaagggaaggccaggacaactacatccctgaaatgaagcatgtcaccttgctggaaacagtcgtggaaacgggactacctaaagttgtgactgaaccagtagtcagcagcgaggctgccgtgccagatgatgaacagtgctgtctacatccagaaactagtttaccacaagatactgttcttggtagctgtgaacttctagaccaaaatgagcaactgcaactgcacagctcatccatgatgtctgccactccagatccaactgtaaagacaggggaaatgcatgaattgtatgaagaaccgcctaatccatgcaacagcatcagcactgacatttttgcagatcaattggctcctgact

SEQ ID NO: 76275 - DNA, 694 bp, Triticum aestivum
  Clone ID: PAT_TA_76275
aaggcaccatctgcccatcaaggctaacctcctccttttcctcgtgcctagtagtattgaaaccgcacctcttgtactcagttttagttctactaagccttaaacctttagattacaaggtttgtctcgatagctttaacttcctattgacccccatccgactatcgtcgagtagcaccacatcatccgcaaagagcatacagacccctggtgtagtcctattttaatcgggaagtcatcagtgtcgccatcacttgttcgaacacttgtcacaacattatcgtacatgtccttgatgagggcaatgtactttgctgggactttgtgtttctccaaggcccaccacatgacattccgcggtatcgtatcataggccttctccaagtcaatgaacaccatatgcaggtccttcttttgctccctgtatctctccataagttgtcgtacaaagaaaatggcttccatggtcgacctcccaggcatgaaaccaaactgatttttggtcacgcgtgtcattcttcttaagcggtgctcaatgacactctcccatagcttcattgtatggctcattagcttaattccatggtaattagtacaactctgaacatcccccttgttcttgaagattggtactaatatactccgtctccattcttctggcatcttgtttgcccgaaaaatgaggctgaaaagc

SEQ ID NO: 76276 - DNA, 745 bp, Triticum aestivum
  Clone ID: PAT_TA_76276
aggtgctctcgccatggaacatgacccaacagcacggaggaacgcattcctcatgctctgcgactgctcgcaggttctggccaccagttacttgctcgccaatgctgaccgcttcgccaagtggcctgcccccctccagatggtcgccctcggtttcgttcgcaaagtccatcgcaacctctgttacaagccctacaaccgttgcatccgcgttctcaggaaaaggtatattgagatcatcatttccctcctctccactggcacaactgctgttatatatgactgcgtgtggacgctgttgcgtatgtccaatgaaccgaccttgatccacgctgccgcaaaaacctattgccagctgctcacttcacagagtgacaacaaggtgaagctcattatcttggaccgcctgcatgagctttgcacctcacaccgttatctgatggtcaattttaccatggacattctgcgctcactcgccagccatgatctggatgtaagcaggaaagttctggatttggtgcttggtttgctcaccacacaaaatgtggatgacgtgctgtattacctgaagaagaaggtttttcagacaccgagcgttctgcttgagatggccgatgactactgcaatatgctggtgcaggcgatccatgcctgtgccatggagtacccaaaagtggctgtctcagtggtgcccatcctcttgaacttccttggttgtgatgacgttgcttcagcatatgatatt

SEQ ID NO: 76277 - DNA, 633 bp, Triticum aestivum
  Clone ID: PAT_TA_76277
ttctgaattccaacagtatgctgtcgtgatgtttgattagtgtcttctgtgaatctataccaaaacagactagacagcagaccaaggccatggatcggttgattcaacagggaaggaagagacagcagattataaaacgagcttggggattaactggcctgaaacttaaacagggccgccctgatgatggactcaagctccagaatcaagacatgccactgtagatgtttttttaaaggcagctagctacttggattgcgcaaatcaacaagaactccctcatatagcatcagaactaaggagacaacttccagtagacctggccaatggaaatctcaattctcttagcctgtaagctcagctctcaatcaggtattctattcgtaactcagcgtattttttctgaagttttaggcctaactctcaaacatcttttgtcaagagtaagaatgtagctgttgatggttgcttgctgaagaagagtggtatcaatattaccatagaagtagatgtttttcgaattattcttgattttctattgtgttaatatctctctgctctgtttttaattgggaatccttgctccttgggtccctgtaaattgtacaaaaggtaatttacctgaattttatg

SEQ ID NO: 76278 - DNA, 672 bp, Triticum aestivum
  Clone ID: PAT_TA_76278
ggaggtcagtgatgcgccgccgcctgccgtgtgccgagctccccccgcgcgccgtcgccgtcgccgtcggaggcctcgaatgaggatcgagcggtgcttgagcagaggcgcccaaataagcagctccccctttgggagcagcagtccccaatcgaagcagcagcagctccatttcgagctgcttatttccgagctgcaaccagcaatcgaagcaatcaagcggctcctctccgagccgcagtccgcaatcgaagcgcctccctttttaaatcgcaatccgcaaacaaagcagtccttcccggaatacaatcagaaacaggtcctgtttcaaattcagtctccgagtttcaattgctggcgggaacccagccgctatatatctggcctggcggctaccgcggtgctaattcacggcaactcgtgagccttcagctttcaaattcaaattcacggtaaccaattcttctcgggcctcggcagatctacgcgggagccatgacgatgcagaaaggcaagagagctgataggctcagcgcattgcctgatgacattctggtcaacattcttgaccgactcaatctccgcgaggctgcaagaaccagcgtcctctctagacggtggactcaactctgtgccaagctgtctcgacttataataagtgctcagcacttc

SEQ ID NO: 76279 - DNA, 793 bp, Triticum aestivum
  Clone ID: PAT_TA_76279
gacctatagcggccccagctcgatctccgctgatggtcctgcgtcctcaccaccctgacctccggagaagctccttcgtcccacttccttccccgacctccgctgcgctccggcgttcttcactgtggtgacgcacccatccatgccggttgtacatgctggattaagaggcacaggacatgctcactactggaattcccaatttttatgagtgccaaatgcactcggcaaaggccaataaaaacacggcagcactgagaaaacacgactatgctgcatgcctgccggcaatgtttattttgctgtgttcttttgcacgtgcacttactagacaactgcaaaaaacttcgccaagttcaaacacagcatttcgaggatgagcacatggtgtatatggtgatcaaggaagcctaggaacaagcatctttaggaaagagatggagaagatggtttccaagaaagggaaaagcagggaagtaaaacacgattactttaggatgatgtgaaagcagattttctttcaacagtaggtggattcttaagataatgacaggttaacagtgcaagagctatgataaggcctaacatggttgctggaagatatatttgtacaataataactggcatgcacatgcagctatagttaatatgaaattaaaaagagtttatatgagatatttaatttctgtggctgaatgaaaattgctgaacaaatttctgtaaggtagcagcccaatagattgtacaaatatggatgcatgcaggtgatgatagacactaacatgtcagatct

SEQ ID NO: 76280 - DNA, 479 bp, Triticum aestivum
  Clone ID: PAT_TA_76280
aagaaggagatgcggatcctgatggtcggcctcgacgccgcctgggaagaccaccatcctgtacaagctcaagctcggcgagatcgtcaccaccatccccaccatcggtaccgatgctgttcgccgcgctgctattttctgcttccggtttcttcctgtagcgctcacgctcacacgcccaaatcgtatgtgcggtggaaccgctggccgggctcgcatgaattgcttcctccgttagtatagtatatacatgagaaaaattagaacactgaattatccatatgctttctttcacttctgtctaatctagtgtgctagatttctgtgctggtagcctggtaccagttcggttctatacgaacaattgattttgtatctgtgccagttgaaccccctatatcgtttagctactgcttcttctgactgtggatgcctggtgcgtatgttgaatcaaagattttgggatactctcattcggg

SEQ ID NO: 76281 - DNA, 438 bp, Triticum aestivum
  Clone ID: PAT_TA_76281
aagacagagagaggctgtcgatggggtgggccagaaacttgtcaaatagcggttgtgatggccggatcgtgcgtccacgagccggccgctcgatgtgtccaaatagtgcgtatgcactttttagattttagggacaaaaaaacccaccccacccataggactcacccccgatctcaccttctccgggctcccggcgtggctcgcccccacctcctcccggatcccggcgccgccccgctcccacctcctccctgatcccggcgtcgccccgcccccacctcctccccgtctccggcgccgccccgccccgcccccacctcctcccagtctccggcgccgccccgcccccacctcctcccggatcctggcgccgcttcgacgcgcacccacctcctccctcgcttccggcgcccccctgcttccatgcgccaccatccg

SEQ ID NO: 76282 - DNA, 703 bp, Triticum aestivum
  Clone ID: PAT_TA_76282
gaaccaacaaatcccccagccgatctcgtctccggtcgactccagctccccctcctccggtcctcccccaccgccccaagaaaatatgctgctgctgctgtttattctctatgacttgatgtatagaagcattagtatttataatgtgggtttgcttggtctgcttctagaggctcattatcctgtttggtattattctctgcagatgcagatctttgtgaagacattgacaggcaagaccatcacccttgaggtggagtcgtctgacaccattgacaacgtcaaggcaaaaatccaggacaaggagggcatccccccggaccagcagcgcctcatcttcgctggcaagcagctggaggacggcaggacccttgctgactacaacatccagaaggagtccaccctccaccttgtcctccgccttcggggaggcatgcagatctttgtcaagaccctcactggcaagacaattacacttgaggtggagtcgtctgacaccatcgacaatgtcaaggcgaagatccaggacaaggagggcatccccccggaccagcagcgcctcatctttgctggcaagcagcttgaggacggcaggacccttgctgactacaacatccagaaggagtccaccctccaccttgtcctccgccttcggggaggcatgcagatctttgtcaagaccctcactggcaagaccatcacc

SEQ ID NO: 76283 - DNA, 663 bp, Triticum aestivum
  Clone ID: PAT_TA_76283
tttctaccgggagccaccttcttgtctgaaactgctcttcttgcatgtcttaagcctccagtctcgaaatcagtcttataccaagctttagagcttgccaaggacacggagaggttttactgaagggtgatgttaaaaaggaacagatagtacatggtggaagatatcctgctacaacacaaagtgtgtcctctgccgctctggaagatgctgtaagggtgagaacatctactttggacatcaaagattcaatttcttcggataaatcattatattatggctatgcgccacatgcatctgctgggagtatttcattttatgatggattgtctaaaggaataccatcatattctgttaatactgataagcgtggtttaggagaaatatatatgccctgggaatccaaccggcatccaggtttatcaagttcagttccaggtttccagactagagagaatcatttcagtagcaagcatggtgatttaagcatcagtgacccacggaagagcagctcccctgtgccatgtgatggtggttccaactctgagacagcagtatcaccctccttcactagatcatcagaggctctggagacaggttggaagcctcgtggaattctagtggcacatctccgagaacatcgcttgtctgtcaatgatattt

SEQ ID NO: 76284 - DNA, 596 bp, Triticum aestivum
  Clone ID: PAT_TA_76284
tagcagtactgggtttgttaggatacctagtgttagttttagctgtacctagggttaggcctagttgattgcaacaatattgtgctacttaatgaggaactgcattttgttatctgaatgaggaactgcattttttatctgaatattatacataatcttaattgtattttattatcctcatacatagatcttagtgaatgaggaactgcttattaatgacatgttgttcagtgttgtttgtagagtacttttgtttgtactgaatattgttgttattcagtgtttttttactgaatattgctgttattcagtgttgtttgtactgaatattgctgtcattcagtgttgtttgtactgatattgctgttattcagtgttgtttgtactgacttttttaactttactgaaaatgttgttattttgttttgtattgtgtaggcctgaggagccatggtcattatattttcagtttccctctaaagatgctgccagaaagtatgcccttgtgaagatgtatgagatagacatcacttatggcagtttgcttaatgtgatggtcagaaatggatatggaagtgatgacaatatttgttacc

SEQ ID NO: 76285 - DNA, 532 bp, Triticum aestivum
  Clone ID: PAT_TA_76285
atcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcagacgttaacattgtctcaaatgctagctgcaccactaactgccttgctcccctagctaagatcattaatgacaacttcggtattattgagggtttgatgaccactgttcatgccatcactg

SEQ ID NO: 76286 - DNA, 687 bp, Triticum aestivum
  Clone ID: PAT_TA_76286
ggcaccagacaggctgcaactgggcagcaattggattgcaatttgggaacagcagatgccgaccatgaatggtgggtgaagctcatcgaggcccacccagaatttgtatagttccgtaacggagcaccagaaaaccttgctgagcttaccaccatttttgacaagactcatgtgacggttgcaacttctgcgatcctaggtgagcatatagaagaccccactgatctctttgaggttgaggatggcaacagttatctggaactggaagacaacaatgatgtggaaagcaacaaggcacctggccagaaaataaaggaagtggaaaagcagagggctgctgccattgctgctagtccaaagacgaaacgaaagcaacaaaagaaccctacggttcaggagtgcaggcatctggcatacataatggctggtagcacttcggtgacatcttcgactgatgttccaagaggccatgggattaaagacgtcatcaagttggctgtgcaatctggggcgaaggaatgcagcgatctgttcttcacggccaccaagctttttgtgaatgtggattatagaaagatgtttagtgctttggagaccaatgaaggaaggctcgattggctgaacaggatgcatgaagagatgtagaagaattaatggatctgcttctctcttagtactgatcttttt

SEQ ID NO: 76287 - DNA, 653 bp, Triticum aestivum
  Clone ID: PAT_TA_76287
caggtgcggttcccttaggctgctaccgctcgtcagcggtctggtccagcgtcacttaaccattgtgacctggctggtttggttcagctttgagctgcccaccatggagtgggaggccgacatgctgatgaacatcaacacaggatcaagtacgctggtgcaccgcggcgtgcggcggcctatattcttgtagtggtattgtatatggtctcatccagcaccgagtatccatatgttgttctaatcctgatgatgatgttgtagcataaagtggacaccatattcagtttgtcttgatgctttatatcttgtggttcttgtctgatgcacattgttctttgcagggttatgatgatatttccaaggaaatatactgaccctgatgcgacaaaggtgtccattttccctttcttgaacttttttactctgttatttgttcttcctgtagttccagtttcacattgctggtgtttcatgcaatattcatcagatccttcttacatgccttattattgagtaacttgattagtatttctgccactgtcctatctcagtaaactgtttgttttttcagtacctaaaaaagaaagtaaatctattatatcttggtattctagaatttcagtctcacagaagttactatgtgtcctgct

SEQ ID NO: 76288 - DNA, 514 bp, Triticum aestivum
  Clone ID: PAT_TA_76288
tgccggtgatcgccgtcgtcagtgatgcggagccggcggtgctagggattccggtggcttcgccggctgggggcgtcggcgaggagaaggcgccactgggggcggaggtcgcggtggccgtgaaggacgagccgcccgtgaaaggggatccggcggcccccgccgctgatcgggaggccgatgcgccggcggcgaaaggtgtggcggagaaggatgacgagggggtgaggtggctcaagcactactcgtcgatgcacagcatactcgtcgtcggggacggggatttctccttctcgctggcgctcgccaccgcgttcggctccggcgagcacatcgtcgccacgtcctacgactcctacgacgctttaaagaggaagtatggcaacgctgaggcaaatataacagagctgaaaaggttggaatctacagtgttgcatgatgttgatgcaaaactgatgaagctttacccttctctgaagatgagacggttcgatcggatcgtctttaactttcc

SEQ ID NO: 76289 - DNA, 590 bp, Triticum aestivum
  Clone ID: PAT_TA_76289
gtgtacaacctctttggcgaagccatgtcgatctcggcgtgattgggttggccggcgaggatgctccgactaacttggctgtcggaggaggggaagaagatcttaggcgtatggagacagagcccgaggtactgcttcgctgtgatggagggtttcgtcattggagcggctcaggtgagttgtacgacgccgaggctgaagcaggacaagagagacaacgttaacctgagtggaattctaatagcatctccaatacatgacgtaaaatacataaccacaaagtgctagatgtaaaatacatcagctgctcgtctctgaacttacctgtcaaaactgaatttaattgacgaaactgaacttaaccgtcgaaattgaattttgctgtcgaaactaaattttactgtcgaaactgaacgcactagcaaggtgaggctacacgtcagtcgactgactttttcatctttggtcggtcgattttgcagccgttggatacgaaatcaagggcctgcagttcatcttcaacctccaccccccctgagccgccagccgccatgggccaaacagcagccccccgctgcccgcggccggcg

SEQ ID NO: 76290 - DNA, 703 bp, Triticum aestivum
  Clone ID: PAT_TA_76290
ggctccaaactgaagaaattggttgtatgtggtagcttgtggcagcaaaaaggaatgccctttccccccttctttcttgctctgtagaaatgatttgccccatgaacataaaggagcaaagccgcagccttgcctgctaaggttgcttcatcatcgttgatgccgcctttcgggacaacaccgcccgttcgttccctcgttttctcactggacgaggctttcttgttggattattagtattattactattatagtcgtgcaacttttccgccatttttcctcgtgaggcggccactaactctgcaggaataataatagtcttgcaacttttccaccattatttctcctgttgacgcagccgctaaccctgcaggaaaacagggttgccagatacagttacccatatctcttgttaataatccgtgttttgttattaccagtttagatatatctttttttagcggacagcagtaggtgaggccctcatttcgcaatccacaccgagcacgtcagccgttcgtatcagagaaattaaggtggatatcgcctgcagttagttcgctctccctgaacggcctctcgggcataatcggcagttaagacgcaatccactattttaaggctgctacagaaagcgtctgattggattatgggactgttccagcttttcttgttttcataacgtgtgatgggagtaatcata

SEQ ID NO: 76291 - DNA, 747 bp, Triticum aestivum
  Clone ID: PAT_TA_76291
ggacttcttccgccgccgggcaagatgcggaatctagggtcgtcctccacgcaaactttgctgatctgctaccggcgggcaaaggaacctccaactctcgccggccactctcctggaatctctcgaatccagagctccgatgcagatccccatttggggagcaaagcaagcccgcagttcaatttccatccactataagtggagcgactggacgaaattccgggttgagcctgcggaggacgatatctcgaactcctcagaccagatccccatttggggggcgaagcgagcacgcaattcaacttccatccaaaccgattggagggactgggcgaatctcggggatgggcctgctgggctaatcgccgagcgccttctcgccaacgatgtcgcggactacatctgcttccgtgcagtttgccgtccgtggcggctctgttgcaccgatccgcgcactcattgcatcctggagcgccgcttccacccacttcactggattatgctcagggaaacggggggctctccacgctgccgcttcatgaatatgtccaccggatgctcaaggtatgtacatctgccggagctctgtggccatgacgttttcggccctaccacggagggcctgctcgtcctcctcgacaggaccacctgggtggttcgcctactgaacccgctcacccgccaggcagttgatctcccacctgccaccgctctgatgtccaagagtgatctgaaggaagcgtcttg

SEQ ID NO: 76292 - DNA, 718 bp, Triticum aestivum
  Clone ID: PAT_TA_76292
cgagccggactcttcatcaacaatgagttcgtaaaggctgttgacggcaagacctttgaggtcatcaacccatctaccgaggaggttatctgcaatgttgccgaggccaccgagaaggatgttgacattgctgtcgctgccgcacgcaaggccttcaacggcccatggcggaaggagacaccagagaaccgaggaaagctgcttgtcaagctcgccgacctctttgagaagaatgccgatcttctcgcctcagttgaggctctcgacaacggtaaggcattcagcatggccaggaacgtcgatatccctgccgccgctggttgcttgaggtactacggaggatgggccgacaagattgagggtaaggtcgtcgacacagcacccgacagcttcaactacatccgcaaggagcccatcggtgtttgcggacaaatcatcccatggaacttccccattctcatgtggtcatggaagattggtcctgccatcgccactggtaacaccgttgttatcaagacagctgagcagactcctctctccgcatacgtagcctgcaagctcatccaagaggccggtttcccaccaggtgtcatcaacgtcatcactggtttcggaaaggtcgctggtgccgccatctccgcccacatggatgtcgacaaggttgccttcactggttcaaccgtcgtcggtcgccaaattatgaaggccgctgctggct

SEQ ID NO: 76293 - DNA, 555 bp, Triticum aestivum
  Clone ID: PAT_TA_76293
ctcttcctgtgtgcgggccgccgctgccacaggccacatctcctcgccctcctccacatctccggccaaggcgctcgcttctctggccgtcctccacatctcctcgcctccaccccatccacttcctgtcctttgcttctccaagactgcagcatggtgctcggcggctgcggcaacggagctgatggagcgcaagccgaccagttcaacggaggcagtagcacggggcagcggcagcagcatggagggcgtccgcttgactgggaaggtaatggaactgcaaataggaatggcagcggcaaccatgatgcaagtgcaagtggttctcaatgctcttggaaagattatgctactgcactaacagatgcgatagcgaagatattagatccaaagagtgctctttcagccattgatgaagttagtaagtttagggagtgccaaggaaggtttgggaccagattagcacaagaagctgcggcgagaatggagccaagggatgttcctgcattgcagaagtgtgcaatgagagtttgctcacaatgtgtctcatctagt

SEQ ID NO: 76294 - DNA, 573 bp, Triticum aestivum
  Clone ID: PAT_TA_76294
tctctgctccctcctctcctcgcgcgcagggcccggcgaaagggaagcaagatgtacaccgccaggaagaagatccagaaggacaagggcgtcgagccctccgagttcgaggacaccgtcgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgtggtctttgttgcaacaagaaggattgtgaggccacccaagaagggttctgctgttcagcgccctcgcaccaggaccctgacagctgttcatgatggtatcttggaggatgtcgtgtacccagctgagattgtggggaagcgtgtcagataccgtttggatggtgccaaggtcatcaagatctacttggacccaaaggagcgcaacaacactgaatacaagctggagaccttctctgcagtctac

SEQ ID NO: 76295 - DNA, 472 bp, Triticum aestivum
  Clone ID: PAT_TA_76295
ccggcacctcgggtgccgctgggctccacaccggcggcggtggcggtccctggctggggtttccttccggtggctgctgactccggctgggtcctcccgtgcttcgggtcggtgcggtggtggtatctcatgggggttgcacgggttgtcggcaggggcgcgacacgtcgcttaatgctggatgacggggtgcgggtggcggttgcgacctcagatgcgggatcgcggcggcggttgctgttgtatgggcgacaacaatggctggtgcgacggtgggtgctccttgtagcgcccgtaatcggggcggcgatccctcttcatcaacggcagcggactccgagatcgtgtgggtgattcgaagtctggatctcgaggtggtgacggccttttaaggctggcggctgtatgggacgtcccttccgtcaacagatcaggttcgatgcggctcagcagatgaaacatgtgcttctat

SEQ ID NO: 76296 - DNA, 662 bp, Triticum aestivum
  Clone ID: PAT_TA_76296
aagaagagaaagcgaacgaacgagcgctcaccgcaccgcactcgagacccgagcacaggctaaccgcgacaccgcaacccggtggtggttccgcctcgcttcgccggcggcgtcgtgtgattgtgattcgggagcgggagaggtccgggatggccggggatcggatgagctgggcgaggctgctcaaatggagcctctcctacatggacggcgcgcggccttctcgcgacatcagtgaggaggagcagaggtggctggcggaggcggtggagcggcacatggcggaggacgtggtgggccgcctgagggagatcgcgctgctgatgagaaccccgctctccgtcctggaggcgcagggcatcacacccgaggacatcgaagatttactcgcagagctgcaagtacatgtcgagtctatcgacatagcaaatgatctgcattctgttggtggcttggttccagttattaggtacctcagaaatactaatgcacgcatccgagccaaagcagctgatgtggtaacaacggttgttcaaaacaatccgactagccagcagctggtcatggaagctagtggttttgagccacttgtatccaattttacatcagatcctgatctcactgcacgcataaaggctcttggtgcactatcctccttgatt

SEQ ID NO: 76297 - DNA, 571 bp, Triticum aestivum
  Clone ID: PAT_TA_76297
ctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagatgaaggagaaggccaaggtctcctacgacaggagaaagcaactg

SEQ ID NO: 76298 - DNA, 451 bp, Triticum aestivum
  Clone ID: PAT_TA_76298
gacgagagacggcaggtaatggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccgaaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgccagtaccgtgaggccaagaagatcgacaagcacatgtaccatgacatgtacctgaaggtcaagggtaacatgttcaagaacaagagg

SEQ ID NO: 76299 - DNA, 655 bp, Triticum aestivum
  Clone ID: PAT_TA_76299
gcacgagccccaacccacccattaacccaccccaccacacatcagtgatcgtgccatcagctctcctggcactatccgccttcagcaccctcgcctcggcactccctctctcgtccgaccacgtcttcggccaatccaagggtggctacaaggcgccgttgcactcgcttgctgttgaccagggtattgagcctgttaaagatggctacatcgtcgtcctgaaagacgacgccaacgtcgacctcctcaccacccatctcgccctcgtcgaatccgcccacctcgccacctctctcgcctcttcctcctcggcctctatcgatgacgacatgggcggactcaagaacgtctacacttccgacaagctccttggctacgcagggacgttttcggaggaactcgttgaccagatcagggaggacccgatggttgcgttcgttgagagggattcgatcgtcactacgatggagactgagcttggagcgccttggggtctcgcccgactctcgcaccgaaagaccctccgtctctcgaccttcaccaagtacgagtacgacgacactgccggagagggtgttgacgtctacgtcgttgacaccggaatcaacataaaccacgtcgagttcgagggtcgagcctcgtggggtaagacgat

SEQ ID NO: 76300 - DNA, 423 bp, Triticum aestivum
  Clone ID: PAT_TA_76300
cgccaaattcaaatttgaaagtttctggccgaaattctcgcacttcctcgacacggttgatcatgcctggagcaggccagtccacagctcctgtgccttcaagcggttgtccatcaagatggcgtgcactgcaaaatacctgaagatctggagctcctccctcttcagtgatgctaagatacagttccacatagcaacagaaatcatcctgcgcctagacatagcccaggaatcccgcagcctctccacaccggaattcaacctacggtgactactcaagcagagactgcttggcctcgccgcgatcgagcgagcacgcaagcgtcaggcctctcgactgacttggctcaagttgggcgaagcgggaaccaattttttccatgcaaagttccgttcacgccgaaggaagaactacatacacag

SEQ ID NO: 76301 - DNA, 603 bp, Triticum aestivum
  Clone ID: PAT_TA_76301
tgctagacgacatgtgaatcgcctctgccttgctgctgaagttcctttggttgaaagtgggaccactgggtttctcggacaggttactgttcatgtcaagggtaaaacagagtgctatgaatgccaacctaagcctatcccaaagtcatatccagtctgcacaattacaagcaccccatcaaagtttgtgcactgcattgtttgggcaaaggagcttctttttgctaagctatttggtgataagaaccaagataatgaccttaatgtgcattcaaaagatggcagcagttcaaaattagatgtatttgaaagggatattgatgaagatcttgatcagtatgctcagaggatttatgatcatgtatttggctataatatcgaagttgccttacagaatgaacaaacctggaagaatcggagaagaccaaatccagtatacattagagacacattacctgaagcagtaaagcaaaatggtagctcacgggactgcagtaatgatcatgaagagccttctgctatggcatctttaggtcttacaaatcctcaagagatatggactctggctgaaaattcaagagtgcttttggaggcttttaaatt

SEQ ID NO: 76302 - DNA, 510 bp, Triticum aestivum
  Clone ID: PAT_TA_76302
gccacggacgggtccggccgaagacggtcagatccaccaccacgcattccaggcgagatcccccggtcgcttctctatctctgggtcaggtcccagcccagcttgcgcccctcccatccttgtcgtccggcaaccaactcgatgtagctgccacgtcccgcactcctgccccgtcgcatttgcctgggcgcgccatggcttcgtgctctccggcgggagacacttttggtactcgtccgtatcctgctcctcaacgtcgccgatgccgctagccaacactgcatccagcctccggccacgcagccgtcggcggctcctttttgttgcagccgctcgcgctcctccgtggaggcctttcatggtcgccaccctgcacaccttggcttccctgagcaacttcccacgtcgctgcaagatggccatatgttcgccatccctggagcattacttcttgtggcgcctcttactgaccttccgcggcgtctctcatcgaccttccccatcgacaag

SEQ ID NO: 76303 - DNA, 528 bp, Triticum aestivum
  Clone ID: PAT_TA_76303
tgcccttgacattttctcgtgtaaggctgcatgaggcgtacagatccaactcccccgcccggcagctacggcgtgtggctgcccagcacatcagcgcccccaagggccacgacatgttcctgagatcgagcaaaaaagttgatgttgtgatatattgctagcactagcagatcatgggatatgggcacaccaggaagaagacggaaaagaaaatggtgagttggagatcgcaagttcactgctcaaaaggataagatccctgttggttttatatagagaacacccagcgggggtaaaaagagcatcgctttgtccaagtcctccaatcaaatttttgctctgtttaaaggtttacgtcactgtctgaaattggtgattgtttctgtatgtttgagcatccgacttgagtttcatttgtgaggcggtttaattacagtaattttgtctattcagtaatatgtgtacaagttactgtatacaaataaaaaagctaagaaatttactcagcagttgaagaagaaaaaaaaa

SEQ ID NO: 76304 - DNA, 568 bp, Triticum aestivum
  Clone ID: PAT_TA_76304
gcaccagccggggtggttgtcatgcacgcctccgcccgcttgctccgccgcctatcctcttcctcctccgcccgctcgctccgccgcctcccttgccacccatcaccctcgccgcctccacatccatctcatctgccgccccttcgaaccgtgacccgcgccctcctcccccacctcgctgccccccgcttctccaccatctcttgcgcatccacaccctctctccgcctaggtgaatgcggcgctcccggaaccccggcgataccgttggcggagaattccgagggggaggaggaggcggagtctgtggcggctcggcatgacaccgacgcgttcgcggcggtggagctcgcgctggactcggtggtgaaggtgttcacggtgtcaagtggccctaactacttcctgccgtggcagaacaaggcccagcgcgagagcatgggctccggctttgtaatttctggaaaaaggatcgtcacgaatgctcatgtggtagctgatcatacttttgttcttgtgaggaagcatggatcacctacaaagtacaaggcggaagttcaggctattg

SEQ ID NO: 76305 - DNA, 597 bp, Triticum aestivum
  Clone ID: PAT_TA_76305
cagatttacgcgcagttcgaggcaccggcatacagcttggagcgactcttcacggacaaggagcttgccctcgctaccaatacggcgcagaacgcgacatacaaatacttctaccagccgccgcaacagcaacagcaagattcgggctccaacaccaatgccacggccgagccatcagtcgacaacgaggcacgtgacaacgctttggcggccgacggcgaggagttcgttgctgcgggagatgcagtcaacacacctcctgctggagccccagagatggagcgcacatcctcacaccaagtcctcacacggggtggagcacgcgcaaacccgctcgctgctctgtcagatcttgcaacagcagcagccgccgcaagcggcaccaccgcaatcatcccaacacgagacaatccgttcgctccagtcgtgcctaactaccacgctgttacgcgaagtgaaaagagcggggctccagcacctgcagctgttaccagcctggacgcggagaacgactttgaactcatgaggcgggcgggaagcaatttccccaccagcacgcgagcagacgacggtggggacatcgagatgggtgaagct

SEQ ID NO: 76306 - DNA, 584 bp, Triticum aestivum
  Clone ID: PAT_TA_76306
cagattgtaacaagatattcaacactgtctattcacctcttattgcggctctcaatgttgtcggctctctcaatgttagcccactgaaatgtgtcaagcttctgattaaggctggcgctgacgtgaagggtgttggcactgtgtcccccttaataactgctgtcaacaatggcttaactgactgctacaagtgcttactggaggctggtgcagatcctgatgttcgtgatgattttggccaccttccaatagaaattgctgcatataacaatagacgggaagatgttgaaatcctacttccagtaacttcacgtactccatatgtgcgagactggagcgttgatgggataattcgttgggtgaaatcaatgccatcagtggagaatgaccccatgaacaaaatgaatccagctgatctcaagttagaaggaagcaaggcatataagagaaaagattatgctactgcagtcaaactttactctatggcagcagaccgctgccctgatgacgcaacactgtactcaaataggtgcctttgctggcttaagatgggtgaaggagaccaagctttgatggatgcggga

SEQ ID NO: 76307 - DNA, 472 bp, Triticum aestivum
  Clone ID: PAT_TA_76307
tcaaccccgtcaccggccggcgcatcccgctccctcccatcgccttcttcaagaagtggcacgacgtcgccaccgtcgtgctgtcggccgatccgggcggggccaccgagtgggccgcggtggccgccggcttcccggccgaccgcatcgcgtactacagctccgtcacgggagcctggacgcccctggctttcagcgccgccgggtacgccggggtcgagcactatagggggcggttctacgtggccttcaagaatcagctctgcgtcatctgcgagcttgagtgtggcgcgccccctgccgtcatcccgctcgagcacgtcaagggcgacggcggcggcggtggatccgacgacgacgagctggtcccaggaagcggcaggtctgttgccctcgacgcgcacctcgtggagtgcgacggccagctgctgctcgtgtcggtgcgtgacgagacggactacaactcggacaa

SEQ ID NO: 76308 - DNA, 291 bp, Triticum aestivum
  Clone ID: PAT_TA_76308
atttgccaaataggtgtgtgcgtcatctaagcgaccgaaaaccttgtggtggactacataagcctagttaagcggtagccttttattccagacctagttaatcctatattttcaggatatttgtctcaatccacaaagttaacatttccggcaacaatttgatatttgctttccggtgcctacaagaaacaaaatatgtttactgattgattttgtttgcacttctgactggaaggaaaccggtcaaacaagaaacacgacgaactgcaatttttgtgttttgcctggacg

SEQ ID NO: 76309 - DNA, 619 bp, Triticum aestivum
  Clone ID: PAT_TA_76309
acaaactctattcttgagaactttacctggatatgctaaagcttgcgcactgagatttgtgttcagttagcgctggagttgtgcaactcccatgtagtttctaatgtgtcaacaaactgaaaattgctgatccttctcactgcagattgtgtcatgagctcgaagacattaaggcactgttagttaaatgttccaattcttgtgtacaagaagctacatggtggctcatgagatagatgcactagctcaatcatcagatcttggtgatgtaatgatgcttggctaggctttagtatgtcagagattagaggagttgcatgtgaatatatgttggaataagagaatagggaaaaggctcaatacagtgttgtaacgaccaaaacaaacaaaaacgaagattatagtgatggatcttcacatccagataggcaagggaagccttttcttttgaaatgcaatgtacctcttacattacatagaccatgccagttagtttctggcagccgatgagaatgaacacaaccatttgttccttgtctgccatgagtatttttgctttgacctctgcttctgataaggcaagacagatccaaaccaacacaataatcctctgaccctt

SEQ ID NO: 76310 - DNA, 362 bp, Triticum aestivum
  Clone ID: PAT_TA_76310
aggctgcccccacctcgagttcctcgaccttagagaatgcctccacatcatagttaacgctgaactccgagctcgctgtgccaatatcaggcatgtccggctgccaggacgggagccttatgttcggtgcccagagatccaaaccatccaggcggatgaaggtcaagtgatcgagatggctggtctctatgagacggaggctcgctctgtgcacaacgagccagcaatgggcaatgatgactatggcgagaactactgcgactgctgggatgactactcgctcccctcgtcccctgactcccctgccttgccgatgtactccatggatgatcccagatactactggcagctgtaaacagatg

SEQ ID NO: 76311 - DNA, 154 bp, Triticum aestivum
  Clone ID: PAT_TA_76311
aactggattgtaccggttcctaatccttgttgtgtgatatatgttgcatattatcatttcatggaggatattctaaactgctacgctttagatacctatggatggttgcatattaagcgattttgtcaatatatgttgtacatacctatggatg

SEQ ID NO: 76312 - DNA, 327 bp, Triticum aestivum
  Clone ID: PAT_TA_76312
gcgccgagacctcgaagccttcgtctccacctcggagcagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggattcaacgtcgaaactgttgaatacaagaacatcagcttcactgtttgggatgtggggggccaagacaagatcaggcccctgtggaggcactacttccagaatacccaaaggctcatttttgttgttgacagcaat

SEQ ID NO: 76313 - DNA, 146 bp, Triticum aestivum
  Clone ID: PAT_TA_76313
tcctggactacaccgccaatgatacagaggagtctgtatttgaggcctgagtcaattgaatcagtcctatgtggttcattatttccaccagagtttccgacaaaggaaagagtgaaacattgggtagttgctgccacacattttga

SEQ ID NO: 76314 - DNA, 200 bp, Triticum aestivum
  Clone ID: PAT_TA_76314
tcccaacacatgatcgccagagctgatagacgagctgagaaatacttcaggcgtggactaaggcttgactggccagagggggcagcctcacgagaaagcatgaaggcagtatggaaattgcctcgtctgcagaatcaaaacaaaaaaacaacaacaaaaaaaaaaaaaaaaaaaaaaaaaaaaaaaaaaaaaaaaaaaaa

SEQ ID NO: 76315 - DNA, 452 bp, Triticum aestivum
  Clone ID: PAT_TA_76315
atcagttgcttacataagtgtttcttgcattaaccttatcagtatgtcagttgtccattagagtttatattttattattgcgatcatgaggttatcccctgcaatagtgcaaaagagccgttgctaagagtatcttttgtatgtgggactcgggtgtaaagattagaaggggtgaggctagctaaattatttgaggaaccggttctagtttgaggatcgagtctaagcaaataaaagaattgaatgggcgcaatgtcagtttgcaaactcacgagataaatatgctagtgctcagaaaaacgtagagctgatcgtctttctgctagctagtgggtcctacagccaggtctaagacattgtagcaaattttgctctgctagactctctatgggtggcagacttcatctcaacaaaattctcagcacattgcccatgccctaaccatttcaatt

SEQ ID NO: 76316 - DNA, 184 bp, Triticum aestivum
  Clone ID: PAT_TA_76316
gcaccccggatctccctccacaggcggcggatcctcgtcgccgtcggtgggcatcctcaccaccgaccgatccggtcccgtgcttctaggcaggtctgtcccacgccgtcctcaacgatgcctccccgccgcagctcctccgccggacacagttcagcggagtccagcaaggcgtcacaatcaa

SEQ ID NO: 76317 - DNA, 179 bp, Triticum aestivum
  Clone ID: PAT_TA_76317
agaaaaggataacattgagcaggttttccgtagtgctattttctgtttaagtgaggaagatagagggttacctgctatagagttgatgttgcctcttcttaaacgagggattgcagtacatcattctggactgcttccattaattaaagagctggtggaattgctcttccaagaaggac

SEQ ID NO: 76318 - DNA, 191 bp, Triticum aestivum
  Clone ID: PAT_TA_76318
aagccttttcaaataagtgggtgagggatccctcggcgccgccgacaaagcaagcggaggcgcagccagcaccgcaggcggcccacacatcctgtgcagaccccgagtcctgcaggcaacggatatctgatgatttcaagaatgaggctcccctgtggaagcttacttgttatgctcatctcataagtggt

SEQ ID NO: 76319 - DNA, 351 bp, Triticum aestivum
  Clone ID: PAT_TA_76319
accaggagcacctgcacgcgggcgacacggccaagatcgtgttcgccgccaagtggtgcccgtcgccgcgctcgtcgtacgaccgcgcgacgctgctctgcgaggccatcgcgcgccgggtcttcccgcgcgactcgagccccgagtacctcgctatccccgacaagcactacgcctaccgcgtccgcaaccggctccgccgcgaggtgcaggtgccgctccgcaaggtgctcgagctccccgaggtctacatgagcgccggcaagtgggacgagctgccctgcgcgcgcgcttggcgtccacggccatgcgccagtacaagaggcgtcctgggtgtgcttctttcttctg

SEQ ID NO: 76320 - DNA, 369 bp, Triticum aestivum
  Clone ID: PAT_TA_76320
gacatgggcaaaaaggggttccggccgacaatatgcatgtttgaggccaaaatcattgccttatgcagggaacagagggtagatgatgcgatcaaggtgttggaggaggagttggccaagaatggtatcgttcccactgtgagaacatataacttgttaatgaagggtctttgcgatgctatgcaagcaatgaaggccctcggataccttaaaaagatggatacgcagcttggttgtgttgctcgaaaggatacattctctatcttgatcagcggcttgtgttcagaaggaaagtttgtcgaggcggcaagggttatggagaggatggtgaagaaccagcatcgtcctgacaaaaacgaattcagcatc

SEQ ID NO: 76321 - DNA, 424 bp, Triticum aestivum
  Clone ID: PAT_TA_76321
gaaggtgaccatttgctgcacggtgtacgacttcaccgaccggggcaaggactcgccggagaaggagaggaagcggcaggtcctcatgtccctcgtcgactcaattggcgccgccgaggagcccctcacggaggcgatgatgtcggcgtgcgtgcgcatgttcgctgtgaacctcttcagggtcttcccgcccaaggtccgatcaggcaccaccacgtcggagacagaggaggacgagcccttctttgacccctcttggtaccacctgcaagttgtgtatgaattgcttctgcggtttgtgacctcgccatttgttgaccccacggtagctaggaagtatgtggacagatcgttcatctccaagctgcttgacctgtttgattctgatgatcccagagagagggactgtttgaacacggtgttg

SEQ ID NO: 76322 - DNA, 565 bp, Triticum aestivum
  Clone ID: PAT_TA_76322
gaaagattataaacataagttacggtgaaaggacgagatgttctctataaattaattccctcataaattctcatcccctccaagcaaacaggtaagaccaactccaatcgtcgatcccaaatggacgtttgatttgtccagatttcgttcgtttgggtcggcaaaatggacggtcgtgtccagttttcggctctgccgatttgtgcacacaaccaggcggccgcatctcaaaatgtccggctaggaggttcgaaaaaaagcatgccacacatttaaaaacataaagataaacttaattaaacattactaaaatctaaagaagtccacaaaagtcccggccgcttattaaacttaagttaacatttaaaagtcataaaaaaaaagaacttcgatgccatcgccgtcttcacgcgccaccgtcatccttgtcgtcgtccatggtgaggtcgacgtacggcggtggatgcaagaggtgggctggtggcccctgtggtggttgcccgtcggaggagcctgcaccacttcttcccgtggcgaggaatgctctcatgagcgtggtggcgtg

SEQ ID NO: 76323 - DNA, 405 bp, Triticum aestivum
  Clone ID: PAT_TA_76323
ttgacatgattcaatattacactgccaaggattcttgttatgtcaacagttggcttctgattgctgtcacaccaggaattgaggaacttacacttcaactgtctatgggggaatacaattttccatgctcacttttgtctaatgggagtggagagtcaatccgctatctccatctttgtggttgctcctttcgacccacagctgaacttccttggttaaaaagcttgacaaaagtgcggcttcatgctgtccgttttactggggatgagttagggtgccttctgtgcaattcttctgctttggagcggctggctctcatgcattgtgatgagatggtttgcttgaagatcccttgcatgctgcggcggctcacgtacctacaggtttttggctgtgaagatctgc

SEQ ID NO: 76324 - DNA, 571 bp, Triticum aestivum
  Clone ID: PAT_TA_76324
aacaagctcagacaccccggcccacacaaaatccctcctaaaacccctttcggacccgtgcattcatcctatcatctttctctacatctgttttctctctcgactctgccgctgctccaccaccacgaccgccccgcgacacccttgccggaactcgacgacttcgtttcctccggcgctacacctgggctccaagccgcttctccttcgccgcagtttcatacctctcctccgtccgccgtacaggtaccatccgccactgaggcactcaccatactcatcgactgttcggtgaaatgcccgtgctaattttgttgcctcttcttctttaaagcaatgtattccgatatggagtacatacacgagcactttgttgagtcgtacgatggctcgtccaacgaggactacacggatgagacggcgacaggggcagatccagaacaaaaatgtcccggtgtccacgtgcacatcatatatacaaagatggacaccaagcaataatatggcaaggatatttcttaccgaaataaataagactgcttcacttccacttgaatatggtggagctgga

SEQ ID NO: 76325 - DNA, 347 bp, Triticum aestivum
  Clone ID: PAT_TA_76325
ctccattacacccaatgacccaaaattatggtgttcacttggtgacgctacaaataacgatgatcattataagaaagcattggaagtctccaataataaatctgctcgagctctgcgttctctggctcgtagtgcgtacaacaagaacgacttctatacatccaaaattctttgggaatctgcattggcattgaatgcgttgtatccagatggctggtttgcctatggtataactgcatggaaggataaagatcttgagaaggctttggatgcttttagtcgtgctgtgcagatagatcctgaaaatggagaagcatggaacgatatagcctgcctgcacatgatta

SEQ ID NO: 76326 - DNA, 291 bp, Triticum aestivum
  Clone ID: PAT_TA_76326
ccctcccccgttcgtaagctcgccgaaatttgccttttagtttcctccgatcaatcgccggatctgacagcccaggtcctattcatcgaatctgaattttagaggaagaaaaatacagcctttgtcgtttgattagttatagggggttgttacgctttaattcgtgctcttggcgctttaattcgtgctaatgggatcgatttcggtcgagatacgcgtcccgatctggtgatttagcgcggttaatgacgcctagcgcacatctgcctggattcgctgcacgtgacctga

SEQ ID NO: 76327 - DNA, 311 bp, Triticum aestivum
  Clone ID: PAT_TA_76327
cgccatacaaaagacaatcttctgacttgaaaagtaactcaatgaaagaacttagcccacatattaactctgttatgaacattctggagagccatgccagctatttgatgactggcaaggaactttcaaagctcgttgcttttgtcaaagggactcaatttgatcttgtggaatatcttcagcgagaaaggcaagggtctgcccgactggagaattttgcatctgcacttgaactaattggagaaaagctccaaatggacacacttcacagccggttatatgctgagttccttcttgctcatatgtgttct

SEQ ID NO: 76328 - DNA, 295 bp, Triticum aestivum
  Clone ID: PAT_TA_76328
ccagtctgcgtaagcagatcaagaagatggaggtctcccagcactccaagtacttctgtgagttctgtggcaaggtaaatctgtcaatggttttatcgattatagtacttgcgttgattatagaatgctaaactgtcagctggtggttgaactgtgcatctatgttgtatgacaagtgtttttggcatttggctagattgaaattcgcatcttatctttctgtgagtaaaaaaaagcagcatactggtataggttatttgctgcatggcgatggtttaaaggataactaagtttt

SEQ ID NO: 76329 - DNA, 270 bp, Triticum aestivum
  Clone ID: PAT_TA_76329
cggcttgtcgtcgacggtggacatggtggcaatcttggtgagtggagtcgagtggtggcggtggcccccctgcttcctcgtgcatgttcaggccgcaagacggctgatgaacaggactgttccaaattgaccattggggagctccgctgcggccaaccgtgaacttgctctgctgtaatctctctaggacagtacaaggcacacagtttgttgattgtggctgccaagacccccttaattagttatccttgggtgacagtcaattgatgg

SEQ ID NO: 76330 - DNA, 447 bp, Triticum aestivum
  Clone ID: PAT_TA_76330
cttgtttatccggtctccttgctcattgtatttcattcatgaattaattccttaaattgttctttgtaactcgttgtatttcattcaccattaaattccttaaattgctctttgtagataccaacttttatgttttgaagaactattgttttaatggttgcatttttccaataatgtttctttgctcctagtttaaataatgttccttttcccttcgattgtatccaatccctggtccagtctgatccctgctcactgcttatgttttcttgattgtgtgattttcttatgcacagggacaagagtctgaggttgctgctgctgccacagaggaagcaaagaagagcaacaatgtccagaggaagcttgagaagcgccagcagggacgtacactggactctcacattgaggagcagttcagcggtggaaggctgctggcctgcattt

SEQ ID NO: 76331 - DNA, 355 bp, Triticum aestivum
  Clone ID: PAT_TA_76331
atgaaactagatccttatgacacatcaaacaaacgaattgaggaggcaactcccaaacaagatgtttgcataacagagaagattacagaaaagagcacacctgaacctgaagagactgaaatgtctataaatgctaaatttcgtgacatacagccaagttcttcgatccttcaatatgttgaagataatctacttggtcgtaggcgtctaattgacataaaaaatgctggctacaataccaagctttctgctcctctggataatgtccccttctcaaccagaattgaacgtgaccggatagaacacagtgtgtccagaaataagctggacttttttgccgctgcaaagatcccat

SEQ ID NO: 76332 - DNA, 179 bp, Triticum aestivum
  Clone ID: PAT_TA_76332
atgttgcagctggtgctggtggcgagcaacggcatcagccccacgacggcgcctccggtgctgtcgtgcttggtccagcgccccaagcgagcacgccggccgccttatagactccgttgcgacgcctcgggccattccccgttcctagtcgctggcgctgacagacgctgcgggagaga

SEQ ID NO: 76333 - DNA, 507 bp, Triticum aestivum
  Clone ID: PAT_TA_76333
tccccggagttacagaccaaaccatcatcttcggagccgatgtcacccaccctcccatgcgaggtggaggcatggacgtccctccttcgatcgtcgccgtcgtcgccaccaccaacggacagaacaacgcctaccgagccgaggtccgtcttcaggagggtcgaaacgagatcatccaggacatgcagggtatctgcacgtctcttctccgacagtaccgagcttccaataacaacaagcctcctcaatccatcatcttctaccgagacggtgtctcagagggtcagtaccaggaggtcgtctcgaaggaggtcgccgccatcaaggccgcttgcaccggcatcgacaagaactataagcccaagttgacctgggtcatttgcggaaagaggcatcacatccgattcttcggagcccctaacgacattgaccgaactcgaaacttgcccgctggtctcgtcgttgaccgaggtgtcacccaccccttcgcccttcgacttctacctc

SEQ ID NO: 76334 - DNA, 229 bp, Triticum aestivum
  Clone ID: PAT_TA_76334
tcccctgcctctccctcctctcgccccgcctcaccccgcacaccgtctccgatgcgctcctgtgggccgacctccctgccgcatcccgcatccgcctcttcctcttctccgccctccccccgcgtctccgctccccgctgctccactcccgcgccgtctccgtgctcctttccggcgaccccgatgccgcaatggtcgacgccctcgccgacgcccgcgccgccggcct

SEQ ID NO: 76335 - DNA, 496 bp, Triticum aestivum
  Clone ID: PAT_TA_76335
acagataccttccatataaacagggatccctaaacccacgataaacatatccaccttkaatttakrcaaacccaaggttctttttcacaataaaatggttttaccccakggcaggraaaakggcatttatggaactaaatwatttattccctcsgggsstccactckggakaataaakttakggsccctcctatbscscccatcsstaatttcsccccttggaaatcaaatctacttcttcatatgcatcckccccaacatctccacaataaaaatagaaagscctctcggaatcaaaactccatctccasgggtttctaaaccccaaggcccaaatctctggttkcaaatcactttctttracaaatggattttcctttggaatscaatagttkccccacaaggtckggttacsvattttcttckggctttttacctsggcgggmaccasmctaatsaaattccsgggscscccakggggssggagacattscag

SEQ ID NO: 76336 - DNA, 202 bp, Triticum aestivum
  Clone ID: PAT_TA_76336
ctccacyccacycaactattggagcagagaagatgatgacgatgatgatgcagattaggccacatattgccatatcacgtctcatggtggtggtaggagccgtggtgctgctgctgctgctgcagggccgttcagctgaggcgcacctctcccggttactacccgagctccaaggtgagctcgatgcccttctcgcagtggt

SEQ ID NO: 76337 - DNA, 182 bp, Triticum aestivum
  Clone ID: PAT_TA_76337
ccacaaattcactaataatttcaaacarccacccrracaaatccatatctaccacccccctaccaccaaacaaaaaacaactctaaacccrgaracrgacccccarctcttcaaaaaactcctccacaaaaagccaatcgtgatcccrcacttccacaaaaarccarcrccggtgccagagt

SEQ ID NO: 76338 - DNA, 238 bp, Triticum aestivum
  Clone ID: PAT_TA_76338
tgttatccagttccaatcagaattgttccctcccycttggatwgcttggtggatcatagtcattagaatctcaaratagctagagccttctttgaaaagcattttagawaccaycttgaacctctacaawagactctagycaamatwgcactaacttatctcaaacaararttyctctatagcmgaattarawsttgrggccgtctttcctttarwcttctgggtcaaaaagttaata

SEQ ID NO: 76339 - DNA, 205 bp, Triticum aestivum
  Clone ID: PAT_TA_76339
twatttcaaacaaccacccaaacaaatacatatatcaaatatataatmcaaactmctaaatattmcycycyccycaatcacacatatttcaaatctaaacaaattcttctacatttctcccttttaaattwtaactacrgccaaacaaaatataacacatccttcaacactggrttataaatcttcctcctaatcttcaacttgt

SEQ ID NO: 76340 - DNA, 234 bp, Triticum aestivum
  Clone ID: PAT_TA_76340
yacaaaaahacycccccaccayygccaaagaggaagaggacgagcagccaaaacagtggcacygycatgtgatyccaagaccagaacagagccatctacatgttcttctctgcattagtcccytcccyccacacgtgaagctacgcgccaacctcctctgtttagagcgggacatggaggtttttgtcctaaccggaactcgtcgtcgaccgtgcacacatgcatgcatgtcgt

SEQ ID NO: 76341 - DNA, 177 bp, Triticum aestivum
  unsure (1)..(177): unsure at all n locations
  Clone ID: PAT_TA_76341
tgtatccagtcacagcagcatcattaaattacatccaggtttcactttkttamacttgsactgggtgsagcgggagstggggtgtnccctggtgsagctgctagatmattgathatcgatwatgcatgsacsgsgsgsatgcatcatatstatgatcgatccatccatccatctagt

SEQ ID NO: 76342 - DNA, 357 bp, Triticum aestivum
  Clone ID: PAT_TA_76342
tgtaaaagaacgcatmaccggwacgttaasgacgcttggaagtccaacggaacsygcgaaacctgsaaabaaaaattaaaaaggkgaatasaamhaaaaattaactttgyaagctswatkytccsggcygsttacttcttgsttgtagtaatgacaaatcwaattccggggctgstkcyccttggccccactttggtgttgayctctatggggtccacttgacttcccaaagctttgttgtgcyacwagtsttcyggaaktagtgtaaggtktgaagctastctgggaatttgcwaktcctggasaaaawgaatgagtaattgkttgagatgttagamctcggcccgagaccaatgt

SEQ ID NO: 76343 - DNA, 549 bp, Triticum aestivum
  Clone ID: PAT_TA_76343
accccagagaggggcccccccccccgtgaccaaaagaggacamcacccggcccagcaccacgagaagaccaaacaaaagaacggacagagaaagaaaaagccccccaccccacccagycaccgggagccaggcaacagggcgkagggcggcgaacgccaagcagccygycccaagccccaagaahacccaccggcaccaagcccagacagcaagkgatgacayggcaahagccccgacaaacaaggcaacgsaygagcacaccygcagccccggatygcagcccaccccccggccaaggaaamcagcagcaaygagacccaccaacgccayahagavcagyayaccagaagacactgaayccagaaggccccccaccaccaahgccccggggcsgybggcgcygtagaacgacgcgacccccgccccgacagcgaccccaamagggggbgbgabagcaaagaagaaagccaccaggagygcagagaaamccccgaaccgagccccagaaahgcagccacccaaggcaaaacccccaaagaacsgggggg

SEQ ID NO: 76344 - DNA, 365 bp, Triticum aestivum
  unsure (1)..(365): unsure at all n locations
  Clone ID: PAT_TA_76344
acgcctgtrggtgsggcgattaktttkcgatcrcgkcttgsgagsttggggggaatggggaggttkkggggggtgaggatgggggaaatrggagcggcaagcgccgtkatkctttagccaacagtctatttkgggggaatgtggctcgggttctcttaaaacacaastgggtgrkgrrataaaactttattcakcgkbgcctstgggatttatgttkgttggtcaagaaakacggatgtraacaccgttccatcctgctatkktgaaacacctccgatcatggtcgacakaaggtgggccttccsgggcaacsggtcgaartcagattcccccgaccgccatagcrcsganagcakgcaacatca

SEQ ID NO: 76345 - DNA, 168 bp, Triticum aestivum
  Clone ID: PAT_TA_76345
tctgwtctytctgccttcggggctgtggcccgtttgggcgtcccgctthcccgtatccttgtttggttttctgggtcctggtttytcctcgggtwtcgcmcctcgtttttywthatwtgggacttgtgttttcctggtttcgtwgtwgtttctttttggggttgaagt

SEQ ID NO: 76346 - DNA, 308 bp, Triticum aestivum
  Clone ID: PAT_TA_76346
accgcctcgacctccgcgagaagctgaatatggcgcagaagaaggacgacctccttcccatatactggctagctctcttgttagttaagttctatatatgtgcagtggcgtacagcccaataaatcagggtggtccatcaatagaaatatttacataagtttatttattttcaaagaaatatttttwwactacactatatacaagcwatggggaaattacagggtggtccatggacccctggccaccccctagctacgccactgtatatatatratgatcagctagctagctaaccagtggtagttgt

SEQ ID NO: 76347 - DNA, 212 bp, Triticum aestivum
  Clone ID: PAT_TA_76347
caaggtgaatgggagactatatattcaaatatctcaaaatctcgagcatattcggttacacaaaagaaaactgctgcatcgacagttgatgcatgcatgggcgagcaacgggaacacayccgycgttgcyycycctaccatatgcatgtatgtgcataaaaaaatattcactatatccactcatgcaggcgcatatttctaacgcgactcgt

SEQ ID NO: 76348 - DNA, 359 bp, Triticum aestivum
  Clone ID: PAT_TA_76348
actacggaacagctaacaagcttcgaagggcccaacaaattaggacacttgagccaactaacatgcttggccaagaaagttttatgatttttatattattgtatgactagttcgtagctagcgcaggcgaggtccctgtattgcttgctttgtttctttcagacttcaaaggctctgcagcctgctgttgttctccccactgaagatccggttgaggatggccgccagcctgacacctccctgggcaatcctcttctcaacaaccggcatcgccgggaagaaatattcatcttctaagttggagtattgcccaacacccacgtaagccgggcacgacagctccgcgctctcctcggcgt

SEQ ID NO: 76349 - DNA, 385 bp, Triticum aestivum
  Clone ID: PAT_TA_76349
actaaccactgaagcatctgaaagcaatgtttctgcattgggagatgatgcagaaaaccatcaactttctgcactgggaaatgatgaagaaaaacaacttccgaagcacaagaggcaaatgaagtcagccgatcaagcaaatgaggagcaaactgctatgatggaattgcaagaagcgtttttatctcttactttggtgatatgcrctgaactgatcagtgcggatgactttgatgatgtggctcgaaaagttgccccagcagaaggtggatttgtggcgaastgaagactataatagaagaaaactgtgaggacacggctaacagcctaagaattgtcaagctttgtggtcagattgctgttagaatgatgcggcgtggccagt

SEQ ID NO: 76350 - DNA, 249 bp, Triticum aestivum
  Clone ID: PAT_TA_76350
tttcttcttcttcttcttcttcttcttcttcttcttcttcttcttttaacctvccaaaacaacattctatrtttgcrgctcaacaataarrccaatatcatcttctyccttctttttttktdtaaataaacarrargrccaaccactaaaartagtcctvcaaaaaaccacaatrgaaatctcctatrtcatccttttatcargctcacatctcttrgaacaacttaaaacaattccctsgcccctcct

SEQ ID NO: 76351 - DNA, 236 bp, Triticum aestivum
  Clone ID: PAT_TA_76351
tccctgatattagtcaacactgcgccaatcgaattcaaccatccagcaagacaagagayacagatcaattcaagactcrgacgsgtaagagctgcaasgkgcagcggctcgcatggtgkgsrtaaagctacagggagtgaatgaatgtaccggcgcgggcggcggcgcgaaatgagtagtgaattcscccccccccgcasctcsaccatatgggagagctcccaacgcgttggatg

SEQ ID NO: 76352 - DNA, 573 bp, Triticum aestivum
  Clone ID: PAT_TA_76352
acarattccagagtcatcattataaacatcaaaggtttatgcctttccaaattaattatgtaagttatctttgaggcatctcctgttcacaaaatttaaatagttttgccggtatgtagggttataatatatgtttatacattttattcatttttagtgcattaagattgtgatctcctttcttactatcatactgtttgcttaaaacaaagactgacaaacctgctcccactgtatccagtcccatgccgtttattcttcattagaaatatatgggcaagtgtagaaaaatgagaatctgtttcttaaagtaaattttggataaacatggaatgtggragttttattgttaatttttcatatagtttcagccacgacaaactgtgggggkcctaatatttwmctttcatttaatttggcttataaarawctccaatggacaatgatgatagcatggttttwaargcggtaaggcgacctaaggcgctggggggsgcctttatcgcctaggcgacccctaaacrcctaaggcaggcatatwtataaaggcgctgggggggcgccttttcgcct

SEQ ID NO: 76353 - DNA, 313 bp, Triticum aestivum
  Clone ID: PAT_TA_76353
acgggtgggccaacgcgtgggtggccgccgtscttktagctgkggctggkttcggkktygttgagggrggkcggttcsatccrgcaggrgkctsaatgrgtygggggggggkccatccatacaacggraataaratcttkattagrcgtggagaaaggtgtggggsggggkagtggttgtcgtggakggggggggtgrkgggkgggggkgggggctkgggggggsggggggkgcgggggggggatttgggtgatgtacctdccsgggacgggggggkckraatcaaattcccscgagccggsatdgsggcggg

SEQ ID NO: 76354 - DNA, 183 bp, Triticum aestivum
  Clone ID: PAT_TA_76354
gggaaaaattgctmwargctcytgggamggccctgagycgktaacvamgatawakacracgctcacttatcskacagacakctattaagcysggrgactttggaggaaatatgttgaaagarttacaaasaaatcactsagggrstggakacagggaggcttcaaagaggcggtgcacacccg

SEQ ID NO: 76355 - DNA, 397 bp, Triticum aestivum
  Clone ID: PAT_TA_76355
twatttcgcactctstattggttgcascgmtttyyttacagtaaaatccaactttytaaagaatgcmcttmyccctatgtttatgagccytgaagttyccmscgmagccccamgctctscaagcacaaattaacmagtggaaagccctmcccmagtaattgtgmcmgabscmtgtwcgggagsgttatttttttsttgtagtaatgatcmayymmmttgtcgcgggcgcgtygtyccyggctmccctcytggtgttgatgtccctggggttcctcygatcctgccaagtcytgtyststtcgcmgtgyytcsgaagtagtgttaggtstgaaggccgtctcgggaacytgtcagttcggagcaaacgaatgagtaactggttgagatgytagtacct

SEQ ID NO: 76356 - DNA, 376 bp, Triticum aestivum
  Clone ID: PAT_TA_76356
cagaacacccaagccacgcacccaacgcgyygggcgcycycccacayggycsacccgcaggccgccgcsaayccaccaatgaytagcgkgggcgcggscgagggacawycarcyawgccawyacaaaaccgrcaagggaataacggggccattgcytgtytgagggcacaarttgkaracygccycarttcarcytcycyaatagctcgktgatcttgtcccacgggtgcccgaagtcgccgccatccttgaaggggttcttcttcatctgcagcctcctctccggacacttgagcttgaaaggsatgaraaarctcgccgtttctctgaartgcggsccgaccgtggggatttcgtgcacgacgtcttccaaaca

SEQ ID NO: 76357 - DNA, 326 bp, Triticum aestivum
  Clone ID: PAT_TA_76357
actatcacaaggccactgataactgaaatacagaaggacaatgyctctgtctcaagggccaaacaattttaaatccmagaatccyttccgtcytccagataatgaaggagttytatgtatatgtgggatttttyctgaattcaccccstgaatttgtaagggagtgttctycccctgyccccaggaagttaaagttyysgaattcmcaaggaaagttytgggatgttaattatgtttattayagtgaatgtstgggtggtggtttgagtggtggttggggtaagttttttctagawaataattcggagaagtttcatgtgtgtgtt

SEQ ID NO: 76358 - DNA, 230 bp, Triticum aestivum
  Clone ID: PAT_TA_76358
tacgctcyaccacgacaaattacacaacgcatagyatagmtcaaatgaaacaggmcccycmcaattacaggggtagagggggcagcsgmgctcccccaccagctagcaaagtaatgctagatcctatcacgactcyagtgatgcttacagyattattatttggyggygattaaataattagtaggcgcycgaascytctacaacatcgtccactcacctcgcgttggatc

SEQ ID NO: 76359 - DNA, 172 bp, Triticum aestivum
  Clone ID: PAT_TA_76359
actttgacgcttgaggagctcaaggagggcttgcggataaacggtcatgctgttcctgagacagagatacagatgctgttagaagctggtgacatagatggaaatggcaccttggacactgacgagtttgtgacagtcttacttcacatcaaaaaaatgagtaatgaggagt

SEQ ID NO: 76360 - DNA, 233 bp, Triticum aestivum
  Clone ID: PAT_TA_76360
gcgctatcgcgtttyccggrggtcctgcgctgggvscctctgattccytcccgtgaccccccsttttyybtagcgcgctatagctcgcgctatagcrtttrgaaaagrtccgccgctaagaggcttagcgccctatttaaaagtagggactaatatrccatgcmtatgtgaatgtcaaggcgratcctgatcaaccgttggcgctacgttagcmmcacgttgrttgttctggt

SEQ ID NO: 76361 - DNA, 241 bp, Triticum aestivum
  Clone ID: PAT_TA_76361
tcttgggcccacctcctartttatctgtatagkkgragttgtggccctcctctgtacaactgraccaacargsaggtctcttcgtcacaacttgtastctggaactcctggtgsastgcctgcttacttccagstaaaastrscaacatacaaaatrggtcatctggkgkacctascccgaggggcastccratcgrattcccmsaggccscattgsgsggagaarcattcagcgtcmggg

SEQ ID NO: 76362 - DNA, 228 bp, Triticum aestivum
  Clone ID: PAT_TA_76362
acatattggcgaccatactataccagacgcacacgtgagcggcagcacgcacgcttgcagctagcttatggtagagacgccgaaattaagagtgctgtagcaaaacatgcatgcctgcagcatgatatgctctatcgatcttattggtgtccataggatagatcgactttgctaaggttgcatgcatgattacttagttgctgtagctgttgtggacaggcatcctgt

SEQ ID NO: 76363 - DNA, 235 bp, Triticum aestivum
  Clone ID: PAT_TA_76363
actcatataatgttaactcgagttgcagggggagaacacatacacaagcagaacaaaagtaaaaaagggaaataaaatcaacctgacacgaaaccatgttgtatgatgaagggtagttagcttgtttaggccttgccggactcctcacagcctggtggcttgaaggcgatgaagctgacgcattgcacctgacgcatgttgtcgaatccgatgatgcggacataggcgttagggt

SEQ ID NO: 76364 - DNA, 439 bp, Triticum aestivum
  Clone ID: PAT_TA_76364
cacttgaaaaatgtgttgttgtcttcaatgcacgtttamaatagagttgcaatctatacttctctggactacgagacagggcgaacgaactgcaatggtcctcttyttaatccacaatacaaacacacacaaattacagtgacgagggacttaaaaaataaatccacatttttgtccgtgaatgcaagtcggcgccaacgcactgcatgtccagtcccccagcactgcacctgtgcacccatgggatggcagtcaaaatctaaaaagtgaaaaaatgtcamccgtgagcaaaatacacacaaaaatcaccgtcttcctgcaccccatcttgsgtaacacgcgcacatgacmaagctgcccgaaccgcgagccacatcgcccggcgagctgcaagtcctcgacgaagaataatccgtggacatgctatactgcaaggtgg

SEQ ID NO: 76365 - DNA, 165 bp, Triticum aestivum
  Clone ID: PAT_TA_76365
acttggcgaccgcgtccacgtcgaaaccggagaatgcctccctgtagatgtgtctcctcctgaggatcgaagcccagtcggccccgacctgcacgccggacagcgtcggcatctcgaacagcaactcgtcctcgtgcacaggcacgccccactcctcgtcgtggt

SEQ ID NO: 76366 - DNA, 242 bp, Triticum aestivum
  Clone ID: PAT_TA_76366
gcaggkagatgaacatggacakacacatattsttrggaasaaacaagaaagataaatggrgraggaaracccaaagcaatggtcagagttggrcaaaraccgcaatggcactttatgatgtggcccgyggtgagtgagcygtttaggccktgccggrckcckcgcagccgcggtggcytgaaggsgrtgaagctgacgcacgtgcgagctggcgcatgttgtcgaatccgatgatgcggacg

SEQ ID NO: 76367 - DNA, 163 bp, Triticum aestivum
  Clone ID: PAT_TA_76367
acgtgcgtggccttggcggccagggattttcgtgatgctttcgtttcatgcagccgcgatcgaccgtttgtgcatgtgcctgtaataataacaaaatatttgtaatctttttttatgaattggtaatcccatgacaagcgggatcatcaaatcggcatattgt

SEQ ID NO: 76368 - DNA, 444 bp, Triticum aestivum
  Clone ID: PAT_TA_76368
acaatkgccmscctkcttgtttagcacaatctccccaattatacaagcagatgagcatctktggtggctttggccccctctttgrggttggtcccstctttagrgcagaaaagtcaaacactcacaggcatytgtgtgrgtttwttgggktggatgctgvgrtggrgatcaaggvgcmctmctttgrggtttbtgatatcmtmgrtsgcytwtttgtagcaatattcaaacmcttsaawgaaaattktcagaaggvacytgrgacaawaaawaggcagyatccatttgaacctctgaagkacaagstttttttttttttttttttttttttttttttatccgaatacatastcgacagattgtataaatatattatgtgcatgtgcatatacatagccaccgattgcattcacatacgagcatgctttctcgagmcatgttggt

SEQ ID NO: 76369 - DNA, 334 bp, Triticum aestivum
  Clone ID: PAT_TA_76369
atcccttcatcgtctgcaacacgaagacttgaggcaacaccatgttcctgccttcgtgaagagatctaggatttatttcttgttgagcacacaaagctggtggttcttcgctattttctagaatttggatagtagamtctttgrartccgcgggrgraagtratgagaaggtggaaccggcggcggcgtatttctcgcaataggcactctttggttagttgccaaagtgtatccatcatagtgttccgagtagcaggcracaggtttgatggctagagaaagtcgatatgcttttcttccaattgtcatccttatggatggktagcagtggcgt

SEQ ID NO: 76370 - DNA, 262 bp, Triticum aestivum
  Clone ID: PAT_TA_76370
acggttgactgcyttgatcyagatgatgatccycatggaatgggtggatgggattggcagacttgtactacgcccccgtagcaacatagaggcctggatcttgaaatacgcgcaccgaaaggcgctcttcttcatataagctgtatttcacattcactagcccctctctgatatttatatactttacataagtgctaatgtattctatatsgrcgtatccagtgtcgataggaaactggaggacagacattgacgaatttgt

SEQ ID NO: 76371 - DNA, 194 bp, Triticum aestivum
  Clone ID: PAT_TA_76371
actcctactactcttttttctcccacttccattcaggttttgacctcatcaaggagcatgtgcaacccaggggagtcggtgctggattgaattgtcacctgccgtgcgaacccaatctagaagtgccttcatatccaccagcagcgttgtcttggcgccctattggmacgtaacagggcagtaatagtcatcgt

SEQ ID NO: 76372 - DNA, 403 bp, Triticum aestivum
  Clone ID: PAT_TA_76372
acgtgaagcaataagatatgctagccgtataccaaaacaaatccaagcaaggcgagaacgtgctagagcatgtcggcaaaatttaacacctgctgagagggaaaagattaatgcacaaagaagagaaaaaagacaacaaatggcacttgatgaaaggaatgcmagccaacaagcacgtaggcaaagtttgacattagatgagaggcaagaaataaatgcacgccggcgagcacgtaagcaaagcctacgacttgaagagcggcaagcactcctagctcagtgtaatacaagctatgcatctaaacgagacgccctctgcagggattctgttgcactacagtgccctacaggttcattgatgggacatccttcgtcaagttcttatgtctttagccacccaagt

SEQ ID NO: 76373 - DNA, 174 bp, Triticum aestivum
  Clone ID: PAT_TA_76373
accagtattatgtagaccctggtcctsggscatggttattatagttccctatatggtttatatcttttgatcttttcataatgttcaaattttgttactgcattctaaagggtcctttaattatgtacgtgagctgtccgctcctgcatgcacgtgcatccatggcgaagttgt

SEQ ID NO: 76374 - DNA, 232 bp, Triticum aestivum
  Clone ID: PAT_TA_76374
cacaygycccaccccaycccccyaacggcaaycgggcagaycgcgaggaacacggyyycacayaaaaccgggaaaagacccgcaggcagcagacgccgaayccacaycccaaaccccaygggagygacayagaycgcygcygyyggaacyggagaygggcaggaaaacaccccgccagaagaaygycccyycyggaggcygcaccagcyygcggtycygcgycgccgccaya

SEQ ID NO: 76375 - DNA, 231 bp, Triticum aestivum
  Clone ID: PAT_TA_76375
caggtaccatcgatgaagctgttgtctgtcttgbcggtttggatgaaaatgatgatacgtgaaacatttacgcaatgtcttaaggtgggcgcttggctattgtggatatgctccaaacatattgctcgacatctgtcttagccgtagtgttatgtcttagacagtcaatttcttgtaacattattwtttytwgtgtcaggwacactttaacgctgtatgcttccatgctta

SEQ ID NO: 76376 - DNA, 408 bp, Triticum aestivum
  Clone ID: PAT_TA_76376
acttgtgrgagaagagagagatgagcggggagataaaaggaaggatggaaggccagrbggagagagagggggcgatgagatgcgacggtggtcttgctgctgctgctcgccggacgccgtggctcgccggccatccgggagrcggaattggggcctcccgcatcacgtggtgacgccaaggtccagcaatggagtkggctctagctcttgaaaasatggtgaacgagaagctgcccaacctgctcattctaggagattgtggcggcacgggggttttgtgtcagtagaagatcatcaaatattaaggatatgttttggaaatataattttgtgaaattgaatgcacaacatgttcagaggagaggaaacataggcttgctgttaataacttgagtcgctgtgatgatc

SEQ ID NO: 76377 - DNA, 238 bp, Triticum aestivum
  Clone ID: PAT_TA_76377
cacacagccaccccaaacaaaccacabcacacacccccagcaraccmasccacaaacacagacccaacagagggacacgaggaacccgacggcgcccccaccaacccccgccgggaccaacgaggaaccagaccccccaaacgdaagcsakgyccyccattgcgtycycccytcycyctgagccartagctgckcccagtccttcarccacggcaagtcttcgcagccatgtgatggk

SEQ ID NO: 76378 - DNA, 252 bp, Triticum aestivum
  Clone ID: PAT_TA_76378
acatggagtkaactggccgkggaacccgkgggcgggcatvacccctcgaccacctcwactgcaatagtggcctcwgcacaacaacaataataccatataccasctccaktrtrctgaacttacttctatagcatctagtgcccacaaacartttaaatsgcaattaamggatattrcagcggctgawcaggaggcttaaatctctdtactctaaacaggtagcgcccttaamtwtaaraatggcctcaaggt

SEQ ID NO: 76379 - DNA, 302 bp, Triticum aestivum
  Clone ID: PAT_TA_76379
kaactcawatactgcacacatacaaaagtctsamctytttcattycamccccgawaakcgcactatgctskcatcacatatttcccatttctctccsaaatgatgscgaarcgaaactaaccmatrkkatcttttaaaggactccacacktcaaaykcatttgagtkggcagakgttacaaakagttgatsagagccakacaataacacrcarccrkcrmwataccracggtatayagcaccatrgacatgcrsgaccagcccccyycscgcgcyysttcaggaccgcaagcctcttttgca

SEQ ID NO: 76380 - DNA, 251 bp, Triticum aestivum
  unsure (1)..(251): unsure at all n locations
  Clone ID: PAT_TA_76380
tcgcscgctccccsktcccscgtggtcttttcygctgctcgctktcgcgtktcyktggcgcgcsctgttctcggcscccggggcygngccccgcsttcgccccscscttggcctgcsgcgcgcggctcgggcgggcgtcgctccccggtckttgcgtgccgcggggtccgstgcgggtcctgccgntgccgccgccgttgcttgttgggcgggggcgcggcgcgggccttkgtgttgttgtcgtttggtgc

SEQ ID NO: 76381 - DNA, 232 bp, Triticum aestivum
  Clone ID: PAT_TA_76381
acgttcgttwccaaagcagraattyaagrtgcatgcatgrtgrtactwcmgctgcaagkgcaaagatcgatcgrgckgggggccccagcctgggrggrkgrttacttgtattttytagatctttttttacycgttaatttgccycycgatatgcmcaattcatgctacagtccmgtagattwttgtraagctwcttttwcgtgtgcgatccatggrtttgcatggttactgc

SEQ ID NO: 76382 - DNA, 324 bp, Triticum aestivum
  Clone ID: PAT_TA_76382
ggggaaaagrgrgataaaaccattcatgtggcactgaatacacacacccggttgtactacttgtccagattaawcaatctttcaccmcctcacatacatacaaacatgrtagtttttttttttttttttttttttggagatattaatgtttaaattatgataaatattggtttgcacctatttgctgtttatcagtaacrttdtdtratatatacgtatacaaactdttttrggcctcrgratttcrggrctggcccgggtggrggcccacggcttggccgatggcgrggcagttgctggcgrgcttggcgrgctcggggtcgt

SEQ ID NO: 76383 - DNA, 355 bp, Triticum aestivum
  unsure (1)..(355): unsure at all n locations
  Clone ID: PAT_TA_76383
accagggcaagaaagccygccccccgaacayggccgggaacngcccgcccacacgccggaacaccyccbggatggaggbggagyygccgangaaggkggacgccaaggagaggccgcgwggggggaagccacacacgcyygacctgacgvygtyggggacccaccccacgaagcmaggaagagycccygccccgcacggagaacamcagnacaacaacchccsbggggcccaccccgccacggsmacacgggccgagaccgbgagggagcggccahggcggggggcggcagcacacaacaagaccccmgagwcccacaacmgccgsgggagcmcagggaacagcgagggagcggg

SEQ ID NO: 76384 - DNA, 282 bp, Triticum aestivum
  Clone ID: PAT_TA_76384
acacacattttgcaaaacmgctcatgagttctgtcaactaaattacagtgtctagtagttgtaactattactgccatcggggaaaaagtcgctgcaggagrtacsttcatatgaaaaacatcctgtcagtagcaactgcratatgcaaaacggtttagctaagccccagctccttcttcagctgctcgagaacggactctatgtcagacacgccgtcatcggagctgtttgttcctttcttgtcaccccaagcctttctgccaccccctccaaactgcgtgt

SEQ ID NO: 76385 - DNA, 183 bp, Triticum aestivum
  Clone ID: PAT_TA_76385
actgcggttgatccattgagcccatcataacgcaaggrtttaacaccacaaatggccatgcgctcatggatcaagttttggtcttgcagttggcccaagtgcttgcagagatagcgtatacgtgatcgatttcttccttgttcatggagatgttgtggaattagtgttcttctggggtggtgt

SEQ ID NO: 76386 - DNA, 244 bp, Triticum aestivum
  Clone ID: PAT_TA_76386
cargtacctagttacgaatgtaggaatacctggagcaccatgaggttagctgacagcaggtagatgcagccatataaattttgtgcggtgctaccaaaattgaggtttgtatcccttcccattatgagaattcttcttgaagttggtagaatgtgacggcttgttctttgcatcaaacttgcctttcccctgagatttgttcttgttgttttggggctggttgggctggaagttcttctcgtgt

SEQ ID NO: 76387 - DNA, 214 bp, Triticum aestivum
  unsure (1)..(214): unsure at all n locations
  Clone ID: PAT_TA_76387
ccgcaaaagacraaarggggsagaacaarggarrggaaccagcggacccgrggrggaaaaccamccncaaaaacacgggggggngacrggagggrgscrcagggsgacgggaaaaacaacgccacacggcaagcaggggggcgagggaaaaraagggggrccrggccgggggggcmgacaraaacggaaacccrgaggccscaaaggggsgggg

SEQ ID NO: 76388 - DNA, 342 bp, Triticum aestivum
  unsure (1)..(342): unsure at all n locations
  Clone ID: PAT_TA_76388
ccaagaatcaaatggtaaccttgagtaataattctgctactgaagcargangaccataatgggcatggarrtttckgrrscacatgtaacttgttgatacggtatacccagrtacgggcacattctgggggaaacgggaactcaccatcatagtrcaaaarttgttgratcaccaatagttatasacggaaatwdwmaagagatrkaatasttggartctccatrkaggcakascggcaggkcggatctccaacttcctytcaatagcaggtgggacatctrgaggaaagrgctctatarrgtaccaaakagtagttccaatcttaagagaatcarcaatta

SEQ ID NO: 76389 - DNA, 353 bp, Triticum aestivum
  unsure (1)..(353): unsure at all n locations
  Clone ID: PAT_TA_76389
tgagctggcggccggggcaggtactattctctngaatagaatttmgacatgggagaaagggaatccaatacgataggttggktngtgsctattttcttatatcctggaattcggggggttataggttggccggagsggkmgagtgggkggggtwgatatmkaggtgracagactggcatatgsctttmkaagsctttgggcggacctcgggcggcgccacwgtaatcggattcccggcggcgggcattggggggggggsgatggcgcgkccgggccaattcccgcctataggcrckcngattacaattcactgggscgccgtttacaackgctggrctgggcgaaaccttggg

SEQ ID NO: 76390 - DNA, 225 bp, Triticum aestivum
  unsure (1)..(225): unsure at all n locations
  Clone ID: PAT_TA_76390
gcaggtgtygtcacgccgccggycycccyyygccgggcggcaacttcactgtcagagcctcctgctcccgtatcctctccngggaagtttcctcccctcttcagcaccatgcacacttgtccgccagggcggtacagctcgctgacgtcactgatcttgcacatcgccatctcctcccgcagggcccaggtatcatatacaccgccaaaataaagagccttgagt

SEQ ID NO: 76391 - DNA, 305 bp, Triticum aestivum
  Clone ID: PAT_TA_76391
ataatggaaataaggatttatattatatcatatattaatatatataatwmttatstagaaatgttggtataaataaataaatataaggtgatatatgtatatagatattaaagttatataatgtatatggaaaaaaaagcgatatagtaataaaaaatgtaaatwrthggtagaggataatgmtgtgmtgcgatggatgggatgggatgggtsgtgataaggatgataaggggggtaagatttggataaattaaggtgaagagatgacaggtacmstggtatttaataaattaggggaggaataa

SEQ ID NO: 76392 - DNA, 352 bp, Triticum aestivum
  unsure (1)..(352): unsure at all n locations
  Clone ID: PAT_TA_76392
tcatacgttcccttttttttcnccgctatttccattkcattacttyctatctcktcttattbccagtcastattcttgaaccttcctacaasctcctttgcsttcaacccactacgacctcttycctagctacccstaacttattwagatyggacgcttttgtctttctctntccattctttttttttatcttttcatcgttctccycccmktaatatcctyttttyttgacattaaatkaagcccctttttgrgtacctckgcccyaccacmctaatcgactastcaattggccsccccctccacgtccaccatatcssacacctcccaaccccttccatccataccttca

SEQ ID NO: 76393 - DNA, 241 bp, Triticum aestivum
  Clone ID: PAT_TA_76393
tacgtataacggcatggyatcygccyycyccttgtcaaatatacggttgastatcagcscgastctcacgccggcctgtccyagtctctcctccacgaccgggtagsgggtcamgtcatamycatctccsagggtmatgtcctgcaccacatccttstaggcstagttscaggacaagtstatgccctcgcccgcctagtcatttsccraggtcgcccttytsttggggcagttctcccag

SEQ ID NO: 76394 - DNA, 313 bp, Triticum aestivum
  unsure (1)..(313): unsure at all n locations
  Clone ID: PAT_TA_76394
ccctcacacgcgcggggcgcggcgmgastcwcagcgaghgtgaattagacggcccgycccggrgryatrgatayaaattryaaacycacctcaaadccctatgyyytttcaawarawayttgagtggaagcgtgagggkcaccacccagagggcttnaakggggatggcctcacagatgcctccctacagtgagcaacacccaatttaytcactgaaykrcaccaaggavttcccagacaytcbtaggayacccctgaagmartaacacacccccctggtkgcccggggacttggtgattcagacgtattgag

SEQ ID NO: 76395 - DNA, 272 bp, Triticum aestivum
  Clone ID: PAT_TA_76395
aggtacaaatatgaacaattccaatgatgacctacgggaaatagtctcgagagtagtsttcatgaacttctcccattcaaggacatccctttccatttctctgacacttggtaatctgamaccaccatccataacatgtsatatccacttggccataagcycggctgtmtatcycyccctcaagctctcsgaatagcsgatcaccgggaggtgtggaatctyaggatggacgcagtcgctataaagtgggagggtcattgatgttgagsgaa

SEQ ID NO: 76396 - DNA, 269 bp, Triticum aestivum
  Clone ID: PAT_TA_76396
gtgcttcgagaccatcgtgtgccgctgatgagtgagtgaatcacgagcgaaattgctctacacacgatgtgccctggccgatctgtgcacgacaaaacaatcaagcggccgctgctcctttgtggaccagattcctaccgctggatttgatcgtcgtctgcaaatcgtccaaaagttgtcgtccgcatagcattgctcaatcacgagctgctcgtggtctggcscgcgcgtgtgagactcacatgattctytcctcgttcgatcaccgt

SEQ ID NO: 76397 - DNA, 285 bp, Triticum aestivum
  Clone ID: PAT_TA_76397
ccacaaattcactaataattaacataatcacaagccaaaatacaaaaaaaatacaacaaaaagaaactartaacaaataaaaacaaccaatttttattccattttatttaaagtataaatatatttatagagagtartagagccattagcaacagagccaaagcatcttttatttaagtttctagagtaaccagagcatagctagatagcaagagcagtagcaagctagcargctcccactagagatagarmcagctcamctagagtaccctagcaccaagagca

SEQ ID NO: 76398 - DNA, 375 bp, Triticum aestivum
  Clone ID: PAT_TA_76398
acattaccaactgaaaatgtgaacatacacgaaaacaagggtggacagcaaaattttggacgacctatggcacttactgatcttcttgggtgcactacaagaaaacctatagccatataaatactgtttgatgatactgctacgttatgaactccaaaatttagcaccacctaaatcctaccatatgctacaaacacatctcttcctccccctccctccctaatcacctccaatgctactctggcccaggtgtcaaaactgtcaagcatgatcagacattggagatctattcatctgatgccccttctgtgaacatggacttcagtgtctcgtatgtcataaaaatgaggccgacgctgggaaccactttgcagt

SEQ ID NO: 76399 - DNA, 191 bp, Triticum aestivum
  Clone ID: PAT_TA_76399
acatcctyygcaccctccgcagccgttygccgcactctcgcagccggatcccgcatcccgcagtctcgcctcccgcagcacgacatcggtccggttcggtcgatcgatcctcccctcctcgatgttttatccgctcctcgcyctcgtcgtcctcctcggtcctggtctcgatcctcgatcctcgcaacctc

SEQ ID NO: 76400 - DNA, 374 bp, Triticum aestivum
  Clone ID: PAT_TA_76400
caagcccgacaaggggacgyacccaggagayacaacgagacaagacacacaagaaccaygtgaaggacaccgycaaagyyayacayaaccgtyygcaccaaatgttgcgaycyyatgcsayaccyaacacgggaaccgcgagggyccytgggaaycacacgygcsacacggcaagtscycctycagtagaaggycccctccggaggctgcactagtcyccggttgtctsatgtcgccatcyctcycycmasctgtatcaagatgttctccattgtgtactcggcgcctccgacgaggacgacctcggcgacgacggcsaggatgaggttgatggggatgctgttgccgaartagttgagggtgttgccgtcaag

SEQ ID NO: 76401 - DNA, 252 bp, Triticum aestivum
  Clone ID: PAT_TA_76401
ttagagataactaactgatgaaagcagaatgagcagcagcatatttacagtgaaccgaacacatccccaagcccagtgtccccctctgctatttttgacgacaacagttagcgaaaatgctactaccctggcagctcaggtcagtctactctgtgttctgcgatatcgcctcgccgaacttgaggaagrgtccgcgtcggacgcgctcgacgagttggcgcrggagagggstgccgcttctcaggctgacgt

SEQ ID NO: 76402 - DNA, 223 bp, Triticum aestivum
  Clone ID: PAT_TA_76402
acaaagcygttttacacgaycycaaccyacatttggsgaccaaycyggacagcygaggyccgaaaycyaaagcmccaagccaaycaatcycatcatctatgaaaraattgtgtgacatcccyggaccaaatccycgcaacgaaatwttccgttccagcaccaccccccycagcgctcaagagcgcaccgaaatccaamaaagawycytgaaatgagtagttgt

SEQ ID NO: 76403 - DNA, 254 bp, Triticum aestivum
  Clone ID: PAT_TA_76403
yacgygcacaacacgagaccaycacaaccagacccgacaggaccaacaaaaayayaaaaraacycgygacayyttggttayyccacaytgctaacacgagacgactcggctatyccgtgacgcgamacttgggcatgaccctgtctagycgacgttgaccycgaagacgyccttgcscycctccyccytsaccttgggcacgaccacccggagcacgccgttcyycayctcggccttsmcctggtccatccggt

SEQ ID NO: 76404 - DNA, 207 bp, Triticum aestivum
  Clone ID: PAT_TA_76404
ccccgacagtgccgagcacagccttagtggtatgcactgaccgagcgccatggtcgatgaggcgggccaacccgaagtccccgagcttggtgctgagcgacgagtcgagcatgatgttgctcggcttgatgtcaccatggaggatgcactgctcccactctccgtggaggtagcgtaacgcagatcccaagccaaggatgatgttgt

SEQ ID NO: 76405 - DNA, 305 bp, Triticum aestivum
  Clone ID: PAT_TA_76405
acgcagggtgttcgtccycaycaycgcacgcyatgagggccttgaagatgtcatccatggccggcctgctgcccctctcctccatgatgcacgayaaagagatcttsagcatttccatggcctgtcgagggttgacctcccgtccagcctgccatccaccaatsacatgacgtctccgcttgccaccacctgcctcascgcctgcccgacctggctcatctgtagccgccccttgccgtccacagtcctctgtcctgtcatcctgcttcccatcagggtctctagaagcacaacaccatagctgt

SEQ ID NO: 76406 - DNA, 397 bp, Triticum aestivum
  Clone ID: PAT_TA_76406
atattcccgggccsggagcgacwactaatscsytcscgdacaaaagtgagtartaaacggaaawttgacaaaacgccagstctgggcaatacgractggtgraaakkgctacactgtgagacggccgtgtaagrataaactgaagggrasagrraawkgccgaagaggacaatggaagatctagcttwaattactaccacgagcagcagagcgggccgacgtsacggacaagcgggggacgccatkgcctgcacggrgaggasgcgaagctagtcagggagagggagctrgctgragagggcacgaggttktacgacgctacttgaatgtcctgcacgcggrkgaaaggrggkgkgktttgccaggaatctgccctggcaagcgagagcagagaaag

SEQ ID NO: 76407 - DNA, 189 bp, Triticum aestivum
  Clone ID: PAT_TA_76407
kgaagagacgcacaagtccccctctctctccctctctcacaaacaaacaaacaaaccgctcttgtctcccattccaatctcgccccgtcggtcgaattacaagttagaagaagaagaagaggaatcagaggaagaagaagatggtgtctgcggtgcttcggacgatcctggtgacgggcggcgcggggt

SEQ ID NO: 76408 - DNA, 228 bp, Triticum aestivum
  Clone ID: PAT_TA_76408
acagggcccggacttcggtatcyygaycggccatctcggcggctgccygcccgyagcattctccttcttrggacatgcgccacctckakcagaagcttgagcggtagatccatagtgttcccctctgggcagcatggwggagctgcgcagtatcgccttcagcatcaacggtgttgagcattcggygatkgcacacaccctcarcatttscagcaaaactgagaatgt

SEQ ID NO: 76409 - DNA, 231 bp, Triticum aestivum
  Clone ID: PAT_TA_76409
gagtccctgacgttccggagcggtttatagttttgaaatcyaccyagggacbggtctgatkgcgtkagttkactagtagtagtagtagatagtatatcgkttttccccyctcgtcctgccacgrggctctgcatgccgagattctcytcctgtgtctctgctcygcytaccttgacgcccaccaccygcttggaccyatggagactggggtgtcttggcaggaactggtgc

SEQ ID NO: 76410 - DNA, 444 bp, Triticum aestivum
  Clone ID: PAT_TA_76410
acggtgtaaacctttcaacgccaacaaaatcagcgtcaaacatccatccttgaggttagcaaagctgatttacagcaagaggcgggcgggatatttgacgtagcacagcgcatatacaacaagagacaagtatcggtaacgtagcacggcagatttacagtaaggaaccgtatgcttgttgtagcccagcagatttacagtaaggaaccgtatgcttgatgtagaacagcaagagactggcgccctgtttcgttcttgcgttcactttttctgttgaggcataggaaggctgtcgaacagcttaggcctgggaggacaaaacccattsgggggggggggtcaactggaccttctcatccacacgttcaactgtcttcctcagcgtcttctccatcttgtgcatttcatcgctgcctcgttccccgtgcatatacttatagaggt

SEQ ID NO: 76411 - DNA, 378 bp, Triticum aestivum
  unsure (1)..(378): unsure at all n locations
  Clone ID: PAT_TA_76411
gagtttgtcttyattttttgttgtattgttcttgtgaaraattttyttttgggtgggkggrgaataatattgtasgtggggggggagraaggtaatggaatttgggggggggnvatggggggggaagaatgggargtkggggraattkggcwtatagtgagtggtattaaaattaaatgggggtggttttaaaaagtkgtgattgggaaaarggtggggttacrraaattaatygskttggaggaaatkkgktttttggraggtggggtaatagggaagagggggggagggatkgggcttytraaaagttgcgggaggtgaaatggggaatggagggggsttgtaggggggaattaaggggggggggtgtggkggtta

SEQ ID NO: 76412 - DNA, 245 bp, Triticum aestivum
  Clone ID: PAT_TA_76412
acttgagttgggtattgtggtgcactcggtgatcatcggcatctccctcggcgcctctcaggacccggatacaatcaaacctctcgtggtcgccttgagcttccaccagatgttcgagggaatgggccttggtggctgcatagttcaggcaaarttcaaggctaggtccatcgtaaccatgatcctcttcttctgcctgacaacgccagtgggcatcgccgtcggctttggcatatcgcgggtgt

SEQ ID NO: 76413 - DNA, 195 bp, Triticum aestivum
  Clone ID: PAT_TA_76413
attaacattataaccatatcaacaaaacaaaaccctttcaaactatarcactcttcaaatattcaataaartcaacacmcyccttaracttcttcamtccammaaacaccatcytaattccaaaaatatacctcmaccgccaccacactaatcvaattcccccmacctccattwcrcmhatatacattcyacytc

SEQ ID NO: 76414 - DNA, 207 bp, Triticum aestivum
  Clone ID: PAT_TA_76414
agtraaaaaraagggaagaattttgttgagtttttgagaagataatgtatagaaatagtgtaaaaattaaaatagaaaataawtatggdgtaatttktggttataaragttaaaaatttttaaaaaaaatttttttttaaaggatgatatggaggtaagattaatatttgtgggrggggaggtggataaaattgatggggtttayag

SEQ ID NO: 76415 - DNA, 173 bp, Triticum aestivum
  unsure (1)..(173): unsure at all n locations
  Clone ID: PAT_TA_76415
acctgggstcttaataaaattttacatkganaaarggaatccaataaataattkttgtycctattttcttatatcctcaattcctgtgtttatartttgtccstrccaatrtgtdngtgtkattggkrtgtrgctgaacgarctgccatatgyctttgtaagcytttggccgt

SEQ ID NO: 76416 - DNA, 625 bp, Triticum aestivum
  unsure (1)..(625): unsure at all n locations
  Clone ID: PAT_TA_76416
artcaacctacaragcgagagccagcagaattcactaatagattaagcgagtagagtcagcagagccagaagagtacaccagagcaccagagccccatcagacaacctctakcagctcacctcagccagaccccagagccacagccaccatcttccagagagcattcrcccccaaagtaaaagagacacagttagagagaattarcaactaatccagaagagaagcrtagctaccacagagagagaaaaaagatcagctagtagagaactktagatttttttttttccccagtaggatagataggtatagtaaattagtaggarcaaatagcatagctgtagttrggatagtagtaccytagccmcaggagagagccagctcaaahaatcaraatttcccagcaggccagccantrggagcgaggagaragcaytagcaaacagtcarggscccaaatatcagcccctaataagtaaagtcagtahttacaaathtcacctaggccagtcagtttttacaaacagtcagtaacctaggrgaaaacccctaggcagttaccccaaactttaaatcmgccttwgcaagcacaatccccccttttcagccaagctgggagtaaataag

SEQ ID NO: 76417 - DNA, 522 bp, Triticum aestivum
  Clone ID: PAT_TA_76417
acatgctttatatatattacgatatgattctacatcgtgggaaaatgagttttgratatcatacttctaatgttcctcattaaaaatatatttattatagtgttaattctttrrratttaagggcatgttttgttctgatgatatgtaggaatagacacaagaataaggtagaaatgcgtgtgataagaaaacataggaattttgtcaactgtatttggttcacaaaactcgggattattaataaaaatgtggtcaaatctaggatgctattacgcaattaaagacctcggtagtaggagttcggaaaatgaggtccagatggtttttgcggggatgttctgcattgcagagtaagtgtgacagttgtaggaacttggtcattttagttctacgtgcctattattttccatcattgcaaaataaaccactcatatttttatctcttgatttatgaactggtttgggagcgatgcacattcttaccactcatgttcaagtatttatggcttcggtgctaatga

SEQ ID NO: 76418 - DNA, 276 bp, Triticum aestivum
  Clone ID: PAT_TA_76418
acarttaagccttgatgacacaccagcatgaaaagcttgtgctcccgactgtaatggatatgttacacttatatatcctgtgaactttatggttctggtgatatgcacgaacgctacctcctcctttcattgaaacttcttgggcctcgcaatccgtcgaatgtaaaacacgggtcttcctccccggcggcgaccaaaacgatgagccatgccaccacgcttccctcttttcttttctctcctcctccttcattctctaaccaccggtgcagccgt

SEQ ID NO: 76419 - DNA, 210 bp, Triticum aestivum
  Clone ID: PAT_TA_76419
acaagatcatagcggacgctctcgagagccagggtctcgtcgactcccatcctcaagactatctgaacttctactgcctcgggagacgcgagctcgccgccactccagaggcgagcttatgcaacgacaactctgctctgggcatggcgcagaagcaccggcggttcatgatctacgtgcactccaaaggaatggtggtggacgacgagt

SEQ ID NO: 76420 - DNA, 220 bp, Triticum aestivum
  Clone ID: PAT_TA_76420
caggtacgtaatactctgtcgtcgatttartatctgcacgttttggtattgtagatcaatcgatcatatacagtgttccttttttgattgaggtgcggtcacggtgtttctcttttttgtataaggraggattttgtaaatacgtatatgcacacggttggtgtaactatatagatcgacctgctatacgtacagggtgcggccctggcgcttgagccgt

SEQ ID NO: 76421 - DNA, 164 bp, Triticum aestivum
  Clone ID: PAT_TA_76421
acgtgcgtggccttggcggccagggattttcgtgatgctttcgtttcatgcagccgcgatcgaccgtttgtgcatgtgcctgtaataataacaaaatatttgtaatctttttttatgaattggtaatccccatgacaagcgggatcatcaaatcggcatattgt

SEQ ID NO: 76422 - DNA, 179 bp, Triticum aestivum
  Clone ID: PAT_TA_76422
cacarccraarhacccmccrrccgcggcctgccgggccarrargcaraarraggaraarargaaraarararcaccggtgcccgccattgctgagagagagagagggagagcttccctgtatcagcaagctagcttagctttcgagggggkrgggcgtctaaagctagctaggctcgaa

SEQ ID NO: 76423 - DNA, 350 bp, Triticum aestivum
  Clone ID: PAT_TA_76423
acatgcaggtcttctgaaaaatctgcagttcaggtagctagcgagaggatagcttgacgagattcacaacacaagttactcctgccgcaagcctgttcacggccgcgttcacctcttgaatgkcctcggtgctaggactagaacccggcgctaaacgcttctggtctctaagacaatcgacgttccaaacattttgacccaccatggcctcaacctttttccttttcataaccttcattttctggtgcaatttcggtattgccttcacaatagcttcaatattatcctgaatagatttgtcttcatacaacttcagtacgacggcgtctgcgcggagaaggggcccaggt

SEQ ID NO: 76424 - DNA, 203 bp, Triticum aestivum
  Clone ID: PAT_TA_76424
aggcacagagactcaaatccttcgaggtttggtcgttacaccgtccgccgtagatacaaacatgctcgaatgcactactcccagttaatacgttagactagactacagcgtatgaasscaggcagmtccaccgatgaaaagtatggaatccgctcgaattaatgcacacgmccattcgcgcgcgtagcrgcttggttgctagt

SEQ ID NO: 76425 - DNA, 483 bp, Triticum aestivum
  Clone ID: PAT_TA_76425
accgaagkgagttcatggcagcatctcggrggccgaatctgtttggcgcctttccgttcttgcgcttctttatcatggtgcaagtcctcagagggtcaacgcttccagcabyaggtctcttcaacaacttytctgaagcaactctagcagcttcaatgatgtccttggtaggcagccacttgactaccctaccaggatcaccccgcattggcgaatggatttttacaagaccaagacattccatcatttgataatatgctctcgccatgtagtggagtgtgtccctttctggactctgaaaagtatctcgtccattccttgtagcccgggtctactgtaaagccatacatgtcaacgctgtcacagatggagagagcaaattcaagagctttaagcccagttcctttagcagaggaaccaaatgatgtgcctagcatgaggtatactgggttggttattggragttcccgaatcatcttgttc

SEQ ID NO: 76426 - DNA, 522 bp, Triticum aestivum
  Clone ID: PAT_TA_76426
aacgccatgccatatcttgagctgagcctaaagaggtcgagatcgaccacggagggtgcggatgcgatccaggaggaacagaggaacgtcgtgagagaatcagacctctcggcattcacgaggtacaatacgtgctcgttctccaatcaaggcggggcagggttcgtcgggagctgttcgcccaacggcaacagctccaaggccgcgaaaacggacgccgctcagatgaagcaaggctcaaatggcagcagcaacaacaacgacatgggctccaccaccaagagcgtgatgaccaagcccggtggcaataacaaggtttcacccatcaacggcaacacgcacacgtcggcgttccatcgtgtgcagccatggacgccggcgacacaacagggaaagacaaggttgatgacgtgagcaagaagaatgctgcacagcasagccgcagcagcgaaagacaatggtggtgaacacagagcaacaccctgtgcacggcccatgatgcgaatggtggatcggcaggrg

SEQ ID NO: 76427 - DNA, 164 bp, Triticum aestivum
  Clone ID: PAT_TA_76427
acgtgcrtggccttggcggccagggattttcgtgatgctttcgtttcatgcagccgcgatcgaccgtttgtgcatgtgcctgtaataataacaaaatatttgtaatctttttttatgaattggtaatccccatgacaagcgggatcatcaaatcggcatattgt

SEQ ID NO: 76428 - DNA, 294 bp, Triticum aestivum
  Clone ID: PAT_TA_76428
acattraaactctcccatatartccacctacaaamaaccaccaattcactaataatttcraacarccacccgracaartacactaaaatcacctacttcaacatctcccaaaactcaaccaccaccatcataaaragctgctaactcacctcttccmgaccvaaagagagtttmgaaacttcaggggataaaggggsaggggsactctwatcttttcmcgggcacctcgggcgaaccacagtaatcgaattcccggmggcggcathgggsggggcgaarsattscgcgkccggg

SEQ ID NO: 76429 - DNA, 293 bp, Triticum aestivum
  Clone ID: PAT_TA_76429
acacakgacygtcgccaccasatcygggggcagcayatgtcatgcatacacaaatcatcatacatttacyagctcgcaatactatcatatcstcccysctaataaataaacccycyamcarattaakackctccttattttatwtwttgwtwcwtaccatwtwtatttkgtttctakagtgacadacaccgttttkaccgccaccccacaatattcatctcaakgwtagccgctgccaccatcaccattttgaccggctcctcctccgccgttgttgtcgtagccaccaccgt

SEQ ID NO: 76430 - DNA, 220 bp, Triticum aestivum
  Clone ID: PAT_TA_76430
cttccagctagctagctagtgggtgatcagrtgagtgtcggcggtgtggttaagctagcagcttaaggaacttccagctagcgatcgatggctcgtctcaacagcaaggctgtggtgtccgccgtggtcctggcggcggtggtgctaatgatggccggcagggaggtgacggcactgtcgtgcgggcaggtggactccaagctcgcgccgtgtgtggcgt

SEQ ID NO: 76431 - DNA, 189 bp, Triticum aestivum
  Clone ID: PAT_TA_76431
acggratgctgatgcttgtatattgcsggkttcataaccactgaggtccaaacttgtagaataarctccttttccccctttagaacagtcacttgatggtagtgcatccagaaaccatggaagtttctctttaaattgcgttgtggatggrcgcccattgtgtaagtccgaatgtaggaaacacgttgt

SEQ ID NO: 76432 - DNA, 183 bp, Triticum aestivum
  Clone ID: PAT_TA_76432
accttccatgaaaggcakaccgcctgkgacgtgcagcaagaatgccgtccccttcttcttktggagtgatggtcaaatcagtcggtatgtkakccasrtaatcgksagggtcatgattrgcrasaaagagtttaggaggcagcccatgatcattctgtctagaaaccktgaagaaattagtgt

SEQ ID NO: 76433 - DNA, 300 bp, Triticum aestivum
  Clone ID: PAT_TA_76433
gcggaaatgcaacctgctattatgtggacaacaatacacgtgcagaacatggtccagatcacagatgcaaggggaacaaaatccatgcaaggtcaagggttccatcccaagtttacgcaccattttatttctttggtttctataaaagaccaaggcatcggttcacgattcttccggttggaccgccggtcgagtctggtttttgaaactaccatggtctggcggcctgcattgcatggtgaaccccagcaacacttctgcccgagaaaacacaagaaacgctgcatccccatgcatggt

SEQ ID NO: 76434 - DNA, 277 bp, Triticum aestivum
  Clone ID: PAT_TA_76434
aacaaaaatcamgcacttgctatcattgacaakttaactttcagcttcttacmccatttttttwtttaattaaaactgaaaacaaacttwtkatagragcaaaaaagaaaaaacaaawttaatcaaatcaaattaacaaaagaaaraaagaatcccgatccsggtgggtgsgtktttcktttgaatcagacccatgcgmcctccttkacgackttyacrgacgtccracagctttctttcaaacccccattttcttttttttttccctttttmcctc

SEQ ID NO: 76435 - DNA, 237 bp, Triticum aestivum
  Clone ID: PAT_TA_76435
caaacaaccacccaaacaaatacccyaacmaacccccccccccccamacmccccccccccyaamchtaattaaaaaaahayctatmaattacatcaaaacycaaaaaaacaaaacattattttactaacycctcctacaactcaaccataaactaccaacarractacccrccaccrracaccacarcaggrtacctcaaccacaaccacactaatcaaattcccacaaccaccata

SEQ ID NO: 76436 - DNA, 197 bp, Triticum aestivum
  Clone ID: PAT_TA_76436
cgcggccgcggccgaavcacaamccgaagaccaggaggaagacccasaacccagcgccgaaggacgcgccacaccccscccggccgcagccacaacccaaaarggagaaacscagaavaacccccccagacccgaaacacgcgcgacccaggagagagcaacacccagcagycygsacyacacacyygacacacgca

SEQ ID NO: 76437 - DNA, 279 bp, Triticum aestivum
  unsure (1)..(279): unsure at all n locations
  Clone ID: PAT_TA_76437
gacacasgccgggggccygygyygggggggggggggccsgggcccaaagccaccggggacgtgaacccccagacccgggacacggsgggcagacycacagacctbaggacgkagggaaggacacccagcgcycyacggggaggaagancacatgawatyccgcacgcgtgatgaayccacgtagaaaggbccggktcaccggccgkcgcgctcgcytgccgtggcgcgcactgccagcttgntgacagahctttttcaccgaggtgacagtgatactgt

SEQ ID NO: 76438 - DNA, 236 bp, Triticum aestivum
  Clone ID: PAT_TA_76438
tattgtaaattgtaataagttgtttagtacccvmgttaagytgacccyttgggtcccyttwgaaagycyttgccmgttssgaahtaaatccsagttgatgaagaatgtatttcaagttttatytamaaavgatccmcatttttttgytatgttagtatggttgaagtaaaagrattgtagtgraaaaaaatatgargattttatttmtycatgaaatgtaaaatatgtahmgtggy

SEQ ID NO: 76439 - DNA, 314 bp, Triticum aestivum
  Clone ID: PAT_TA_76439
gaggaccgcayygagycccaccgccaccaygaaccccyygaaagggacaacaytaagyytggcaacagyagccgggagbacacyccggccgccycagagyycgcaggagaayycgggbycgggbcgcacagcagggacyggatagaggycaayayygccgcaacaycayayayagggccccaccggbyccgyaggatgyccaagcagatgcyyccayccgcayaaaygyytgggtgaaacayccytgagacaaaccgaacagttggtggcyygtyggggkaaycttcygtgaattgcagggtcagcttgaacgt

SEQ ID NO: 76440 - DNA, 224 bp, Triticum aestivum
  Clone ID: PAT_TA_76440
ggcataaactcgccaggattgttccagtatgcagggtctcgagaaatcgsgaagacattaacgtatacattggtgcctttggggrtgtcataacccatgatagtacaatcctctatggacgcgcggggaattagggggcaggcggatggaacctgagggtttccttgatgaccatctgcgtgtagtcgagtttagcgaggtcgttattggtaatgacagcccgg

SEQ ID NO: 76441 - DNA, 308 bp, Triticum aestivum
  Clone ID: PAT_TA_76441
tttagcgagtgcaaaaaaggcttgcggtcctgaacaarcgcgccaagggggctgctcctgcatgtycatgctgctgtccaccgtyggtatagtgatgcttktggttattktytggstcctcatmaagtatytgtaamctctgcmcaamtyaaatwagttttaastgtgcagttttttyaaaratagtatggttayttccgcttcscmattcacttyggcgaraagtgggaaatatttatgchamatgtgcccttatygggttgaaatgaaaaaattyagacttttktatgtytgcagtatatgagttc

SEQ ID NO: 76442 - DNA, 185 bp, Triticum aestivum
  Clone ID: PAT_TA_76442
gratgacccaacttgatatgaacaattrtgrgtratttgatgcaccrgrtccracggcttccgrgatccrrcggctgtcggaacccgtatcatgggrgcrggctrracccggtggrtrttctccctrcrataccggtgtggcgtrgtctcctccrtgtccggrgtcgctctcrggtggggcctac

SEQ ID NO: 76443 - DNA, 521 bp, Triticum aestivum
  unsure (1)..(521): unsure at all n locations
  Clone ID: PAT_TA_76443
gtggtcgtggccgaggtatttgtataaattttycaaacttattttsagggagcacgttgcccagtggayattattttcgcagttggtgaaytggtttatgtttttttgtattacasggactttatmaaatagyttggagacagttttgactgtggytggaytytattattggtttwttgcaattgagttttccaaggaawtttttktttttttaaagyagcaggysgccagttacmawagtttttatycaagaaaagtggtgttattcatagcagctttagtttgcgctattcggccaacaagygctataacatggttgtatgttggttttttggattttatttatataaaatcgaaatgtsgatttttgttttttgaggthattyttttaggggccatsgtytttgnagcaacaacattdtttgataggtggatgtatggttccggggtwattgtgcaatttaattttttgaaattyaacytatttttttyaggaggagattattatggaaaacaagttt

SEQ ID NO: 76444 - DNA, 262 bp, Triticum aestivum
  unsure (1)..(262): unsure at all n locations
  Clone ID: PAT_TA_76444
tagaatatttaagttatgtatttaatgtgttgggagttytyyyatatgggtcgayctgcagggygtgtccgcraattcactagatgattagacgtggatcgacgggccgwaggataccatccaaatsaaacagaccccgrtaaathcagactccagmkcwcgagagcaacaacagctctctctgttctctcccamcagakctccartgagcadtaragcacaggkcaggnagacaacaacatctctctctggtctctccaca

SEQ ID NO: 76445 - DNA, 403 bp, Triticum aestivum
  Clone ID: PAT_TA_76445
acaaaaaatagtgtggagcytagcattacaatatgtatkgtttgcgatatatsgagcagaagatgaagaaggtatgtgagtgttrgggtttgygttsggtattcagaccgcagaaggaaaagaatggggkgtgagaagtbttagtttgatcgattgtgtattgytgtatktgtaaattktaataagttgtttagtatcgcagttaagttgatcgtttgggtctatttagmaagyttttgcaagttsggaawtaaatwcgagttgatgragaatgtatttcaagttttwtttacaaacgatccacatttttttgttatgttagtatggttgaagtamaagsattgtagtgsaaaaaaatatgragaktttwtttatccatgaaatgtamaatatgtavagtggg

SEQ ID NO: 76446 - DNA, 376 bp, Triticum aestivum
  Clone ID: PAT_TA_76446
cggtacgagcttgtattgavacacasgcastgtccacatttgmatabtgaacgtattcttgcywbtccyttccgaggagggagcttagagcttdaaycgtcmtcttctgcttttggtggtagtttacgaagagaaaasggaaaamhttctycttctaaggttagtgttcsmctgtttgctgtmcttgaacctccwaacccttctgtgaaggtcctctcyttgaaccctagtaaggmcttwbggctgctctcwyttggctcayactcsctaacaactccgctcggtgctcmcctagrkggctgacaycccaaamvcycttcctttttsakgactccagasggttchyacytccccacggtcmmraawctgagckcga

SEQ ID NO: 76447 - DNA, 186 bp, Triticum aestivum
  unsure (1)..(186): unsure at all n locations
  Clone ID: PAT_TA_76447
acccggcgcgcatggagcgcctgaccgacccgagcgagcgaasagggcngcacgttstaataattaaagcagaggkaaaagracacgtcgtcatcgcacccgcgtgggtaaagtggcasggctaatcggaaatsrtgctatcgatttcgcatwgtaactcgcagtgcagtcgccgctcggtttaaa

SEQ ID NO: 76448 - DNA, 306 bp, Triticum aestivum
  Clone ID: PAT_TA_76448
accaaacttttgcttacrgacttccaataaarcactttattccaaaatcccaatataggaactttttataarataataaaattcttttgacaaccaarcagcctcttctgtatgctaactacgggtatcagcaaatcaatactcattccacaaaagataaattgtatacctccttagaaaagcaccatattcaaatwtttacccaacaaatttctaaaatatgcaggttgtgacttggaagtaatgcctgcaaattcactttatcaagaatcacaagaggagcagcaagtcaagaaactgtcctgt

SEQ ID NO: 76449 - DNA, 283 bp, Triticum aestivum
  Clone ID: PAT_TA_76449
gccaaaatactcaactccattaatcatcttatcamcmagcattaacacagtctttaacmraaactttctacttsagtarttwaaaarggcctccaagsttggkccmraaaaatcaatcaccatcacattatactctccctccacaccaaaccactttrgggggagratwscagttcctcctttggrrarsattkaargstttgrctcmkaatwgggstbgggggkgtttgkctttrcattttccagktttrcgggmgcctcctctccgggcttgacattcaca

SEQ ID NO: 76450 - DNA, 213 bp, Triticum aestivum
  Clone ID: PAT_TA_76450
bacaacaccccgcagccggcgccgaaccagcccaacaaaahgcggyccaaccgagcgccgccgccgccgccgccggggcaccgcaygcggsccggccgagtgggsccgyaygycygcgccagcccahmaagagccgyggbagyagcgyggaacgcggggtgagycccgcctgcaaacccccyaamcctgtcccccccawkgamcaaatgcagt

SEQ ID NO: 76451 - DNA, 367 bp, Triticum aestivum
  Clone ID: PAT_TA_76451
actagtaggcctcttagtaagcttwaaatcttacsggtcaaktgkttrgcgracctahtttttwtacgagctaacgaacctkyttawtwtaaacwctttvccccaawtctcccccgtrgctcktrggttcktcaccccattttttgaaagcttgaaaagacgatccaawaaatctcccttttcaatatcctattaaattctcggagtcgcawttttttctmctttawtawttawattctamtwtawtttwttawctcgcggcttrrcccaarcaawatccmycttttwtcmtytttmmccctmactttcttaaaacacttbctcytttttttaytcttyctattaatatcaactyttttyttctttt

SEQ ID NO: 76452 - DNA, 294 bp, Triticum aestivum
  unsure (1)..(294): unsure at all n locations
  Clone ID: PAT_TA_76452
cggatttcgaacaaacactgtcgcccagggcgcaggtcggcgttcagctctycacttcgtcctttcacagbccacccgcgngcgctcgcgcgcacgngnacggtycycgcgcgcacacgngcgccctcacacacacacgcctctcacwctctcaccccaccgcgcgsgctcamcactcactcacacacgtctcgccckcatctcgcgcgcggtctctctcgsttcctawctctctcgcarcactctcgcgctctctcgcgcgstctctctcccctctctctccccactctctca

SEQ ID NO: 76453 - DNA, 329 bp, Triticum aestivum
  Clone ID: PAT_TA_76453
acctcctagtctccgtgctatttctagttcagaatcagaagaaatctctctgttacgccggagagtgagaggacttctgaacaggctttcggagtccaatgtggagtctattactcaggaagttgctgcaatttttcgttcggttccacgaggtgttggctgtcagttaattggtgatgaagttttggcaagttgttcccggggacctcgtggaaacgaacagtatgctgctgtatttgcagcctttattgctggtatgacatgcttggttggtatggactttagtgccaaaatcctttcctctcttgcgaaatcttttgaggatgagt

SEQ ID NO: 76454 - DNA, 297 bp, Triticum aestivum
  Clone ID: PAT_TA_76454
accgattctcttctatgctaatctgaattgcatgtggctgattggttaattgttgtccatgtggtttccatgatttttgttgggrtgsrragtagataaggaatacgaacaagaaatatactagggccaaggaaacgtgtgttactaggtcatatcaagggtggtttcagarattataggctatatatgtttagtgtgtgagattgggagtkwgtaaaagaaattaacagttactgtcgctttgtatggatagattaatgtttttctgttggcataatgcagaggaagtacctcggc

SEQ ID NO: 76455 - DNA, 349 bp, Triticum aestivum
  Clone ID: PAT_TA_76455
acctgcagaagccgttctgaatgaacgcggcatccgtcagacccctcctccttagcagcctccactaacatgttcgtcaggtctcgtgtaattcggtctgcaagcttccgbmaccaatgcagattagagaaaacttagtgaggattaacccgcacaaatctgatgcccctagatcgatcgatcgggggttcggatgcagagttttcccaaacgcacgtatataccaggtgttagcctcgtcaggttttggatggcatttgggtgacttggtactcttcgtgctggacggactggcgctggccgggctgggtgcgctgggcgacggtgcgggcgacgaagacgatgaact

SEQ ID NO: 76456 - DNA, 269 bp, Triticum aestivum
  unsure (1)..(269): unsure at all n locations
  Clone ID: PAT_TA_76456
gtttcgtgggcttgyctggctgtcccgcyyctttgccmnctyggcttgtygcytctcggccggggcttctttggktctggktttgctggkttttcggkctkttytkccttttcgtctttttttcttttttgtcttgtcagattttgtgggtgttttggkttgtttttgctctctgtcatagggctagctwtctgrttgttttcgtgggtgtttttttgtccgtggcgctgtttgtttgcccmtcttggtttttctttgtycgctttgtt

SEQ ID NO: 76457 - DNA, 281 bp, Triticum aestivum
  Clone ID: PAT_TA_76457
acaagcttytttttttttttttttttktgtgtaaagcttgcaacatttaatttcyctgattttatgggkctcacaagcygcactgaagctaagcagcttcaattacaagytacaacacatgcataaaakaccacacctaggatgccgccatgattattactggagctcgagccatcccaggaactcatgctggcagctagtctacctctactactctacgagaacgagatacagcggccaagcacacgaagcatgcatggcaagataattaaagcaaacgt

SEQ ID NO: 76458 - DNA, 217 bp, Triticum aestivum
  Clone ID: PAT_TA_76458
actggaggagaacaaagtgtgtgctgtggcgaggagtgttgtttgcaaaatttccgttggccttctctagttgcgtcctcgttactgctgctctagacaagtatggaccgcagacgcctccacagcatgaccaagtgtcggtctttttctctgaacctcttcctttctgcttgcacactctgaacttgttgcacctccgttagtatggaatgattgt

SEQ ID NO: 76459 - DNA, 311 bp, Triticum aestivum
  unsure (1)..(311): unsure at all n locations
  Clone ID: PAT_TA_76459
ctcggtcaaagtcaataatatactcattttgttttggcggatatggtatcatctatgtgaagaatktctttccatcagttttggttgaaagccttgtctaagctggcgacataatgtcgacatcccttgcgataaacacccatgctttccgcacctcccaaacttccggtccaaaacaggtttcctttagacacgctactgggttggmatwanctagtttgggagattatatcgtktcaaactcgacgacccaacagagtaccccattttcgacaaggttgatgtcaacggcagcaatgtttcccccctgt

SEQ ID NO: 76460 - DNA, 223 bp, Triticum aestivum
  Clone ID: PAT_TA_76460
cttccasctavcyagctagtgggtgatcagatagagtgtcggcggtgtggttaagctagcagmcttaaggaacttccagctagcgatcgatggctcgtctcaacagcaaggctgtggtgtccgccgtggtcctggcggcggtggtgctaatsatggccggcagggaggtgacggcactgtcgtgcgggcaggtggactcccaagctcgcgccgtgtgtggcgt

SEQ ID NO: 76461 - DNA, 188 bp, Triticum aestivum
  Clone ID: PAT_TA_76461
accccgcgccgcccgtcaccaggatcgtccgaagcaccgcagacaccatcttcttcttcctctgattcctcttcttcttcttctaacttgtaattcgaccgacggggcgagattggaatgggagacaagagcggtttgtttgtttgtttgtgagagagggagagagagggggacttgtgcgtctcttc

SEQ ID NO: 76462 - DNA, 223 bp, Triticum aestivum
  Clone ID: PAT_TA_76462
ccacacgccgcmaatttcactatgtgatttcgagtcgsgccgcccggggccaggtacaaactcaggtcgggttattggcacaakcagaaaaaacccgagctaggttaaactctgagatctycacatgakcttcttagcaagaatatctccgaataaaacccgcayctggctattwccmtawccgggtagtttattcyggcmtatatatgcgtatatacgtacc

SEQ ID NO: 76463 - DNA, 222 bp, Triticum aestivum
  Clone ID: PAT_TA_76463
actgcmccatgtwtggtagcaamagaatggccggactttggagttyttcttctcgtwtcaaggatacgttgggcttgkgcatatgatctatcmcggaaayccttcgatagatytttwtytwtacccttcattaagcttgcaagaacmccagcrgaatgcyccctgmcctcaacttggttwtccmcaagtaacttctcgattgttctttgtgtytttcagmcc

SEQ ID NO: 76464 - DNA, 430 bp, Triticum aestivum
  Clone ID: PAT_TA_76464
gaacsgaaaaaagcaccgccactatttccccagwccaagaaaaamgwccccacacaagacacagccagcacaagtcacatcaggacaaagvccgagcaggaaaccacagggcgacwmcgtcccacccaccaggaagacacacacagggacaggaccgawccaggcggaggggcaaytgggggacgggcctgggrgcccccggagacggcgggctkggcgagcccgccggggaggacgaggcggacggaggbcsggaccccgcgggacgwgayggkgggctcctcgtwgyascgcgccascybggccgacccsccggccagytgcccgaagaaggcgtggargaaggagtycamgatcggacaaggcytkggaggagwmgccgwwkcccggggcgcacckcgyttcagcacctggaagwtkcagwwctkgt

SEQ ID NO: 76465 - DNA, 389 bp, Triticum aestivum
  Clone ID: PAT_TA_76465
actagtagaaattcaatctaatgacgacgggacatgttctcttttctttatgctgtgttaataggataccgtaaacgtaggccgctgacaatcatatcatagctctcagtcmgttcattttctctatggggaatgaattcttagctgctgcaagtttggcaaatagacaccatactcgtttttctgtgtaaacatagttagcacctctgtttttgagtagttccttacttacctctgtgtaaactgaatttgygttcagttaaaaaactgcactacctgacagttttgggcagcgagcttctaactgaaaaacgagttcgttatgctcataatttcaagttggcctctacatatgagttgtaaagcatgttctaaggtttccgtagagt

SEQ ID NO: 76466 - DNA, 171 bp, Triticum aestivum
  Clone ID: PAT_TA_76466
ctaaacacstcgctcaccaccgggcacatataaaskcgcattcscggtttckcaactctcrcattcsttttgggtttcctttctccatttatctttctttktttktcctaamratatyktkatykccatyktcattkacctccgcgcgcgcrccaccstaatccrattccc

SEQ ID NO: 76467 - DNA, 331 bp, Triticum aestivum
  Clone ID: PAT_TA_76467
acattcctgaagtgaacttcctcatgggattggcgagcatcgtggtcacgsgtcgccttccggacgaccaccagcatcggccacgcttacgggatctgtbyggtgaccacgtttkcgatcaccacccatctgatgaccgtcgtcatgctgctcatatggaagaagcacgtcatcttcatcatgctgttctacgtcgtgttcggctccatagagctgatctacctctcgtccatactgtcgaagttcatcgagggcggataccttcccatctgcttcgcgctggtggtgatgagcctgatggcggcgtggcactacgtccaggtgaagaggt

SEQ ID NO: 76468 - DNA, 195 bp, Triticum aestivum
  Clone ID: PAT_TA_76468
acacatattacaaatggtggcggtgacagcaattcagcaaatgagtttgctgccagctaaacggaagcaactcgatagacctacaacaagtagggagaaagcaccatatgaaggtttgagtaagagaacaagattttgtggcatctgcaggcagcaaggccacaagcgaacaacttgccctgaacgcggggatgt

SEQ ID NO: 76469 - DNA, 404 bp, Triticum aestivum
  Clone ID: PAT_TA_76469
acttttggmagttgaacctagtccctggggataaatgagcagcaatgaatccgtgccgcaaagtcaggtagtctgtcctccgaacagatctgaaaaactgcctaaagaagctcacgacatagagcataatcgtgcttttgctccaacagcttgcgtgctgcctcacaaaagaagtctggtgagtgagccggaatttcgatggatcggctgaaaattcataggtgatggaggaagtatccttttcccactccttccatatccgcgtctttgctctgcccagggacattgtaatagcactgaacgttacatggaagacggccaggaagaacacgaagatatgtagctggtgtagcccatcggttgaaacgagtgacaccatacctttggggcatgagaagtaggcc

SEQ ID NO: 76470 - DNA, 602 bp, Triticum aestivum
  Clone ID: PAT_TA_76470
acaatgaagcgtagatctgcatatagacgtcagggaagggacactcgcgtggctgataataggctataggcctccytataatttttatatacgtttaaagggatgaagtgyaggaaaactttagcatcttaccaattagaacttacaactgaattttatcaaattcataaaaacgcaaactgaacaatacattgaccaattactatctagcggasaaaaaaattagatttgcatgbvagaagcaacatatactatatcataacagcgatttattatcctatataccaataaaactgaactattaattaaagacatacaaatctaaagattgtatgskatacgggtgagcagtcaaaagatgttctacctgtcaaatggaggatgcaaggaaccaattgctttcatggctagctgtaaatttaccaaaaatcttgtgagaccataggggcaaagaacccgcgtagataatttcckagaagagtagtgcttctctgtttgctagtaactgatttcgaatgaatcttgatacgatcctgatgcacttagcaagacaaagaaaattatgttaatcttctgatcaaaggcgcgggaatcctgattgt

SEQ ID NO: 76471 - DNA, 231 bp, Triticum aestivum
  Clone ID: PAT_TA_76471
acctcctctatcttctgttggtgcctgctgcttctgcaatgatcctcaaattgagatttagagtwacattcggcctcgcacattgtgcaatgccattccsaggygtggttcttggctcatggccactcgtggtgcattgtttttctcttgcttggttttcgcgcttaaaacctgaatgtttagttggtgtctcttgcctgcaagatggttctccaagtctgattcacaagt

SEQ ID NO: 76472 - DNA, 225 bp, Triticum aestivum
  Clone ID: PAT_TA_76472
acaaaaaatccctgggttccttcacaccgatgtcaactagactacatatgatcatattaataactatctggctacataaatattgcagcagcgtcgccacsaattcaaaaggaacaacatcatcttcatagttcagtaccatctttgattctgatggtgagctgagcttaactgatcacttcatgccaatttattcagaaggacaaacttgatgaggacttttgt

SEQ ID NO: 76473 - DNA, 179 bp, Triticum aestivum
  Clone ID: PAT_TA_76473
tggtttttaatcgatctaaccatcgatgccagcatacgtvtctgctgacttccktatwttthctkcggkgdagtacgagtgtgttcaagcctatatctactgcttttatttgcaaggtaaagtaaaatrgggatccctccctaatgcatcctatmmatcmatmcatccctmccatccwt

SEQ ID NO: 76474 - DNA, 302 bp, Triticum aestivum
  unsure (1)..(302): unsure at all n locations
  Clone ID: PAT_TA_76474
acaaacattaaagtcctaggtggttggctaaacaattaatagtagagaaggcggctactgcacagacgcaattgacactcagttcttacacaggctcccccgcnccttgatctggtgcagtgcaacaacaatcttgttcactcctcaggttatttttctggaaataaaaagaaaaagaacatttcatgccattttcaaataactgctccaaaaatatcctgtgctcttaaaagaattgacatcgcatggccaagggagagctcaaccactgctcctttcctctaggttatcttagtacctcg

SEQ ID NO: 76475 - DNA, 321 bp, Triticum aestivum
  Clone ID: PAT_TA_76475
caacgccgccacccggckacactcgaatctactccgacttctacatcaacacactcccccaaccccgtccaagctccgacgaggcgaacacttcaccacacatgtcyccttcccgatgaagcmatccatatctygccgggcaccgatgaggcgaaggcamgacacaccgtgtctaacaccgacgaggcggacaccaccaggccgggcaccgacgaggcgaaggccgaccatctgtctgagctgacgaggccagacatcttcatcatcggacatcgacaagccggagggatgtgactaagcatcgctgggagcgacggacgt

SEQ ID NO: 76476 - DNA, 284 bp, Triticum aestivum
  unsure (1)..(284): unsure at all n locations
  Clone ID: PAT_TA_76476
agattacagagacgygcatgcaagcagagacccggccccgtgttacacggagatgcscycytagccggcgagagcgcyggggttgtagacgaggaggacgccgccgccgaggaggccggcgagggggacggcccagavaagaagcccgggcgbyccgccggcgbacgggtcaccagaatcagaccamtcccccggcggggagaatgggccggagccggcgacggtggcgccggacaaaacmgkcycagacaacaaggncaaagaggccacaaggcaaaaccccg

SEQ ID NO: 76477 - DNA, 339 bp, Triticum aestivum
  Clone ID: PAT_TA_76477
accgcgacacccgcgcctcccgccactcgtccgtcctcggcctcggcggccacgscctcgccatggcgtcctcctcctcctcctccggccgtccacatgccctacaccatgcaccatggttaaatatacaagttaactgtatcgagcatatagtgaattaagctgcaaatcgtgcatgcaccgcgtggtcgtggagcaacaagtcatcgagctggccgggcggccgccgcccgttcggtycamggcgagcbtgcccagctcctccatgaccgcctycgttagtttcagcctaaagatccargctcctttttcaagaactgcgcattcgtcaamcggcgt

SEQ ID NO: 76478 - DNA, 430 bp, Triticum aestivum
  Clone ID: PAT_TA_76478
cagcaccaacacccacgagccgcaccggcgcggccagcstcccggggahgtcggccagggacgcggygcacgcggcyaamggggkgaccaccaccactttgcactgggtgcgggcgagcagcgatgaggbgaccccacccacgcacacggsggaggccccggcgcggrccgccgvcacgcrggccaacacggsacgccgcacaccaaccgcacggcggcgcccgcccaaagcagagaagcaaagcaaacamaagacggggggggawawggcatccgggcaagaggcsggcagaggsgcccccccgggaacggcggggcgcggccgggccgayggaggccccggsgccgcacagcawtacvgccggagacgavcgccagaggaggcggcccgcccgccccccggccakggagagcggcgagaaggaggcac

SEQ ID NO: 76479 - DNA, 284 bp, Triticum aestivum
  Clone ID: PAT_TA_76479
cccatataaaacataaaatcaagttaagttcaactattacacaacaaatatataagcatgcgccaaaatgtcccyttggccctgatgctctgaaaggcagcaaacttacctagatccatcactatatcacaactccagatgtatatatatgcccgggcatgatgttttcgtgccgttcaattctcaccgatcgtcttcaacagtatatatatgaacaaaatccagaaactcctttggttaatccgtcaagatgttcaaaacttgtgcgttccgttggcgcgtac

SEQ ID NO: 76480 - DNA, 235 bp, Triticum aestivum
  unsure (1)..(235): unsure at all n locations
  Clone ID: PAT_TA_76480
acgccgggaagaaggcggtgatcgtgcgcgtgttcgaggagggcacccgcgaccgcccctacgggcactgcctcgtcgccggcctggccaagtactgcagctccttgcaaaattgtcgggacaccttctcttcttagcttcttctcaacaaaactgcgactgtgctttcctgtccgcctggtccaaccyccaggcacgaagbtagnagctggaatgataacagagcaagatatcg

SEQ ID NO: 76481 - DNA, 376 bp, Triticum aestivum
  Clone ID: PAT_TA_76481
actacctccgtccgaaaaaacaacggagccgccacaccacccccatcgcaacccaacccgtcctcatcgcacccatagtttgagtcatcgcaccaccgctatcatgggagswagacctcctcgactggcgggcacacctccatgttcccgtggcggdcgcccgcaggttcgcagggaactccagagccaacccatactaccccaacctccagaggccgtgctctagaacagcacgagagcgggtcctggtttatgtttctcacacttgcaaaaattatgtctttaatttggctggtcatattattagaaaaatgtcttgttatattattattcttatttgaattggcttgttatattaaacacaacgtggcacagt

SEQ ID NO: 76482 - DNA, 367 bp, Triticum aestivum
  Clone ID: PAT_TA_76482
ccgccaggaagccgcccaccaagrgatccacgccggtgaagaaggccgcgcccgccaagaaggtgcgccggsgaagaaggccccggccgcmaagaaggccaagaagtaggtcyttggrgggagatcttagggtttggggatagttttcmagtagragtttttcttgttttgtgttgttagtkgagatgtccgggttgtgtggggggtgttaggttgtaaatttgaaatttgggttggggtgrattggtgatcttgtgggsbkytttgtgtgtgttgtgagaaagggtggrgaratcgtgttgtrgvargtttwtgtwtttgtgtaattgaattgggtaattgaattttcattttagcaaaaascccm

SEQ ID NO: 76483 - DNA, 380 bp, Triticum aestivum
  unsure (1)..(380): unsure at all n locations
  Clone ID: PAT_TA_76483
tggtggtggtggtgtgtgtggatggttgctgcagcatagctagctagggacggggaaggtggaggaagcagcggagtcagccatggggrgggggagggtggagctgaagcggnatykakaacaabatyaaycgccaggtcaccttcgccaagcgcaggaacggcctgctcaagaaggcctacgagctctccggkgctgtgcgacgccgaggtcgcgctcactcgtctctctccaaccgcgcgcaagctctacgagsttctgcagcwyyyagatgyatggaygaagatactcgacaagtatyaaaaatgcagttatgcagggatytgaaaytaytgtgyagaayagagaaaatgagcaaytgaaaaayagccgcaatgagt

SEQ ID NO: 76484 - DNA, 208 bp, Triticum aestivum
  Clone ID: PAT_TA_76484
acggtgcaatatttagctcacacggccatatatataacgcacgccgccgatcgccggtgcaggtaggctgatgagtcccgatcgaacaatcggctggcaatgcaggccgggctgcaaaaaatgtgcggcgatcagcagatgacgcacgcattggggccttcctcggtgtggatgaagtagcacgggtgcgggtgctgaggcggcgggt

SEQ ID NO: 76485 - DNA, 440 bp, Triticum aestivum
  Clone ID: PAT_TA_76485
acagccrtcgaatgsaaggcaatagataataataactcgaaacatagcctcatattgcatagaaaarrccaatattgtggaaaacagaacatacggttcatatcattrrtcatgtcgaaattataagcccaataaaccacaacctcgaaattattgccacctccatcscataccctcatctcaagcaaatgcataccatgccaaatttagaagacaagagcacaaccgaggattskagcaatcagctatcagcgtcaagtgaaacragagagggggaagaaagagcacccacataagaagtcagtgaggtttggggacaacgattggkaggttgggctccggacgctgaccacaaaaattagggtggggaaagaacagatgskaccttattatgacatgacaccacacatgccaccgctgtgacgccaccgggatcaaca

SEQ ID NO: 76486 - DNA, 194 bp, Triticum aestivum
  Clone ID: PAT_TA_76486
acacccgatccatgacacacatctacggggctatgacaaacgacaacggaagcatctaaacactagtagccgagcaagcgggatcggcaacaattccatggrtccactggactagccgctcctctcccgccataatacaggcagcagcaggagccagcagaacttgctccacaacagacatctaaacaaactgt

SEQ ID NO: 76487 - DNA, 505 bp, Triticum aestivum
  Clone ID: PAT_TA_76487
gaggtaccgtcatcgaagtccagcacgcccacgtgggggggcagggtaggaggaagcagagccatgahgtdyktdkgtdtgtcacgttcgttcggtcgtccagctgctactgastgcaggtcgtgcgtccagatccggggcagtcatccatagccgtcaccggagatccgcggtcgtcggcgcgcgtccttgaaggttgaggcgtcgtccttgagggtagagcttggggcgtctctgtccatccatggctactgkbgggccgggtcggacctccgtgccgacctccctcgaggacggacacgcatcaggtcgacgacggcgcgctgatgcagccgtggatctgggcgctccctctcccttcccttggcsktggsttcccttcccttgggattcccttaggagaggaatagaaggtttgggcggcggtgcaggkgggcgaggagatcgccggcggsggggttggattggggtgcggcggtggctgagactggagacgggagacgag

SEQ ID NO: 76488 - DNA, 173 bp, Triticum aestivum
  Clone ID: PAT_TA_76488
tcgtttgggcgcttttgtttttggtccttggtraatccatcacasgtcttaattacttgagagcctccctcacgcttcattggrcccatragacccatcttcatctccaatcctacaagtttacacaggcgtcccatctttcccatctttcacttgaacggggagaacagggt

SEQ ID NO: 76489 - DNA, 894 bp, Triticum aestivum
  Clone ID: PAT_TA_76489
acatcagatagtctgaagccaccatcctagcaacatatgtcactatttctatccacttgatgaaggtgtgccgatagtccgagcctaataccaaacagrcatsgcacaaatgcctaacatctaatgtcggaggccccaaccaagccacatactgggtttggggtatacaccggtccgacgcactctcatgtgctgtcgccgccatcttccaccaatccatcttcagagcaaaaactaacgcaccgaccttgctaggcctctctgccatcaacgccaccatgacgccagacaacgtcctcctcctgcgcgagtccatctccttgcatcggacaccgaatccccattgcaccacgccgccgagawccgccgtctttgatgtggtaaatgaaaaaccgctccaccacttgtctccctccatccagccgctgctccaaaaamaatgcccccatgagggagaacgacgcctaaagtgtcgccatcgttcgatccgggaaccccgggtctaggttttcacccggagcagcgcaactagatcgacggtagctacagtggcgatgtcttcatcaagataatgacgcgaaaacgccgccatcgcctgccctgaccgaagtcatagcacggttttcaccggcagcatcatctcccmctcggcgctgggactggatgtgtgatgccacaaccagctggccgaccacctccggcgaaggaagtagccaccaccgccacgccgagggtcggagcccccgacgtcctcgtgttgcgggtcgagcccmggagcagtttgccattgacggagcatggaagacaarccagcagacatacatacmtatagatgcgcttrtgcacagrtgaagtgggtcacccactgtatatctcaccgtcgtcttcctccga

SEQ ID NO: 76490 - DNA, 326 bp, Triticum aestivum
  Clone ID: PAT_TA_76490
ggctgtgttcttgtgacgctgtygtctgtcttccctcgttgtttctgtgttggtgggctgggtcctcgcgggcctggcggccccgattgggggggcccttgccctggttcttgggggccttggtttggtggcttcttcgggtcctgcttctycctcctctgttgttgctgcctcctccsagrttgctgcggccccttcttcgggcccccgggccccggcgcgctcccccccsccccccttctggttgccgccccvcgtatcccccccmacggattrtgcsggcctttktgttggctggcragcggmcrttctggctgttgggggtk

SEQ ID NO: 76491 - DNA, 815 bp, Triticum aestivum
  unsure (1)..(815): unsure at all n locations
  Clone ID: PAT_TA_76491
agaaggccccatccccaatgcccatacaaccgcscgccggcatccatcccccaaaagcagaacagccatccgccggaaagaggcagcaatgdmygcccccagtvgtccgtccccccccgycgcagatgaaatggggawatcamccgngcacagatccccggacccaatggccaawcgaacccgagncccgagaccagcacaagagaaahcgcaahcccygtgtcgccgcatcggaaccccgaaawmaawagaatwgggadcaccyyccagggcaagccccccaagagcaggaccgccacccycccgnawatcaagacccagccamcccgccgaccmgtcawaagccccgccaawcgcatcamccadsgtagtccccagybgaacayacccaccaagggsccgagcaagaacaagaagatygtgcccgcccggaaaccaawgcaygngcccccacawggvgaaccccaacaataggcaagggaaamacccccgccawcycccgagccccgagaacaccaaccccaaggcacagacmaaghcccggsccaatggkcacggccacagcagaaagamcacccccygaaacayttgcgtcatcaagtgcyttcygaacaacccgawcaaatgcaagagcatgagcctcyccggccatcccaggagcaacaccgccccatwgcacaagcaaatccgartgagaagcaaacaccsggscaaaggavcvccccatcgccyctgaccacagcggtggcagngtcgccgcaacaggkcccgawgccgaacatgaggagggccggcgggcggggaaagcgcggagg

SEQ ID NO: 76492 - DNA, 208 bp, Triticum aestivum
  Clone ID: PAT_TA_76492
cacaamcaagcaasahgcatgcatgacacgsccgggcygacccaacaacaatgaacccaaactcgcaagaacagcgatatggagcyagcttaaycagscgacggggaccyccccgaccatgccggccccggcgtgcggctcgcagaagaagccgtagggccgggcacggggagggygacggagaaggkctcgccgggggcgtcgaggc

SEQ ID NO: 76493 - DNA, 461 bp, Triticum aestivum
  unsure (1)..(461): unsure at all n locations
  Clone ID: PAT_TA_76493
ctggtttattgtttcaggaattagtgtgtcgggacggcgacgagccgcgtgcgaggagccagatcggacggctcgcgcacgaagatccgacggctgtcganaccgtttgggagtgcaacatggtcgtttggctcacctctagcggaaaggacaacaagggccggtgcagcatccatgacatcaccaccgtcaacctgtccgacgacgacgaccgcaacggcccctcggaatcgccgccgtcggtgctcaccacagcctcggaccagtttggtgtcctctctatcgacgccaagccctcacgctcactcagcgggcaacgacatgcgttcatgtattgtcgtcggcgctgcagatcaccatcgtcacatccacggggacgactgcacctgggacgaggcaagtcgtcgcaggtctgcgtccatggagaaacccattgaggtgttgttcactgtatatgcagt

SEQ ID NO: 76494 - DNA, 360 bp, Triticum aestivum
  Clone ID: PAT_TA_76494
actcatttcatttgtctccttcagttgcttaagtaaatcaacagcggcatcagggtgattgtgctgaacacagtattgaagcactctgccgcacccatcawaccacatgcctggctcgctcacctcctccagaagttgatacagtctatctagctggtcttctgtttgagtatgctcaatcagggctattgcagcctttggttcaaggtagcctccggattgcttgatttcgtcaaacaattcaagtccatctgataccttcccattcgatgcaagcgctcctacaagcgcgcttcttacttcactgaggcacttaggtggtatttccttatccagggcaacctgtttggccatgtcaaa

SEQ ID NO: 76495 - DNA, 435 bp, Triticum aestivum
  unsure (1)..(435): unsure at all n locations
  Clone ID: PAT_TA_76495
cttctggtsgggcggtgccccgtctggcccctccggstcggccgccctgtcwgtgncacctttccgcggggtgcccctttgccctcgctggtscgtgccggcgycccgcccgcttcccctkttctcgcgtggggttccggtctggcggcccctggcccgggggttcgttcctscktgtcgygtkctgyccgcgttscgttgtgcccctstggcccttctsctgcggstctcttstccyyctcttggtkctctcyctctttttgggcggtttgcggcytttttgtcccycgtgttccctccttgggccgccsttycgggycytcttyytcgycggbcgttggcgtawtcgtcgcgtgcttggcgttctctttcttttctcgtttttgccggtcttgctcgctgcttgcttgtcctcggycgcgtyctcgctyttcg

SEQ ID NO: 76496 - DNA, 390 bp, Triticum aestivum
  Clone ID: PAT_TA_76496
acgtgacggggagggcgtcctcgatcagcaaggagtgctgctccggcgtgcaggggctgaacggcatggccccgcagcagctcggaccgcaagatagcgtgcaggtgcctcaagagcctcgccaccagcatcaagtccatcaacatgggcaaggtctccggcgtgcccggcaagtgcggcgtcagtgtgcccttccccatcagcatgtccaccaactgcgacactgtcaactagttcaatatataacccttcctacgtgcatgcatggacgcgcttgtgtggagcttaatgtctatgttgatggagtgctcatacgatactgatgagctactaaaaaaataaaataaagttgcctgcatgtgttatttcagtagtgtgtsctatgtctgt

SEQ ID NO: 76497 - DNA, 315 bp, Triticum aestivum
  unsure (1)..(315): unsure at all n locations
  Clone ID: PAT_TA_76497
atttttagytttbagggagggtayatwttcgcmtttttgggncgctcgtcagaaaaaatcaatgadatcggcgcctamaaaattggggtttgatctatttaaggatkatggggaggataggtgtktgctgawttttggatggttgggttyggtggataaatgtgttygamrtatatmtaatgcttgtatttgcagmtaaataaaatggggathwctcggtgatgcatcctatggatggatggrtbgctggdgtbsgtacgtgcwcgggsggccgcttgaaattgaattttwgcrggcgccatgggggggcgcagg

SEQ ID NO: 76498 - DNA, 166 bp, Triticum aestivum
  Clone ID: PAT_TA_76498
acctcctgctaygaagatgtctatcctggsaacaagttactgacaatttgaatgtgcgcttcttcactcggaagatgaacagaacaagaacgcatccggaaaaaagaaacgcwtctgctactgctgctggcatcagttacaaacctgttctgggcatatccctagt

SEQ ID NO: 76499 - DNA, 316 bp, Triticum aestivum
  Clone ID: PAT_TA_76499
tcgtggtcgagcctctccagcgcctccgcatcgaccggcgcttccagcgcgccccttcgacgtccaacaacccccctcgtcgtcgagcctctccagcgcctccgcatcgascggcgcctcctcgtcctccagatctgactcacttcctcgccctttgtttcctttccagcccagcgcctccaaatcgaccaaaaaagaaggccaaatcaggacagcgtagttctacgaagaccaagttctaggagtgatagtgttgcacatcagccctctccattgacagatgaatgaaacaccccaggcccaagaggatggtggt

SEQ ID NO: 76500 - DNA, 175 bp, Triticum aestivum
  Clone ID: PAT_TA_76500
acatgcatatatatacccggatctgatcatagcagaaatgagacgagggcgttgaatatgttccatgtccttcgtcgcttggtgatctcgctctggagctcgkcgacgagccccccatccagcagattcctcttggtggcctcgcggagggcgccccagcactcgatgcggttgt

SEQ ID NO: 76501 - DNA, 220 bp, Triticum aestivum
  Clone ID: PAT_TA_76501
tatctatgctaagagacccggagactgaatttaccaacatggaaggattcctcaagagcacatcagcacctgaaggctgctgctgccgcagctctacaatttttcttctttccggacgcccggcagcctgagcatgcaagagcagcagcacgagcaggccgkgctgtgccgsgdccagccagaccctccccrttccrcsggrsttvtccggcctctctyg

SEQ ID NO: 76502 - DNA, 414 bp, Triticum aestivum
  Clone ID: PAT_TA_76502
gagcattytwccactagaccgaccgcacaggtgaagtgagagctttgcgctaaagggttcatcagcaagcatgaagagcaccaagctcgcggcgatcctgatchtccaggccgctcgctggstcatgggggagtcctctcacacgtgwaacgccgatctttctttcccccaagttgttgtvaacaacttgcgggtcccttctcccggggygrcggtcttscgacggacgcccacccccaggtgyccccaagggctgtttccgdkctgttscgtgtgtgagggccaggcccttaamaagarsgtttcsggtgcsgccgacatgtaagagacaccggtcgcatgggcacctgcgggcggggcccatgsyaaaaaagcgactgwatccgattcaggggcgttcagatctcagaacga

SEQ ID NO: 76503 - DNA, 244 bp, Triticum aestivum
  Clone ID: PAT_TA_76503
acttctcccgtatgcgtttagcctacgccggcctcctgtcgagcgggtgccccagcttgaatgagctcttcgccaccgatctgccttggttcctgcaagcaccaaccaggtagggagaagcaacagaaaccccccgaaccgcgtcattgacggtgacagtgccgccccgcacccgacctccgccgcaggccatccgaccctgccctgcaagcttccaagaggtgaacactatcagacctggtgg

SEQ ID NO: 76504 - DNA, 201 bp, Triticum aestivum
  Clone ID: PAT_TA_76504
acgacggccagagccgttggttcggtgtggtggcgcggcggccctcagcccggcggaagcgcttccaggcgacagctcgcgtcgtgcacggccacgacgacaaatctctcggtctctaactgtcacttcgattcctacaggaatacaggggataaacgagagaatgaagaacagggttggcggccctcgtctcgcatccgc

SEQ ID NO: 76505 - DNA, 247 bp, Triticum aestivum
  Clone ID: PAT_TA_76505
gcttccgcatcatacatcaatatccccatgtgaggaaaacaaggtggctaccttagaatcctcagcctacacacgttccttgtctagcatctggaattgcataaaaaaatcataatattaccataaaataggagactaacttcttgcrahcrrcatraaataccaacgacacaaggattggcaaacacatcacgctyctgcattagctcaaatagcatcttgaaataaatgcatgagggcaccttgc

SEQ ID NO: 76506 - DNA, 681 bp, Triticum aestivum
  Clone ID: PAT_TA_76506
tgaagatagttcaccgtgaccttaaagcgagcacatatactactagatgtcgactacamatcctaaaatttccgacttcggcttagcgaagatattcggaggtgatcaaatcmgaagatgtgactcgtcgtatcgccggcacatacggatacatggcgccggaatacgccatgcgcgggcagtattccagcaagtcggacgtgttcagcttcggcgtcttggtcctggagatcgtcacagggagaagaaacagtggctcatataacactgagcaagacgtggatctcctgaatcttgtatgggagcactggacccggggaaacgtcgtcgagttgatggatccatccctgagcaaccatcctcccgtcgaccaggtgctcaagtgcatccacgtcgggctcctgtgcgtgcagaggaaaccggcgagcaggccgacgatgtcgtcggtgaatatcatgttcagcagccacaccgtccgtctcccttctctgtccaggccggcattctgcatccaggaggtcagtgtcagtggaacctcgactgcctattcggaagcatatccgctcacagaaaattcaactgtgatgtcttcgaaccaagtgtccatcacggagctttcgccaagatgagtctagcttgaagcagttaactgaaccagctgtgtatagtgcttcttaccgt

SEQ ID NO: 76507 - DNA, 676 bp, Triticum aestivum
  Clone ID: PAT_TA_76507
ggaagtggcgccgcccaccagggtttccgtcctcctccgtctctccgcgccgccgccacccgctcctgcgcctgagcgcaccatgtcgtccattgcttcyscmkcgcctccaggtccagcttcgccaggtgcggccacgctctccccgccgccatctctcagacccagcacgccgcgtctccgctgctctcggggttcggatcagcggctcgcgctttcagctcaaggcctctatggaagggagcgttcgtcgacgcgttcctgcagagaataaagaatagcggggggagcctgaacggcaggaagatctggtctcgccggtcttcgatcctgccggagttcgtcggctcctccgcgctcatctacaacggcaagacccacgtccgctgcagggtcaccgaaggaaggtcggccataagttcggggagtttgcttttacgcggaaacggaggccccatcgcgcgattacggcgaagaaggccggtggtcaaggaaaggggaggaagtaggaagcgtgaaaggtgggtttaaggatggtgggatgagggcgtggttgaagcacaagcacttgaatcaccttaattttctggtctgcattttcttagaagaataattatagcagatcttactttggactctgtttactctgctagtggttccagcataactttcgagt

SEQ ID NO: 76508 - DNA, 388 bp, Triticum aestivum
  Clone ID: PAT_TA_76508
accagaagagcacggagctgctcatccgcaagctccccttccagcgcctcgtccgggagatcgcccaggacttcaagaccgacctccgcttccagtcctcggcgkctccgccctgcaggaggccgccgaggcctacctcgtgggcctcttcgaggacaccaacctctgcgccatccacgccaagcgcgtcaccatcatgcccaaggacatccagctcgcccgccgcatccgtggcgagagggcctaggctgctgctgcaatccatatccatgcgtcgtgtcagatagatctctgttaggctgtgtttcagaatgtgcgtcgtgttagatccatgttagaaccctgttcctctcgtggtgggtggatgtgttatgcctaatctggtggt

SEQ ID NO: 76509 - DNA, 658 bp, Triticum aestivum
  Clone ID: PAT_TA_76509
cccggactgacgctgttttcascagactycccatggtgttwtttwtgtgcmgammcaaaagttytcggaatgacctgaaactccmcggaacatytwtttggaaaataagaaaaatactggaagaaaaatccacgtcagggggcccacaccctgtccacgagggtggggggcgcgcctgccscccctgggcgcsccccctacctcgtgggccccctggatctccmccgmcctcaacyccaactccatatattcactttcggggagaaaaaaatcagggagaaggatttatcgcgttttacgatacggagccsccsccaasccctaaaacctctcgggagggctgatytggagtccgttcggggctccggagagggggattcatcgccgtcgtcatcyatmaaccatcctccatcacaaatttwatgataytcaccgccgtgtgtgagtaattccatygtaggtttgttggacggtgatggattggatgagatytatcatgtaatggagttagttttgttagggtttgatccytagtatccahtatgttttgagattgatgttgttatgattttgttatgtttaatgtttgtwattagggccsgagtgttattggattatgtttaatgtttttcatgaatatatgtgagttcttgccccm

SEQ ID NO: 76510 - DNA, 470 bp, Triticum aestivum
  Clone ID: PAT_TA_76510
acaccgccggtctgctcaccacaacggtcgsgtggatgcgaggacgatgaggccaaaggggccaagcccaccgcgggaggcagcaccaccgctgctgctgcagttgtagccgatgtcggcstcattgagggcagtgatagcagaagcgtcgaggcggaaggaggcctcgatgtcgagttgatcagcttggcggagagggacatggaagacagagccagtttcgatggtgatgtcgcttagttcggtggcattgaggcgaagggtctcgatctcctccacaggccataagaggaggtttgtcctggttttctcatccagagccaccgtccttggaactgactggattgaggcccatcctttggcgacgtcggcctgcgsggagtcgacctcaccgacataacccatcataatgcgccgccgcttcaccggatcatagaatgagctggatgcataaagcttgccccagtcgt

SEQ ID NO: 76511 - DNA, 257 bp, Triticum aestivum
  Clone ID: PAT_TA_76511
actttyagcttccagggcggctccatcgkcgccttcttgggccgctcctcagacaaactcaatgccatcggcgcctacaaacttggggtttgatccakctaaccatcatggccagcatacgtgtctgctgacttccgtatggttggcttcggtggatacatgtgttcgacctatatctactgcttgtatttgcagctaaataaaatggggatccctcgctgatgcatcctacggatggatggatccctgccgtccgt

SEQ ID NO: 76512 - DNA, 429 bp, Triticum aestivum
  Clone ID: PAT_TA_76512
acgcagatgatgaactagcttaggacaatcagccgatgtgtgtggttgacgacgatgagtagccatgtagctggctagctagcggaggaggctgcggatgatctcggcggsggggctgttgttgtccatggtggacatgaggtcggagaggcggtcgctgaggtcgttcccacttccctgtgcaggctcttgatgtagctgcatgtctccttgagcattttcgtcgtcgacgcctggctgctgctgctgcscgcggcggcgcgtcgtggggagcagggtctggggsctggagatgagctcgttgatctcctcctccgacacggagccgcgcgacctcctgccagacatcgtcttcacagaataatgctgggcgagcgaaggtcgattgagaacctgtgtkatcgggggkggggggggsggstagctgcg

SEQ ID NO: 76513 - DNA, 250 bp, Triticum aestivum
  Clone ID: PAT_TA_76513
acgactacagagsagacgcagccacgcaggaaacagcagggtcagcccggcgagctcacggcgctrcagccgcccgaagccgtagagggtgcggccctggcgcttgagggcgtagagcgacgtccatggcggtgacaggtcttgcggcgggcgtgcttkgtgtaggtgacggcgtcgcggatgacgttctcgaggaagatcttgaggacgccgcggtctcctcgtagatgagccccgagatgcgcttcac

SEQ ID NO: 76514 - DNA, 515 bp, Triticum aestivum
  unsure (1)..(515): unsure at all n locations
  Clone ID: PAT_TA_76514
actttcagcttccagggcggctccatcctcgccttcttgggccgctcctcaagmacaaactcamatgccatcggcgcctacaaacttgggggtttgatccatctaaccatcatggccagcatacgtgtctgctgacttccgtatggttggcttcggtggatacatgtgttcgacctatatctactgcttstatttgcagctaaataaaatggrggatccctwcgctcgcatgcatcctatggatggatggatccctgcccgtccgtacctgcccggggcggccgctccgaaatcngaaattcccstcggccgccataggcggcsgcgavgcattgcgamgntcggsgcccaatwtcgcccctattagtggartcratatatacaatttcactggmccgtccgtttatacaactgtcgtgcactggggaaaaaccctrggcgtttacccraacttaaatcgcctktgcaagcacatcccccctattcgccagctgggcgtaaatagcgaaagaggc

SEQ ID NO: 76515 - DNA, 513 bp, Triticum aestivum
  Clone ID: PAT_TA_76515
actgtgcgcacgagsggrggcctttcctccagttccgctcatcgtttagsttctckactkctttctcascttgctgtgaggtctcatattcgactaaagcatgyttyttgttactcwcaagtgtgtctgacttggawagccctggctgagctaggctcttgggggtggcatatcttgatgttcttcacacttccaacgacactkaagaccttctcgaggctktttcttgatragtcctctggcaaattctccgctatgatcatccgagactgaagttcttctttgtgcttctcggtgaagggytgccctgcgcsygaactttcttcccatcatcgctcacaawaagcttcgtggaggtgcggagagccttgaccagcatctkgttgghtgctcccagagacttgatcttcttccatgatgaaatgactgacaagggaacgtagccttcggagtccttgttcatgatcttgagcaagaactcgttggcgaccaggttaatgtcgctgaactggt

SEQ ID NO: 76516 - DNA, 202 bp, Triticum aestivum
  Clone ID: PAT_TA_76516
bcycagtgaagtagttataycatatacyavcaccaaaagggtaaraaccctaacatggaaaacttgagaacagaaacgrattcacctgcttgactgacaaacacaacakccggcctgsctactgskgggcgcactgcacccgctggccgccgccaccgggcatgkcctcgtcctgcgtsgtaggcckcctgktgcccggctg

SEQ ID NO: 76517 - DNA, 199 bp, Triticum aestivum
  Clone ID: PAT_TA_76517
acgagctcttgcaatgctttcatcttttcgttgatccgatcccttcttttccgctctgattggttatggacctgcggcagcacgagtccttcgctttgccgccggccgctggcggccggggtctcattgacggcctcacagtcgtcggcatcctcgcggcggctacccagttcgtccctccccctcttagacagtagcg

SEQ ID NO: 76518 - DNA, 236 bp, Triticum aestivum
  Clone ID: PAT_TA_76518
acacgctgcgttacgacgcgggrgcatggkcccctgrtgtcaaccagatcatcgtgaaggagaagggcatcttcacgaacgtgagcgttcgccgacggccaaggcgactggcggsgtggtgttcaggggcccctggggttcttgatargaraaggccggcggggcacagcagcgacggcaagcagtcggtgctggacaaggtgatctccaactcgrcgagcggacccaggtggcag

SEQ ID NO: 76519 - DNA, 535 bp, Triticum aestivum
  Clone ID: PAT_TA_76519
acgcacagtgtttatttaggtccgtcatgatggtcgttcgacacgccggttgtagtcgagcatctagacgatgccgccgatgaggttctcggcgtcgttgttaatagggaggtcagcaccaatactcacgagctgcaccggcgcggccagcgtcccggtgatgttggccagggacgcgttgcacgcggctaatggggtgaccaccaccactttgcactggttgcgggcgagcagcgatgaggtgaccctacccatgttcatggtgtaggctccggtgcggtccgccgtcacgcttgccatcacgttacgccgcacaccaaccgcacggcggcgtctgtccaaagcagagaagcaaagcaaacataagacggttgtgtatatggcatccgggcaagaggctggcagaggtgcttcctcgggaacggcggtgcgcggccgtgtcgatggagttcccggtgctgcatagcattacgctggagacgatcgccagtggaggctgcttgcccgcctccgggccaggagagcggcgagaagg

SEQ ID NO: 76520 - DNA, 556 bp, Triticum aestivum
  Clone ID: PAT_TA_76520
accaatacttgaatgatgtggatggtcaagtctagcaaaattattgatgggagrtgctcccataggaccttttgaaaaccatccaactgaactgttttgaccatggtaaataatctcattggttgcagatctcccatcagcaactttgaaggatttttgcagatcagcattgctgtatctgggtgtaaaaaaagattggtcgctgacttgttttcctttatcaatcaatggtttctcctcctgtcttagtttggcacttgtatcaaggaaatttgagcttgttccttcgtcagtatgcttctctttggagtattctttattgaaaccaaagttagctgtgcttgatctcactgcagattggcgccaagagttctccaaggtatacgggagacctctggatactgacccgtttgttccacccatatgcatcccagtaattggctcattcaggtcagcgacatggcagcctcccggtttattggtagtcagtaaaccagaggttgagctattatcattgaacctccccaagccttctgcaccattcggggggttttgt

SEQ ID NO: 76521 - DNA, 427 bp, Triticum aestivum
  Clone ID: PAT_TA_76521
acaacaaggcgctccataacgtggtggaggtgagcggcccggatttcaaggcgtgcaagaacaccaagggcggccccgcctggaggtccggtgccgaccaggtccacctcggckgcgcggggaggaggtggttcatctgcaccgtgggcaaccactgccagatgggcttgaagctcaacgtcaccatcctcgccgcggacgcgctttcgcctgcgcgcctgcaccagctccgtggtcgacggtgccatcgtcgtctactcctcacaagtccaggcggccctttgtttccaagtggtgatgacctgccgctgccgggcatgcagcgccctgtatcaactatacttgttcgtgtctgtttttttgctagtcacatcgtgcacggtgtgatcaatatcgcacactgctggatccatgtaatgttccccgt

SEQ ID NO: 76522 - DNA, 321 bp, Triticum aestivum
  Clone ID: PAT_TA_76522
tgggacaaatatragccttcagaaaatttrascttggatttgaaatcctcaagagcttgcatatctaccacatgtagttcccttgcagatgcattgtaattagcttgtcttttgtttgaaccccgagckccccctagstgagatctccctttatcccaccaaggtggataaccaygcaactcaaaacactcatccttggtgtgtccttttctcttgcaatggtcacaaagcaatttkcttttatcaacttaccaargaatttgtagcvsgcgagggtgtatggrtawkgcgcacgagctctgcacgctcctgaccatcctc

SEQ ID NO: 76523 - DNA, 320 bp, Triticum aestivum
  Clone ID: PAT_TA_76523
caacttgtgaggacctgcgttctcgctgttgatccgtgatggcatggcctccccgtgccctagtcgcgttctagctgatggtttgggtccaccagcggagggagagggggacgacctctgtcgctccttctctctagcctcttcatcttgatgaagccgtagagtagaggggcacacgcgtaatggatctgctccaagcacctcaagccacacatcttcaaggtgatcacttcatccacatccaatgtcagtttccgcgtttactccttttttggggtggatggatgcatgatactctgatagtagcaggcagttgtagt

SEQ ID NO: 76524 - DNA, 624 bp, Triticum aestivum
  Clone ID: PAT_TA_76524
acgtttccctcgcctcagtgatgcagaatcattcttgaatagtgtgattgtgaaggaactctcaagcaacaccacggatatcatgccatctggaagcgactatatgtgtgagcttgaagattcatcatcatctgaatatattccttctaatggacttcaatacaggcctgatgaagcggtaagctttgaggagccaacttctgatcacaggacagacgcacctgctgttggctaccacatggaaccagatcagcctgttcttcaatctcccattgctacaaatatcaatagcatctactctggttttcccgagggttactctggcttccctgagggctactctggtttccctgagggttactctggttcagttaaaattgagagagatggaggaccctttccagcaactataactgatcatgctcctgaaaaggcctacatactggacactcggattgatgctgctggtggaaattcggttgctgataaaggaaagggtgctggtaaagagattgatgttagtgacgtaacacgtgatattttggcagggatagagacatatggcggggacgactcttttcatgatatgckgtccaagctcgacaaarccattgatgaactggg

SEQ ID NO: 76525 - DNA, 189 bp, Triticum aestivum
  Clone ID: PAT_TA_76525
acgatkagagaaactctcccataggatcgacctgcagacgagaccgacgaaattcactcagatgaatttcgaagacgagaccgacccgagagacagagatcatcctcctctccaccgaataatgacaataccatggacccccgaccgatgaatggacttcgatcggactaccaccgatgcgacaccctt

SEQ ID NO: 76526 - DNA, 318 bp, Triticum aestivum
  Clone ID: PAT_TA_76526
acgacatccactacagcactcgggttgccgggaacataaaaaatgacatgatcagcggccttgaaggcatacaggatgtcggccgcgatggcaatgagcttaggctgcacaccgggatcatatccaagtcattctcggttgacgttttctcctctagccctaagtgtaactgagtctcgattgcaagatcgacacaagtgtcgccacccgagtccgcctcttcgaccacgtcgcttgacatttccttctttcttcgcggcattgatggtgcacgttgctgcttgatttgcaatcccgtgccatcttactaatttttgt

SEQ ID NO: 76527 - DNA, 200 bp, Triticum aestivum
  Clone ID: PAT_TA_76527
ataattaacatrrtcacarccraaatrccaacagcmtcacactacactcatccactcacaarctaatctagcggcgtactcacttcarttcagtcggcatggcggctccgaggggcgcggcactggtgctggcgatggtgctcgcggcgatgctggtggcgccgccggcacggtgcacgccatatcctgctccacggtgt

SEQ ID NO: 76528 - DNA, 488 bp, Triticum aestivum
  Clone ID: PAT_TA_76528
acaaacagcaagctagatcagagactggatgggcgcacacatgtratgtaacacaatttgttagracataattccatcacgcacacctgaaaccaatcggarkttccaattccgtcagacttgcaagcgcttccaagtttcacttcatgttcaccttcatatgggcgccccttggatgtcgccaaatctctgttggatatcctcaattgtccaattgactccacccaacgacaccaacgactccagcaggtatcttttttgtgttcaaagtttgctctcagtctccgttggatctccaagattgtgcaattagccccttccagcgaccgctccacctactgtaggcattaccatcttatgcacaaaagcaattaattttcatgatttattattgttagataaacgaactaaacattaaccattataagcaatggatcaactatgcttgatcgatgagttttttctaaaatagaagaactttaatatgt

SEQ ID NO: 76529 - DNA, 668 bp, Triticum aestivum
  unsure (1)..(668): unsure at all n locations
  Clone ID: PAT_TA_76529
tcactatagggtcgagcggcgggcgggcaggttctctctccaactyaccctgccgctcyttcttcctcctctctcgatcccctccaacccagccgccgacaccgccgacctcccccaatcccggccgccactccaccacsggtgacccctccctggccgcagatccactcgcggasagctcaccccgcggtcagatctgaccgccctccctccctacctacctcctcgccggaaaccctagccgcccgtccatggcgacccattgcagcactccaagaccctctcctccccacsggtggtatggtaggaggagacggcgaccagcgacggcacgaaagcccggcccatggtgaccctcgcaaagacctcgaccgacgggtgctatgggtgactgattgtagagatgngacagccgccaagggaacggggacagacaccagatgcccaaagggaaagctctgcgcagagggagagccagcctscctttctccctcctatcttctctcgcttcgctccgtkgattkacctccttccaaagctcatttgcttcattgggargactccagggtgtttgggcaggtccatcgtctttctcgttsaaagattttgccaggtvgatccgacggaggtgctcactcgtgggcccgcatcggggagtccgtcgctcc

SEQ ID NO: 76530 - DNA, 623 bp, Triticum aestivum
  Clone ID: PAT_TA_76530
acatcttctctcccgccgcgttggtctcctccctgctgatggcgtagtcgacccggaagttgtccggcgccttcgccttcatcttcccaaactcctctggggrgggsggrgrgctgctggtcggractcccaagaagagccaggctargccattgaacttgtagtcttcatacttctcaaagaacatcttccacaagaatgaccggratggcgcgataccggtccctgtcgcgagcatgatgatagtagcatttgggtctttaggcatgdgcatttctttgcctaccggccctgttatgttgacatcggcaccgggcttcaggtcgcacaggaaattggagcagacgcccttgacgacctccccggcgtcgttggtgtagacgagccgcttgacgcacagcgagacggtcttggcgtcgccgaagtcgccgagggcgctgctggcgatggagtagaggcgggcttgtggggcttgccgttcttgtcctggccgtcggcgacgacgccgatggactggccctccttgtagggcmcctcgccgtcggtggggaagaccatgtgccmcgtctccccgggcgcgtcgtccgcggtgatcttrgtgttgagcaggcacttgcccacgt

SEQ ID NO: 76531 - DNA, 162 bp, Triticum aestivum
  unsure (1)..(162): unsure at all n locations
  Clone ID: PAT_TA_76531
atgattaggcgtggctcgcgggccgaggrtacttatgggwgacgggtgccccgntawtggcscgaatacggnactcggaagccctgtcagatgacaaatttaagacgagggtgacaaatttgccactcgcctgggtgccgatagaacaggtgagtcagggcg

SEQ ID NO: 76532 - DNA, 216 bp, Triticum aestivum
  Clone ID: PAT_TA_76532
acccaccatcacgtcccgggagatccagacctccgtccgcctcgtcctccccggcgagctcgccaagcacgccgtctccgrgggcaccaaggccgtcaccaagttcacctcctcttaggctctttgtcaaatctcttctggcgtgtgatggatcgatgttgacctgtagttagatcatgttccggstgtcatcttgtaagaaaacgtgctctcggt

SEQ ID NO: 76533 - DNA, 468 bp, Triticum aestivum
  Clone ID: PAT_TA_76533
acaggtcagattgtcgtatttgcagttcattcccctgttcagcaaagagctcctccaacacataatttatttggcgatcttctgcgaccattgccaatgccatgctcacgagttcatttgaaagaacatagtcacttatttttgacatgtataacaaatttttagtcctaggrtccaatatctcactgattataacagatttatcagatgcttgttgcatctctcccatccaagaaccttctgataagcttcttcggaaaccatctgaaccaatcgcttccttgtatggaagccgttttgcctgaatatctctgatcaacagtaacgttgcaagagacctcgaatcagcttggattgctgaatcttctacagattcatctgccaaaatcaatatagaatcaaacgactctaaagggaggctctccaagtgacggcgaataacagcatttccttctcgatgaaccaatg

SEQ ID NO: 76534 - DNA, 306 bp, Triticum aestivum
  Clone ID: PAT_TA_76534
acatgtgttgcatatttcatgggcaccacagaatgagggtcgaacaaacaaactactcaccctgacaccccgtccgcccgggaccgggacgagatggratcatgagatttgatctcatctcatttcctatccatgtatactcgcaaaccactgccggtaggatcgcactgattactgccaatttgctccttcacccaaaactttgtcaatactcccaccctggccataactaaataactaacaaacgaggtgcaaaacagaggatggattattgaatcaacttgctaatgtagttcttttttcagt

SEQ ID NO: 76535 - DNA, 306 bp, Triticum aestivum
  Clone ID: PAT_TA_76535
accatcatgctcttgtcacttcctcggttagcttggggatctatttctccctcctctttgtattcttgcagtgcatttgctgaggccattgcaatctcttctgatgctttaaccgcgagtatctcccttgaaactgcttcttgcttcaactggacaatgttgacatctgccttagctcggtctgcctcttcactagcccttgtaacctcatcgcaggccaaccgagccttcgcctttgctagttgtgtttcttgagtagccttctgtagctctataggcattttagccgcttctgttctctgctgt

SEQ ID NO: 76536 - DNA, 425 bp, Triticum aestivum
  Clone ID: PAT_TA_76536
acatgccaagtcagcgacacatttcaggaattgggtgctgccgtagccgtccgcgatattgtggcatatgtgaagaccaatcacaaatcccccgcatctgagtcgggttacctgcatgaagaacaagggaactccgatgacaaccctagcgtcgcccacgtcgcacagcagttgttccacgaacgtgcatgctggcagcggcggctcgccgagctcatccaaggacacatccgcctccgcctccacgaacaccacgccttccccggtgcactccacgactagcctgcccccgggagcctcccggagacgacctgcaagcgggtagtagtgcaccagcgcctccgccagggcagccctgaaaactgccttggtaggccgcccgtggccatctacgatacggaagaactcgacggcgggctgcaggt

SEQ ID NO: 76537 - DNA, 544 bp, Triticum aestivum
  Clone ID: PAT_TA_76537
atgaaggaggtggtggagcaggaggccatcctcaactccatccactcagaggcggaggtggaggccaaccgccgcttcttccgcaagacggccatcgagggtgacgaggccttgtggttcgaggcggtcaatgaggaagctccaccgtttcgccctccccccaatgaccacgtggccggcagctccggcacgaacttcgccaacatatcctttttttttgcaggagaaacttcgccaacatatccaactactagtaatgtagatggtagtttgatagtagtttctagatagatcgtggctgttgcatgtgtttgtatggaaataaaaaccaagaggtgtggttgtgaagtgtggaatatatggggtgaccagtaaacccggcgaacgcgtccgattttcctacgtctggttgtagatgttctcagcccgaggctgttgctccacggccagtttgtgtgggagtccctacgtgactaggaccctgtcccaccaacaaagattttttttcaggccccgcaaaaaaaaaagattttttcagggacgt

SEQ ID NO: 76538 - DNA, 605 bp, Triticum aestivum
  Clone ID: PAT_TA_76538
gccacayaatyygcayttgagatgaaaccayccaycytgaatatttcatcyacagcattcycatcygaaaccygtatttccatcagatcacgaacaaccgaagccccgtagacattcctaatagcatctagccttgaagatgtgctcccactgtgaacatctgctctattggctccatgctttctgtaagagaagttcacattgatgtgatggaccgcaaaccgactgatgaagtccactatttttggatagtcatcattggagttctccagtgttttcctacgagctaccatattgtagaataaattttcaaccatgacttgagttcctttaaccgcagcacagggcttcgggtcattctccataactccatccctataagaaactctgtagccatgcagttggccttctgttattgttgtcaccgtaacatggccaacataagacatactggccaatgcctcccctctgaaccccatggattttattgtctgtagatcctcatatgcagacaactttgaggtagtatgtctctcacacaatattggsaagtcycacaccggatgcggggccgtcgtcggagactggatgagcttgaggcgscg

SEQ ID NO: 76539 - DNA, 344 bp, Triticum aestivum
  unsure (1)..(344): unsure at all n locations
  Clone ID: PAT_TA_76539
atcaacctacagacaaccacaaattcactaataatttcaaasaaccacccggacagatacracracactcaataaaataaaaaaraarasaaccaagaaactgaagacaaactganacaaggaccgccmccasaggaagacaaaactcatgaagasactcaccaacctcaagggacaaaagaagaagaccgtcaagasactgaacacacaaatcatatcactcaacaacaaaatcatcaaaaagatactcccatccmcataaaaacattaataaatcacacgaacgcacacaaccggsacaaccccccstttcataataaaaattactaattcttaatatgtaa

SEQ ID NO: 76540 - DNA, 160 bp, Triticum aestivum
  Clone ID: PAT_TA_76540
tgcattcycaccggttccgcagctcggtagagaaaggaaaggagagagcccttggattgcattggcttctgctgaatatacccagcaccagtatgtaaataacctgtgatccgtgtgcaaccagtggcattcgttatataaagaagtccaacagtagctc

SEQ ID NO: 76541 - DNA, 518 bp, Triticum aestivum
  Clone ID: PAT_TA_76541
cgcacatctgaaaaaattgctgatgaggggttattttcttctkcsccatttkacaggccaakcaatgggcttcggaatatggaacaaccaaaaaaatacccaaatatgtcaacactcgtgttacagaggtgttcccagttaaaaaatccagaaacattggagaggaaaactataaggrtgatttaccgaataatgagaagtttcccaaatttgctgatactgtaactactccactatcgctaccagctcgcctgactcctctacccagcaagagaagatgaaggagaaattgtgcagcctccatccctgtccaacgtgttgtgcgttgcaggaggagcgagcggacgccggagactggcaacaagccgaggttggagcggtgatggtggctgcagcgggaaaaaccgcgccggcaacaagcacaattcctcatctctgtctccaacgaaaaggatcatctgggccctatgctactattgcttgagtgagagtagtgccagtgcttcacaagtgagagc

SEQ ID NO: 76542 - DNA, 432 bp, Triticum aestivum
  Clone ID: PAT_TA_76542
agtacttattgaaacaacstctggtggaatgccatccttctccatttcatgcagtaagctaatagcctccttgaacattccagcagatccataagcatcaattagtgcattataactgactttgtttggcttgcatgagttcttcctcatctcgttaaaaacctccctagctttttcaggstgtgctgacctaccatavggcattcagtaaartgggtataaggaaactacatcagggtcgcagacaattttgtttcagtaacttgaaaattcccaaggcctcagtgtgatcccatgtgaggcataagcacccaaaagtgcattatatgatacaatattagggtttaactccttcagcaaccatcatatcaaagactgccttgcaatttttcacttgcccacaaacataataagaatgcattatgctagtgt

SEQ ID NO: 76543 - DNA, 317 bp, Triticum aestivum
  Clone ID: PAT_TA_76543
acgcgtatcggacaccgggacggcgcacggagcccgtctgttgcagttgcagtggcctcctcccatttcctcttcttcgcggacaacggcggcgtgtcgctgagcgcctcgcttttcacctgctgccgtccctgctgcsggsgccgccgtcttcttcacttcggsaccagtagaaccgggagaaggctgaggtgcgccsgcgavgttsgcggacaaggccgcagcaaratttgtctcgccgaggtaagcccggawawcaamcgcggcgccgcgtgcgcctarcagcttttccgcccgctgcctctgcttgctcgtca

SEQ ID NO: 76544 - DNA, 447 bp, Triticum aestivum
  unsure (1)..(447): unsure at all n locations
  Clone ID: PAT_TA_76544
agaccgcgcaattcactartgtattarcgmtgggtcgacgggccgcagggtactgggacattaacatttgaghgccccccttgccatgggtgctagctctagggaaangttgcgaccttgcagcgacgaacttgcaccaacagcctcatcaacaagctcccatgaaatgtcatcgggacaccctcgagcaccttggggtggaggtattgttgggtcaacccactcattgccccaatcaaaatcctcaatgactagagggtcatagctattgccasccatcttctcacgcctcttttgaaacctatccaagttcttccggttgtatgaaacaaaaacattgtcattcaagagtcggtgttgtaaccggttccttttcttggtatggatatgttcaaatgcgctccaattcctctcacagccggatgatgaagcacaaagactaacagt

SEQ ID NO: 76545 - DNA, 168 bp, Triticum aestivum
  Clone ID: PAT_TA_76545
gtcgcgggccgagggtactttgtscgcttgytcgctcacggagacacgctcgtagagacagtattccggtgccagaggkcaacccagascaacgagrtcccctggstcccgatggtgatgascgarttgscakgatgstgaaagtggccaargacatcgtcagggggg

SEQ ID NO: 76546 - DNA, 666 bp, Triticum aestivum
  unsure (1)..(666): unsure at all n locations
  Clone ID: PAT_TA_76546
gaaarantctctcccatgccaccgatgtcaacacctctcagcgcccggctcgaaacctcccctgcatcggacggccatctgactgctttggctgcccctgacatgctcaacgaggtggccacgtcaagcaacacgagcacacccatcttcgtttcgctccagccacccctcctgacggccccaagctccacccccccacaacctccagtagccagacgcaagacccttgctggtgtggtcgacttcgctcttggaaggcgcaccacgcctcaaagcaaagaaacacaccatgcccattgcgcagatggcggasgccttctctgtcagaggttgggcattgttggtgaaggtgagatgatcactgaagatgcgatcagcaagtatgttgccctgttcaatggccagctgcctgatctcgcggttgctgctctgcgagctctcttccagatggrttgtgatcttgatggtgcagtggaagatgccctcatccagcatggtggagacacgggtcccggcatgaggactcaagccagcgacgacgccacagtggcgtaatgttgctgcgggctgaagatgaagatgtagcttagtcctgatgattagtccttccttcatgtatcgccttgtttggttatgtgttctgcctgtttccctagaccgctgggt

SEQ ID NO: 76547 - DNA, 288 bp, Triticum aestivum
  Clone ID: PAT_TA_76547
acaagaacaccagccycaccgycygggatgycgggggtcaggacaagahcaggccacygtggaggcacyacyyccagaacasacaggggcccaycyytgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggt

SEQ ID NO: 76548 - DNA, 396 bp, Triticum aestivum
  Clone ID: PAT_TA_76548
tcaagctgcgcgaccgcctcaacaagatctacgccaagcacacgggccagrrcatcgrcrrgrtcgggcrgtgcrtggggcgtggccttttsgtgggccccgggggggcgcgcgggtgggggcttgtgggcggggtcgtcgggggccgcccggcctccctcgtgcctgggggcctcggtgccgttggcccgcctcgccgcggtgggggcgccggcgccggcgccgtggcgggggcgrgggtgtggggggccctccgctgtgtggggggtggccgcgggrgtggggctttttcctgggtcccgtggctgkkttgtttkttgttgggtctgggttttkgtggttcctggtgcggcgrgtcggcttggtgtcttctccctgttgtttcggttgcctggg

SEQ ID NO: 76549 - DNA, 186 bp, Triticum aestivum
  Clone ID: PAT_TA_76549
ccgcccraacagagcaagccaacccaccaagcacacacaggcaacaacaggccacagagcaacagtttcgcggcaacacccaacgagccaaccsyccaassccccaccaycgccacccagcaattccyccaacccgccgcccccaccgccaaatcgcccgactcacgggaaaagccacgccacagy

SEQ ID NO: 76550 - DNA, 370 bp, Triticum aestivum
  Clone ID: PAT_TA_76550
taattaaccgatgtgaaattggaaagcgyrttaatctggtgaactgatgtggcagtaactgcaataattgagcagttatagctgatgatagtagtgtatcatctgctagttattcaaatgtggaaagcctaccctgatctcaagggaaatgccgagagacttgcctcggtgtagcacgcaaccgctgccttctggtagtaggacagtgacttgagtgtccattatagattattatctgggaaattgtttggcattgctgtgcttatagtagtaataagggctgacatatccatcaaattttcgcgtctgcagtggatcttctgggtcggccccttcatcggcgccgcgctggytgccgtctaccaccagg

SEQ ID NO: 76551 - DNA, 360 bp, Triticum aestivum
  Clone ID: PAT_TA_76551
ggcgttgaccccctcctctactccagctgggggcacctcctgcccgagatccccaccttcggcctcgccagggttctcttgctccagctccgtccggcaagggcgtcgcccgctacctctcttgtcgcgaccaggaccacttcctcatgcctctgatcgcctctccacgaccatctcctccccgacgccctggctgctgctacaagaccaccacggggccatcatggagccccaggtctgaagatgaccacgaccatgcatctctccttgtgccactttggagattgagaacatcaagatcaagactgcccgaaccatgtcgtttcgccggatcgtcaaaaaccttggttgttgccaagt

SEQ ID NO: 76552 - DNA, 396 bp, Triticum aestivum
  Clone ID: PAT_TA_76552
acgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaagtccatcaacatgggcaaggtctccggcgtgcccggcaagtgcggcgtcagtgtgcccttccccatcagcatgtccaccaactgcgacactgtcaactagttcaatatataacccttcctacgtgcatgcatggacgcgcttgtgtggmgcttaatgtctatgttgatggagtgctcatacgatactgatgagctactaaaaaaataaaataaagttgcctgcatgtgttatttcagtagtgtgtctatgtctgtacctgyca

SEQ ID NO: 76553 - DNA, 251 bp, Triticum aestivum
  Clone ID: PAT_TA_76553
actctcatcaataaagattaaaaaaatcaacaaagaataaagattaactattctcattacatctctgtttactatttgcatcgattgagtctctcgttttcgacttcaaacagtgacgagtgaaactcgctggcgcctgctgcttctacgagcgggcggcgctgcgacccaatccaccgtcactcctcagggatgggagcgcagaggaagcacgaggggcttgcccgaacagccacgggcaggcgcatcgt

SEQ ID NO: 76554 - DNA, 226 bp, Triticum aestivum
  Clone ID: PAT_TA_76554
acggtcgtagcgggcgaagcatgtccytsacctwccttcttggcggcctcgycgacatacytctggkartaggccacgagcgccttggcgacggccyggcggadggcgstagatgctggsgaggrycttcctkccgccgcggacgcggagtcctcatgctcgcrtgctccttgaagcgggagcgstccggcgagcatgatggcgctcgaaggccttgaggcggacc

SEQ ID NO: 76555 - DNA, 371 bp, Triticum aestivum
  Clone ID: PAT_TA_76555
acaaaacayattyacatgayatgcaacagggaaatyacayaggtggagtgyatatgtagcatcaacagacacgatagattgtggccttcgagaagatgtgatcacttgataagaatgcacctgattggkgaaccgtcagatccaaccaatcttagaggtaagcagtgcaacgbgtataatccggtctcgacgtattctagcttcagatgttcaactaatatgatatccgcattttttaagaaggccacatgggcagagcgtgcgtgatcaaacgatgcaacagataaatagtccagaccaactagcttgatgtcggtgttgtcaacaagccactgggcaccatccgccgtaaatccaacgtaactcatatc

SEQ ID NO: 76556 - DNA, 488 bp, Triticum aestivum
  Clone ID: PAT_TA_76556
acagcaaaaacaatgcaacagtcagggggagaattcacatcttaaggatcattcaaagcttcctaaaaagaaaagagagaggacgcaaaagcattgagcgagtagcagccaagcaaaagctatatgcctgggagggcgtatctacagactctgcatctgggaaaacgagatccggatggtgctcccctccagcgggctggcgtgcttcgacacgagggcctcagtcgcctcctcctcgctctcaaacaggacgagggcctgcctcttgccattcacctcgaacagcttcgtgccgacgatagagccgtgctcagacagatgggcgaggagtgcgtcctctgagacgtcctgtgcgagggcagagacgtggatcatcttggttggagcgcasagttgcccggtagttcttcaccacgttgctgttgaagcggttcaggcccgagttgatgtagtcgtgcgcgtcaggggcaggggttatggtggggtac

SEQ ID NO: 76557 - DNA, 328 bp, Triticum aestivum
  Clone ID: PAT_TA_76557
acaaccgaytggcacaaaaacrcaggtagaatagttcaatatccrgggacgrgtarractrgggctggctccrtatacacggrggcattcccaaactrgacacggggggcrggggcaccrggrasggcrccrgcgrccrsrggggsgcgcaccrggtccaccrgcasgggggsgggccaccctttccgggcctsgggccatcatccctgggcctggaasrctgggggggctcagggttcctccttttctcasgsgaggggasgsggagaatgkgggcatggtatgtcacgrgacacacagkggtgcacctkggcgtacctsgggsgcc

SEQ ID NO: 76558 - DNA, 614 bp, Triticum aestivum
  Clone ID: PAT_TA_76558
acacattcacatacaaaatttattgtaaacattttgagacaaaaaaacaatttttgggtctttgtttgtccatggkcactggcttatgtggrcttatatcctttctgratatgaacttctcctcacaatctagactagtcgtgccatcgcgttttctctaggttgacatttggaaaatatatgctgatagtgatactggaacatttgtttccttttcaacttccacaagcatgcatgagcatgctttacacaaacacctagcatgaaaggattgcaaagactccagtgatgagcctgacatccattttcttcctctcttttttgcgttgttgatgctgctaaactagagcgtcttctggtcaaagaagacaggcctgcaacattcgcgtctgtcgactgtcgccatggtcagagttaggktggcgccgtcgttgagcaggaggccatccgtgatgtattcatcaaggaggagctacggtgtttggggsgggtggcgcagtagcggtggcccggttgcagcacaggaagggaggtgctcggggggaggttkatggctggtggatccagggggaggctatccccaccccgctgtggaaccagggggagcgatgcac

SEQ ID NO: 76559 - DNA, 539 bp, Triticum aestivum
  Clone ID: PAT_TA_76559
acaatgttgcaaagaacatagatgggtataagargcccactggatggccggtgatgtggttgtgggagcggcasgsctgctggtcaggtcaaatcgaacgtcatcctcggatacacagagcgcatcggccagctggcctaggcaattgattggtggcgcagttgccacaagacgcgacactccctccaacgcgcaccaccatgttgtcccattagctcttgcactcgcctctgcctgatggcctctaactctgtgtcatggtcagccagcacggccggcgatgacgaagacaccacgaactgctccgcctcctcgtcattcttttggcgccgcacgacgatgaaagcacgggctgctggacctcctcgtcgctctctccggcagtggtgccacgcaccgaaagcaggaagacgacgatggcgcccacacgacctgactcgagggagaagcgggtctcgggargggcccttcctccggtggcggcasggaatcttggatgggaggargcggcggcggtggatgaagtatkctcatcatgt

SEQ ID NO: 76560 - DNA, 321 bp, Triticum aestivum
  Clone ID: PAT_TA_76560
caaaaaacaggcaacgacgacagtavccayrgacggacsgacggacggacggrcarrcggrggggcgbccgcggcggccaccccggcgacgargcagccaaaggccgccagyyccygaggagggagbcgycgagggcggggaarggccyggcggcgggcccccygawgacggccggcycgggsaccccvgycgcyggccstggcgaagkccaytgggccagggcaccaccgcgccggcgscggcggcgcsgtggkcggtcaccygcaccgtcaccctgaagktcttgkagaagctcrccarctcgccgtccaccacgstgt

SEQ ID NO: 76561 - DNA, 186 bp, Triticum aestivum
  Clone ID: PAT_TA_76561
actgtagcatggcttttcccataagtcaggcaatttagcagtgagagcagcagattgaagaaattactggatagcaatggtgaggagttgaaagattagctcgttaggtattgccgcaaaactgttgctctgtgacctgttgttgcctgtgtgtgcttagtgagggggcttgctctgtttgagcgt

SEQ ID NO: 76562 - DNA, 300 bp, Triticum aestivum
  Clone ID: PAT_TA_76562
atgattcgacggccgcccgggcagtacgcgcctaaggacawggcaaccaaatamaatttawcttcgaaccccggcttgtgaattttgtttaaacaatcaacttcttggaagaaaaaaatcgamtgctgttggramtccttcttcaagtggtcaawtgaawawctcccawtgartctcaawtcawcawcgaamtccttaaaacaaaataacaatttaataaaaaaattcttcaaaaamcctggcamaaaaaaaawggcgctctcgtcccawctttgtaaggctgcawcgarcttcctgtam

SEQ ID NO: 76563 - DNA, 298 bp, Triticum aestivum
  Clone ID: PAT_TA_76563
acactataaaatactcaaactatacatccaacrcattrrrarctccccatatrrtcgaccyrcarrcrrccrcaaattcactartgattarcrtgrtcrcraccraartcrgcrcctacaaacttggggtttdatccatctaaccatcatggccarcatacgtgtctgctgacttccggatggttggcttcggtggatacatgtgttcgacctatatctactgcttgtatttgcagctaaataaaatggggatccctcgctgatgcatcctatggrtggrtggrtccctgccgtccgt

SEQ ID NO: 76564 - DNA, 386 bp, Triticum aestivum
  Clone ID: PAT_TA_76564
cacsggcaacgagayyygcgctgaagakccaaacaacaagttaaaaacygcaacggtttaacacygacatacygcrycyyacatttcycccacgtaatcagtaacycagcattcgtccatgcttcaggctgacggtaattacgcaaagcyttcaagcgtmtgagagcaggcggggcmggagagaagasgaakgtggtggtggtkgcgggacttcasagggagargccsccggactcstcgtcgtcrtcgagggtgcgaggagtagacaggtgtagarggamcagatgaggccgaacacgcccagcaggactcyaccccagcrggttgwttgctcwcccccasgcwcaamcccgtgcsctccgkcgacatccgctcgtcaccagcga

SEQ ID NO: 76565 - DNA, 249 bp, Triticum aestivum
  Clone ID: PAT_TA_76565
accgagagcacgttttcttacaagatgacagccggaacatgatctaactacaggtcaacatcgatccatcacacgccagaagagatttgacaaagagcctaagaggaggtgaacttggtgacggccttggtgccctcggagacggcgtgcttggcgagctcgccggggaggacgaggcggacggaggtctggatctcccgggacgtgatggtgggcttcttgttgtagcgggcgagcttggccgcctcg

SEQ ID NO: 76566 - DNA, 203 bp, Triticum aestivum
  Clone ID: PAT_TA_76566
acgtcttcctctccgccgccgtccacttccccggccccatcccgacggcgaagaaggcgtackcccgatgtgcatggactccatgctcttctcggggttctcgaagacgacctcgatgaaggtgcggaactcggcggtgatgacgttgggcacgacgtgcatggggccgttcacggcagggggttcgtcgcccatctggttgt

SEQ ID NO: 76567 - DNA, 623 bp, Triticum aestivum
  Clone ID: PAT_TA_76567
acatcccaggtttggggcagcacaagtcggaggccaggtgccccggctgccgcccatgagcgggcctcgtcatgaatgctatctaggagcgtgttaagggatggcgtcgcattgtcgaagagcggctgttcctgtgtttccagaccatccgaggcactagcagcgagacagatttcagggccttgcgaaggatcggcggcgtgtcttccttggcatggttccaccagtccgtaagcgacagttcctgtgttgggatcggggcsggtatgcatagccaggccagggtctcgtgccatgcctgacgggctagggggcattccagcagcagatgtcgcatagtctccggctgctggtcacataggaggcagcggggatgatgttgaagaccgtggcgagcctgcctctctgccgtccagcagcggtcctggttggctaaccagtggaagaacttgactcgcggcggcgcccaacacttccagattagcttccaggagtggcatcccgttgatccatggaaggtggccgtgtamaggactgtgcggaataggtgccgctcaccgtccatctccagatcaacctgtccggkgtggtggagagctcggcgcgctgcatgatctgccara

SEQ ID NO: 76568 - DNA, 398 bp, Triticum aestivum
  Clone ID: PAT_TA_76568
acctctgtttgttgccaactgtgaagaagaacacaagggcaaggaaagctgatacttgagaggtgcaccgaagtatgatgccgctccttgtccgaagcastgcagcctttgtatagacatcacaatacatgatacctagttcaacatcaaccaacttggccaacttggcctgttggacttgatgtgatcgagcatagctctcgtccaagttgttgcgcggaagccttctggtatctggaagagtgtaaatccagcaaataagtgtcgaactattggagctgaatccaaggaaaaactaataatgctagagtagctagcatcctcctctagttctggatgagtcaacctattttcttcttcattactattgtagccactgatgttttgtaagttcccgt

SEQ ID NO: 76569 - DNA, 258 bp, Triticum aestivum
  Clone ID: PAT_TA_76569
actttcagcttccagggcggctccatcctcsccttyttgggccgctcctcaracaaactcaatgccatcggcgcctacaaacttggggtkttgatccatctaaccatcatggccagcatacgtgtctgctgacttccgtatggttggcttcggtggatacatgtgttcgmcctatatctacygcttrtatttgcagctaaataaaatggggatccctcgctgatgcatcctatggrtggrtggayccctgccgtccgc

SEQ ID NO: 76570 - DNA, 242 bp, Triticum aestivum
  Clone ID: PAT_TA_76570
accatcargaaggcacgcycccgcagaagasgggcaccrgaagcaarkccccrggarcaaakgaagcagkgrccascgaggcagagaccgagaaggcacctgagsacaagccargggaggtgrgctcggaggaggtaaaaagagagggaagccacagccgatgcagtcagcgccgagrggkagagsratcccatacccccttgkggtgggaataaatctgtgksakacagtatgtaatctgt

SEQ ID NO: 76571 - DNA, 396 bp, Triticum aestivum
  Clone ID: PAT_TA_76571
accctgacgcctatgtccgcatcatcgggggcgacaacatgcgtcaggtgcagtgcgtcacttcatcgccttcaarccaccgggctgcgargagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacctgcacaggctcagctggcctcaaagaagcttgaactgtgctattgatttctccaagcagggagagaagtgcatcatctgttcgtggcctcttagctttgttaccttccagccccggtcgagtggatggcgtgttaggagtgccttcaccgcc

SEQ ID NO: 76572 - DNA, 320 bp, Triticum aestivum
  Clone ID: PAT_TA_76572
caggtacvcacattctttcttccaacctctggggggattatcawttgktggagsacttctcactcatcaccacagggtctggctggkcttacacrrgggggaaactggkggacttgkctcgggcttcttgkcttcctctctcctcctcckctcctcacacggtcattctcacctctggkccaggkggtcttctcctccttctgsctctatcctctccctcagsccaggracacctggrctatccctccacctggggggttcggcggggggccatactgggggtggggagacgggttgcagtccggggggtcctcgaaaag

SEQ ID NO: 76573 - DNA, 244 bp, Triticum aestivum
  Clone ID: PAT_TA_76573
acccgagagggtcggccgccggcsccccgtctacctcgccgscgtgctggagtatctcgcccgctgaggttctggagttggcggggaacggsgaggmgacaacaagaagacccgcatcgtgccgsgscacattccagctcgccgtccgsaacgacgaggagctctcccgcctkctcggsattggtcasragtcgscagscggggttgtcattsccaacatyccacaacctttcttgctccccaa

SEQ ID NO: 76574 - DNA, 233 bp, Triticum aestivum
  Clone ID: PAT_TA_76574
aaagaacactataaaatactcaaactatacatccaacacagtaaraactcycccatataagcaaccyacaaavrgscacaaattcactaataattcaaacarscacgccagasaaakacacatttarsaaaaaktaaaaacaaaataaacaacaaaacaatttacaaaaatataaatakagscaatakttacttcttctatcgcctttcttatctccatcttctcatcaaata

SEQ ID NO: 76575 - DNA, 301 bp, Triticum aestivum
  Clone ID: PAT_TA_76575
gacgggggcacgctcatcctgctctccctccgaaaccgccttttcttcaccttcaattgctccgcccctaattcaggctggrccaaggtaacccacacctcaaaggacaagtgttacgtccctatccttggccgtggggtgtatgcacaagaaagcaatgctgtttacatggttcgcaaagatgtcatctacgcatacaagctcaagctcgggcatgaagagactagtctgaagctggatccccctgtggagatttgctttccttctgttacaagaaacacggcgcatagcttcctcaccc

SEQ ID NO: 76576 - DNA, 391 bp, Triticum aestivum
  Clone ID: PAT_TA_76576
acttaccaccacgcacaccyggccagactcatggtccyccgtcacgtagttctcccgcggcaggtcccagtccgcgccctccagatggaagatgagcttcggcatgggtgccgtcttcttgccatcccaggagaagcatacgtcgtcctcgtccgcggtcttattgacgggcagtgtcacctgcgcgatgaatgcgctcttcagctgcctgaacacggcatccggaaatgtggtgaggtccgtgccgctgtcgatgatagtcccgccggagccgtcggccttgatcgcgaatgccgactcggggaccggcagccgcgtctcgccgacggtgacccctttgaaactgaggaagtagtaggaggagctgtcggtgttcggagaagggttccgt

SEQ ID NO: 76577 - DNA, 538 bp, Triticum aestivum
  Clone ID: PAT_TA_76577
actaaatgttgtgatgccattcaaatagtattttcaaaaccaagacaccattgtggtcatgatgctgcatagagtaacatgcsctgcatccctcatgggsctatatggscggagaccttggagagcgtgtatcccggcaacgacatccgcagcctgatgactacgacaaagaatttgctccagaagtatagctagtagtatatgtatggtgggaatgtgactactccgccaccctgtccgttgttgaggctgtctcttttgatagtgggtgctggccctagctgcattagtgaaaactaaagtgatttatgaattttattttattctgccaatctatatagtaagctttttcaggtttagatatataggcggtgcccagctggccacacgtctgaacctcgtgcaaactgcagtgcacaaaccagcatgattctcggataggttcctgtcaaacttyttcatcataaaaaaaatctattctatgtgaccaatgctgaatataaggtaatccaggcctccttttgaagtgagttagctt

SEQ ID NO: 76578 - DNA, 620 bp, Triticum aestivum
  Clone ID: PAT_TA_76578
actcgaggctggccatccactcctcggccctcgtctcgtcgacccatagatcgctgcgaacccggccatcgccgtattcctcctctgcgccgaccatcgcggtcctgccgacgtcgacgacggcgagctccttccctttcttgagctccacggagtcggagaaggtccccaggctgtttgcgaactgcatgccgatgctggagacggccatctccatctgcgactgcctctgcttgagttgcgccactcgctcctggactccgcgaggtcgacctccagcttcttcaggcagcccagcaacgtggatgacggcggggaagccgcccgtggsgcgctgaacttggagctggatgcgctactgccacatgagctgccgtcgccgcagcctgcgacgcgcctcacgccaccgaagacctcgacggsctccctgacagactggaacggccgggtgctgtcgatctccccgcgggccgtggtggcggtgatctccatgaatggttcaratggtgtttkatggactgatgggattgcatggcaaraatgtgagagtggggactgaagtagacatatgtgcgttcttggttttgtctttgcttctacttcaaarttcaaacaccaac

SEQ ID NO: 76579 - DNA, 537 bp, Triticum aestivum
  Clone ID: PAT_TA_76579
tgttcttcaatgctcaccaccaargacacccctgccctccgggctgtgcaatgtagaacyttacgakttcwtyctwycgcccacctggaagcagctgcgagtggtcaacatactgtccggcaactactgccagcycwagtgcgcggascatgggtggagtgaaattckaggacgagaggcagggcaaagtgcaggtggtggcctcgccgctcatccgcctgaccaaccggccgaacgccaccatcgaggacatcggcagccccgagaagctgatcgcctccctggggcccttcgtcaccggcaacaccttggaacccgaggagatcatcgagacctctgtcgagaagatcggcgacctaacttactacagctatgtgctggagactccactggcactgacgggktcccacaaatccggccaaggccacggccaaaggggagcacgggcggkgtcttcgtcygcgagcgcaagccaagcagtgcagtcgtcgcaaaratctgaaggctatggtagattcattcmaatatgattgcagc

SEQ ID NO: 76580 - DNA, 308 bp, Triticum aestivum
  Clone ID: PAT_TA_76580
acaatggtaatcactacgacatcatctacccatgcgcaacatcttctgggagttcaagtcatcaggcttcctagatagaacatcctggtgatcagagttcaagtcatcaggcttcccagagagaacatcctggtgatcagagttcaattcaacagacttcctagagagaagatcctgctaatcagagttcaagtcaacagattccaccggattaaagttgagttggcctgctgcctgttgaatgagagtgttgctgagtttagtggtagagtagatgccaccggatagaaggttgggggtaggcgata

SEQ ID NO: 76581 - DNA, 537 bp, Triticum aestivum
  unsure (1)..(537): unsure at all n locations
  Clone ID: PAT_TA_76581
cgtcggggcgttttgtccaggacaaaaatwctcgtgcgtggacgctaacatsggaaataasatgtgssgggcnsggtgatgaggacggcgggctcggtaggaggcgcattacctgttyytctcggcctcccyccccccccmtatcatcatgttgattgatagcgcyatgatcactaatattatgatgcgtattgtgatgcggtttgcttaacatgattaaaattatgatgatcttgattatgatgattgggatgatgattaytatgttgcttaaasggctgattattataattaataataaaatggttyttatggggstggttaatatgcttattaagaataanttttgscatataatggtgggarataacyttggggtggtgattatgcacgmcggggaaaayatgggtgggraattatgtaaggttatytgtggtatggaattccaaagttmyttttgttgttgtttaggatgggaatttttyctttttgaattctccccgggygaatksccattcctttggaatttttagagga

SEQ ID NO: 76582 - DNA, 321 bp, Triticum aestivum
  Clone ID: PAT_TA_76582
cgacgttgmatgytctcctcgcgcyatggyggctgtgggaatttgattttgagyggctgtytgggtaggtahaatgtgtagkgggayagctatggamaacacyagtyhaaattgttttgttatatttataggagtagtattttttttttytggwaatgtywaatwaaagtgatagagtattgagyygagtataagtggtattattttatttgagagttgtagtttaggatagatttgttttttggtgttgaatgtgattagtttaaaatttgtattgaagattttggttgtgattatgttaattattagtgaatttgtggt

SEQ ID NO: 76583 - DNA, 288 bp, Triticum aestivum
  Clone ID: PAT_TA_76583
yccgtcaaatggyccttttattaaacactyccccgggggaaataagatgaagatatacataggaaatcgtataactctaagtgtctagctccttggcgtcgaggtggactggggacgacgctggagcgtggtgacgatggtggtggaccgacgatggtgccggagcatggtgatgmtggtgatggaycggcgacggtgcgggactgtggtgatgatggtggtggatcgatgatggagacggagcttggtgatggtggtggtggctcggtgagtgggccggagcatggt

SEQ ID NO: 76584 - DNA, 236 bp, Triticum aestivum
  Clone ID: PAT_TA_76584
tccgcagacgggygacccggccggcttcacsctcgycgrcacgctcscatgcggctccttcggccayatcttgggcgtcggcawcgkgcycsgcctcaaraacaccggcgtcctaraccaratcaycggcyaaaaccttccttttccstcgakagctgttctgcayccacmycggcgcgcyccaygtagtggatyaatttaagtgctccctttgtgmtttgatgatgtggtgtagt

SEQ ID NO: 76585 - DNA, 214 bp, Triticum aestivum
  Clone ID: PAT_TA_76585
accaaatttcactggaaggacttgaagcatgtcataaactttgttgataatctgacagagatagcacagcgtatgaacgctggattttggrkgggrttaattwtacctwtggtgcacacaatgaacaagaccaattgtgttcacaaaacgctggtaaaaagtyttwttttaatgttgatgctcataaactatatatatyttcaatgataaaacm

SEQ ID NO: 76586 - DNA, 230 bp, Triticum aestivum
  Clone ID: PAT_TA_76586
actgttttttacatgtggaaagatatcacgcttcccaagggccatttgcatcggcctstggtgtcaaaacttctsgaacttttacacgtccctcrtcttagaaccrtggaagggkggatccaacatctcctgaataaatccktgattgatagctccgsaagaattcgrtccaaccagtaatartttttcctgsaatccgktttcatcgggccttttgttcaatttctagg

SEQ ID NO: 76587 - DNA, 241 bp, Triticum aestivum
  Clone ID: PAT_TA_76587
actctaattgtaaagtctggtcctcatttaatttctgtaattgattgcctacttgacgaggctataccaactgtcaaaatttcgaatgcatgctagataaggctttattaagcccttggtgttgattgagcatttctcctctaatgttcaagatgttaattgttatatacctctcattgtagaatggcaagttgtggcagctggagcatgtatcacaaggaagagcaatgaaatccattgt

SEQ ID NO: 76588 - DNA, 253 bp, Triticum aestivum
  Clone ID: PAT_TA_76588
acaaaaagttgactgccgatgcagaatgtcagttctttggggcacggtcgaactcagtatctacagattctgcaaacacatgactaacatgcattacaaaatggaatccaacttggtcccctcttaagatacaaacatcaaataaatttgtagaatgacaatcatagctagctggttccctctcatccaaaagtcaaatcgaacaaaactgggtgcagattgtttggcagtgacggctgaaatcagtagcggt

SEQ ID NO: 76589 - DNA, 180 bp, Triticum aestivum
  Clone ID: PAT_TA_76589
actgtgttatgttagatggaaatcgatttttgtcttcttggctttgcgggggttgggggttwtccccccvgccttctgttgcctctcatcgratrgctttdtttgrrgttccattttgccrgcargtgtwtggtcrgrttytyttgraatgttwtaaargcccggrtcatgtgrtmcccc

SEQ ID NO: 76590 - DNA, 264 bp, Triticum aestivum
  Clone ID: PAT_TA_76590
ycctcgaggtgcggttytacggcggcggcttcagcgrgagtacgccggcatcgactggccagcgtygccgtgamagccccggccgttcgtccgtgctcaccttgaccgcagaaagaagccaatcatytttytcgytttttgacgtycctatggtcsttcagatatgcstttscgtgcgtsccagtagcttcaatctgggkgtctgatgyaaacttaatctgatttgaagttttttaaaaacttaatctgatktttwcatgaagc

SEQ ID NO: 76591 - DNA, 356 bp, Triticum aestivum
  Clone ID: PAT_TA_76591
ccgctggataactgtcatagtttgtcgccatcaaagtcctcgaacttggtctasaccagtagtagaacttactggktctccgtgacctaaagttgaaaacagacaaaaattctcaagtaatgtaatctgtagcaaaacacacgattttaawaatcgaaatgttgtaactagagggctataaccmctacaggrtgccmaaaaagtatcaaactgcacaagtagtgttccatttatctttctrctcatgcctgcccttttgatcttataggaattgaggcttcgccmagggacaagactggtrrctagcgcraaggaaactatgtcgagaggtggcactactagacttgctgttgtgt

SEQ ID NO: 76592 - DNA, 173 bp, Triticum aestivum
  Clone ID: PAT_TA_76592
ttcacccccccttaattaaccrttaattacatatatacatrcarctarttatacatcratcataatatacatatatrtartrtatrtattvccaatatataaataatayttaattcgtggctggcttcttatcacaaactatatactaataaactagccacgttggataattt

SEQ ID NO: 76593 - DNA, 247 bp, Triticum aestivum
  Clone ID: PAT_TA_76593
actaacgtatttggcttctgagcagagttccaagaatgttttggaaggcaacttgaagactttggttccattattttagaatcacgtggacgacaggtgcttgtaaagctgcacacttggtgtaaagaggtgtctgaaaaactgtgagggaggtagttgttcggggcgtcatatataaccatatttcagaatggttaggtggatgctcagtatgctaccaatacattgtagcgacaccagcaattgt

SEQ ID NO: 76594 - DNA, 329 bp, Triticum aestivum
  Clone ID: PAT_TA_76594
tgtgccttcctccrgttgsaagccggccgttcttgtmatcctgggcggggccctcgggargtctggtgtrrgcctgcctgcatctrgtgcccmtctcarcggtcrcggcgcccgtrtcggtcrtagtcccttggrctatcccttggggggcgtgrccttcggcggctcctcggrtcrkggctgcgggrtctccctgrttctttgtcatggccttgtctgctttgkctgtgrtggttgcggtcgtggctgcttctgcggtcstggkccctgtgcctgtggcggctgctgcttcggkctcctctgtggcggtccctcgcttgatgctctct

SEQ ID NO: 76595 - DNA, 619 bp, Triticum aestivum
  Clone ID: PAT_TA_76595
tgggtcgacgcccgcccccccccaaacttgacttgcaagtttccccgcaaaaagctctccacgcctactyttatttataaagagcactattcttytttagttaggtagttctcccccctctatgagaccgtaagaccccggtggaatcgaaggcccgcttactaataggcaagaggggaccctttctcgcccagccctacctacatcagtgaagccggaaccgaggaagacaatgttcaacacacatgagacaaaatgaaggtatgggacggccagttcaccacggaaagggatgctagtcgaccattcaggaagacaggaagaccaataggagtcttatcaatccaaccactctccaccgtagtccatcgtccagtgtctgatgagtagattgtcacttctgtgaaatcccaagtgtgtgtgaataccatgaaacgggaggggacggctggatcgaaacacaaatattcttcgacttcttcttcgtcttcgtcttgcaattgtataggattaggaggcagctcggcccacttcttggtcgcaggattgcacacgacaagattgtactggtcttgccggrgatacaaatctttaatgtccctgatgaaaatactgattc

SEQ ID NO: 76596 - DNA, 293 bp, Triticum aestivum
  Clone ID: PAT_TA_76596
accagatcaacacgtaaaatcctctcaatttacttgagagaagtaactttgtttgttaactgtataccctgctcaacatgctaaaactgcatctttacttttactttacctcgtagtttagtctggatacatagtgcagagcacatatatagcatatatagcatagccatggragaactcatcaaaggctcaaaatgtcgcggcgaggtttccatcatctaggggagaatcaaaacagtttcatcacgtctgcccattcttctccgggaagttgagtatctgtggctgcaggt

SEQ ID NO: 76597 - DNA, 168 bp, Triticum aestivum
  Clone ID: PAT_TA_76597
ccttaaaycgatacaccattttttgttccgttcccggkgkgsycgkggtttttytttcyyyyttatatcagtaaatycggccccgtagcaatttggyccttthcyctkttccatgcacgatacggsgactcgactcgrgggrcaataatcgcmytttgcagttggtgc

SEQ ID NO: 76598 - DNA, 315 bp, Triticum aestivum
  Clone ID: PAT_TA_76598
cagcaaatatggtatcgrtgatgcrgaatcgataccgcsccscattttggacgrtggggraggacgcgtgctcgatcgraagctaaaargcgccggkggggcgrrgrtcctccatctggtgtgaaattcgcgtcaaagctgttagaaatttagaaagagtgatttgggccagtcccattggtgatktttatcctgggrcaaacgrggatgatgtkttggtgcggccattktcgcvccatgrtatactactkttgatacttggrcctcagrgcgaaaaactgtgccgtgaatcctgtgatataatttgcttgggtc

SEQ ID NO: 76599 - DNA, 544 bp, Triticum aestivum
  Clone ID: PAT_TA_76599
actgagaccaagtgacttgatctcagactcctttaccctcctcaaaccatatgccaaccacttctttcctaacctaagattcatagcatcccatatctcttgcttctgacaagcaaataaacggaccttctccttcagcttgtgaacagttttcagcgcasactttcttttgttgcggccttaactacggtgccagcaaactgcaacccccaagagtccttttttactggcacaagmcacaatccatcatcaactttcaggtaaagcgatttgcttaagtaatcaacaacttcagactttacagtttctgctatgtctctggaccccacaactgcaacaaaaatctcatccatgtatctgcaagcatataatctcacgtttggctggccctctgtttgatcttcattatttagatccccatccttcatttgacttctaaaccagtgacgcaacttggagccctggttgtctgtaacattttttgcccctgawtaaaggccttcatbtttcatgcaaatcctaaatacttcatggkcaaaactgt

SEQ ID NO: 76600 - DNA, 374 bp, Triticum aestivum
  Clone ID: PAT_TA_76600
ctccgattcttgagcttttccgcagtgattacccctgatagatggagctaagakagatagccacggccgtccaggaatcaggcacaagtagargatcrtggcagcagataaatttgaccaaackgagctgaaggctgraaccacaagcctgcatgatgatacagtaaaataaaaggactgakaacgagagcacggcttcaatcagcaatgcagcggrtgggatcgcttggtcgacagcctcgartggaatctcgatcgatgaggkgaagtcgkcaatcggaatcggatgatggatagggtccctcctcggagatgtagatgtggkcgtcgcagtagtcggtgaggskggggagcttcttggggtcgaggaagcg

SEQ ID NO: 76601 - DNA, 228 bp, Triticum aestivum
  Clone ID: PAT_TA_76601
attcccctcaaaaacttaaatcttcaaattataaccttttcttttatcrttrcryttrtattttcctttarctccttatatcarccactataaartwrcatccctatcttattttctttccttattamtaaatctatttccactataatcctaaccaattaataahtttattaawtmaaaaccrggctatgctagagcccttctcgggcycrgattgtgtytttcccc

SEQ ID NO: 76602 - DNA, 221 bp, Triticum aestivum
  Clone ID: PAT_TA_76602
cagaccgccgtgcgcctcgtccttcccggsgagctcgccaagcatgccgctctccgagggcaccaaggccgycaccaagtttaccccctcttagatygccygccgcccaccgagtctyttgtcagtttggtttyktttkttygtgtgtcaacaatdcgcagggggttarmcccccctayacaaacattgtaaamrtgagyccchytttctaaatcaatgaa

SEQ ID NO: 76603 - DNA, 160 bp, Triticum aestivum
  Clone ID: PAT_TA_76603
gcatgcgttgcatgtgtgarcgctttgctgggcagggctctgttcacgcratcccagcccttatttagggragtcctgcgacggctgcgrtgtctttcttgatggtctctttcttgtcgggrgtggccaaagcgarggcracgctcacggctctgccacg

SEQ ID NO: 76604 - DNA, 407 bp, Triticum aestivum
  Clone ID: PAT_TA_76604
acaaaaaaaaatatactacaaarcaattaaattaaataacaccaaaattttcccaatcacaacattataaaacaacarccaataaattataatacaactcactataarrcaaattaaacccaacatcacatacttccmacmccatarcarccacaaaaattcaattarcrtartcrcarccaaartacattattrtrctctcaaaatrccctcartmatacatcctatttttacaaraaaataataracttctaaaatatrataacaaraatatccctarrtttcttctaaattaaaaaataacaataaaaaaactaatcctcarcaacatacttrttcctacrarcaccaaaarcaattcttraaaatattctggagtaggctttcaagcctgtgagaaagcgaat

SEQ ID NO: 76605 - DNA, 208 bp, Triticum aestivum
  Clone ID: PAT_TA_76605
ttgtggtggtaagggtgaacggcttgagcgctgcatcatcgaacggcctcktgtcgaggaagtgaacgacctgggttgtgrrggktcaagcagggggtgtkgagaggctatgtgggactaatactgccgtgtcagaatcagttctgtagctgctcaccacgcacacctactcaactactctgtgccaccgtcccgctgcgcataagtr

SEQ ID NO: 76606 - DNA, 271 bp, Triticum aestivum
  Clone ID: PAT_TA_76606
gacatcgagagcttgaagaagaagatcgccgggaacagaataaactcaagttckctggaacgtttttkatggctcgttggtgggksggkgtaatgggggaacacctacgtgcttagrgtatgattaccackkttaatattksattggttgttcatggaacgagagctgagaagatggactatrcagaggacgggtsaarkcsatrggskgctccrattgcgrggggsrktkatcataagctggatagccctttggacatcaccactagtas

SEQ ID NO: 76607 - DNA, 440 bp, Triticum aestivum
  Clone ID: PAT_TA_76607
accatgcatgatgcttttctacgctacttcccgtatcattcaagtgtagatcttctctgatattcatgtcttctaagtccttgcgggccttaagtgtgtccttggrcttgccatctatgtttaataaagtcccgaataagctctcacaaatgttcttttcaatgtgcatgacatcaagattgtgtggcaatttcagatccttccaatatggtagctcaaacaagatgctcatctttgtgaaatttttccgggggatgtcctttgaagatgcctttcttttcttatttccagggtgttttccgtatttgaagccctggagatgatctaacttctgcaacaattcaaaaatgtctttcccaaatagttgttttggtggcacgctttctcattcttaccattgaaggccttacttttgcgccacctatggcgaataggcaagt

SEQ ID NO: 76608 - DNA, 262 bp, Triticum aestivum
  Clone ID: PAT_TA_76608
gatcttacatcgagattcgtgtggatatttccttttttttttctctttatgcttgatccacttactaagatgtgcaataagcacatctagatgtgtcctagacacatccttttttttccaaaggatctgcgtttacaacttggtttaaaatgaratgrvctstgtggtataactttctatgaaaaaaaacctttgttttcacctttattgcaacgccagcatgcgggcaaccgttgctttgtttggcagagtctrgactgcc

SEQ ID NO: 76609 - DNA, 488 bp, Triticum aestivum
  Clone ID: PAT_TA_76609
tggatggtgagtccagtccggaatytggggggaatgaaatgatactcataatccggaagaaattktggctmccagaagggggttcmcaggactcgacgtaatcctttggtccgrgtttytttggcgtcgtcagcwtytgcagctcaggggccaagaagcgaaggstsagttgcycccyccaaattcatgattcagtattgctgctccaggrgtrgaattcccagtcctactwtccacgkgaagatagaatgtttytcaggatwtggcaagtattcggaaggctgrgctmaagccctytktccttttgttgtcyccacagatactgtawtcgtaagttawtktttgttttttrgcctggttaggaaataaacytttttyttgttgrgcttcagttaggtgcttcccgkgcrtttgtkgaaktggtttttttaaacagdtttggtgttttttktaagaagattcaactgtrgacatdttttggggraaac

SEQ ID NO: 76610 - DNA, 510 bp, Triticum aestivum
  Clone ID: PAT_TA_76610
acgattktgaggccaaggagatggaggcgaagaagagagcggccgytkttgccmccctgtgyatgctcctccycctcatgctgccaaagccatcccatcagcagctgtccgaagtcaagtgcgagtgctaccggaagtgctmccctgggtgcaacaacagcmcccctccgtggctctgcaagctgatgtgcgcctgtagctgcyccttyttcgacgacatctccgacccccttcgcacctgcttggacgcctgcaacacggactccatytgtgacctgccagcgccgttgaccgatcctgaagtttgtgtagacgaatgctacaatgtgtggggcgcccctggtcccgatcccgacgrggaacattgaagrgctaaaagccmggtcgrgcagctgtgattgctgcatatgatgtcgagcagctgtgwttkgtscwtcaataaataaaatgtkttttgcttccttgtaacgyttgtggrgaaaatttgtgaattttaatwtaaacatggtt

SEQ ID NO: 76611 - DNA, 277 bp, Triticum aestivum
  unsure (1)..(277): unsure at all n locations
  Clone ID: PAT_TA_76611
acatayyattttgttgccaggtttgsgggsttttctatggctcattggtatatwcagattatttatctcgccacaacaaatattatcaacttttctctgtttcnttbttcattgatgcactgtaagctagacgcctatacagttatactaggtcgtgatttagtaatccattgggtcttttgttcttttagatgaaaaccacctctctacgtgcatcttgactatatttccttcttcgctgatgcatgcgatgccatttgatcaggcatttctttgt

SEQ ID NO: 76612 - DNA, 162 bp, Triticum aestivum
  Clone ID: PAT_TA_76612
acttaggtgccatgaccttgttgaaggctccgccttggagtaatcggttcgacgtgcacaactcaactcttcactggtggcgacttcaagtggcgctctctcttccttyctgtagatggcttggaattgtgttgggtggtgtagttgttcccaacattcttg

SEQ ID NO: 76613 - DNA, 236 bp, Triticum aestivum
  Clone ID: PAT_TA_76613
gtcggttgtccgtcaccctgcccggggcgggccgcctcggacawtcgaaatttcccgcsagccggccactggcggcsgggggagccatgcgtacgctcgcggcccccaaattcggcccytamtagatgagatcggtatttacaaaattcacctgggccggtcggtttttacacacggtcggtgdacctggggaaagacccctgggcggtttaccccaaacctttaaatcgcccttt

SEQ ID NO: 76614 - DNA, 243 bp, Triticum aestivum
  Clone ID: PAT_TA_76614
actatgtccgttgatcaagcttgcataatcgaggccagaggtatttctgtatgttctccagcatcggatacagctccaacagatgcaactgaagagactcgggtaggggttgaagtggcacccatcccagcctcacacaaatcctaccaacgtttgtgtccacagggaaagccatatgatggagtgtcaaaagacgcacacactcaacactttttagtccaagacctctaatgcttaagaggt

SEQ ID NO: 76615 - DNA, 229 bp, Triticum aestivum
  Clone ID: PAT_TA_76615
gcgaattgaatagtgatttggggggggggcgcgggaaggtactagaaaatamaggtgatgatgggtggtcatggcgahcaggcaggaaattttaatytagcgatadaaamaaaaaatagatgtaattatggatttygtgmaaatwatgcagtggtggttgtgattcctagctcacttyttgttgtgtggattttttgsttgtaagatmvatatctsggcggaggagtgt

SEQ ID NO: 76616 - DNA, 547 bp, Triticum aestivum
  Clone ID: PAT_TA_76616
acaggttcttcctcaagaatgagctcctcaacgaaggcaggtgtttactcttgtaaaaacacttttttgctaggtttggaaagacaatagcattgctccgagaattcagacgtttgcttggaggcttcttgagagagcagttccaacaggcatgcgggctggtatgtatgccaaacacatctccaaatactgctccatgtgtgaggcggaggaagatgacatccatttatttttctcatgcccatttgctaaagctgcttagttcttagaaccatggtttcttaggtctgattactttgtgcaacattacagatcaattcctaatattattcaagcaatcttaagttcaggacaccactatgcttccatatgcaatctaatgactttttctggtgtatatagaaggcgggaaatgacaaacattttggaagaaaatagggacatccaactcaggtgcatcaagctgctcaagctataatgaaagggtttcaggtagagtccaaagttacaggttttatcggtccacccytctgacagataatcaggt

SEQ ID NO: 76617 - DNA, 277 bp, Triticum aestivum
  Clone ID: PAT_TA_76617
accactttccacaccggcaagattttggccgccaccgtcgtcatcttcaccctcataccctataagttttctccttttcttcaacctataattctcaacttcattatcatcgtcatcatgcgaatcaagcttctcttccaacaatgattctgccatcttgcccttagacctgtcatcatcgcctcttccgtcattcgtaagggtagtgtttcgcttactactatcaagcggattgtgatttgctttctgctccacgcaattggtcatgaaagatgcc

SEQ ID NO: 76618 - DNA, 557 bp, Triticum aestivum
  Clone ID: PAT_TA_76618
acccacagaacaagaacaaagggaagaccaaacctktttccaacaagcctaccaagactactaccttcaagaagaagaagttcaacaaggctgagctagagtgctatgcctgtgggaagcctggacacttttccaaggaatgccctgaacgtgcagaccgcagagggaaaacaagctccaagactgtcaacatggtgaccgctagcaatactgatgggttgcaagggattcttccgtcttaatggggaatgggtcacatgcttctgttcgtggcattggcacggtggatctgaagtttactttgagaaagatcgtgcaactaaggaacgtgcagcatgtccctactatgaacaagaatctagttagcggctcccttctatgtcgagatggttttaaggtagttttagagtccaataaagtaatcgtgtcaagatttggacaatttataggaaaaggctatgrgtgcggrggcttgttccgcttttctctttcagatttttgcaataagtcaataaaccaaatttgtgctrgtgttaatgrtgatgcaagtatttggc

SEQ ID NO: 76619 - DNA, 468 bp, Triticum aestivum
  Clone ID: PAT_TA_76619
actcatagtcatagtatcttttactgaaacattactgcaaccacgacgagtctctgcaagttcagttaagctcaatggagaaccagcagcatctacatcagaaacttttatcgcctcaccatgcaataatgtgcctaccaaacttgaattcgttattctttccaagtcagcagtagattgttcgctttccagcctatgtgaatcaacagaaaaaatcttcaggttttctctcccatcatgcaattggacattagaacttaaagtttcctcatgtgtatgctccagatttagcacctctgaatatgaatcatacctttggtccagttcagtaggttccggtaacgccatattcagatcaatgagaggagcggccatctctctgttaccagcctcaggagaatcctcatgatctgaattcttatctacttctttcgtcttagtgaaagcttccatggcaatatgagaagt

SEQ ID NO: 76620 - DNA, 318 bp, Triticum aestivum
  Clone ID: PAT_TA_76620
acatcagcattatcacttccattaccaacaggaaatccttgtaaagcattgagaaacttcaattttcctatcccttttggaacatgatttatgtctgcaccaataagaaaaaagcatcttaaattgcacaattgggtcatcgccaacggaagactgtgcagagctttacagtgtctcaagctaagaacttggaggttttttagggagccaatggattctggaagacaagatatgccagtataatctaaatcaagtaggcgtagatgtatcagttctcctatataatccggaaagctttgcacaagagagtaattcagt

SEQ ID NO: 76621 - DNA, 467 bp, Triticum aestivum
  Clone ID: PAT_TA_76621
actccctcscgkaaacaaatataagaacgtttagttacctaaagtgagtgatctaaaagctcttatatttctttacagagggagtagtagamaaagmtctctggrctcaagtkaaagagctccacgcaaagagcgcatgccccatattgtcstccagttgaccacctgcccagcctgccatatcagaagcactatgatggkcaccaatatggtagtgatcatcatgaccccaagttcagctatgcctgtaggcttctcattttcagtcaagttcttcacaaaaactgcaggttgccctgractgatagactagttgaactgatctaacagagtagcaaatcagcaaacattgcctcgtatcttgtttcacataaaaggcagccccctggagagatccaagcttgagttaggtttctttcaaaatagtagtagatgtatataggattgaatgcacgtaatacttctgt

SEQ ID NO: 76622 - DNA, 187 bp, Triticum aestivum
  Clone ID: PAT_TA_76622
actcaatctctgacttgctcaggsgcggggrgttgtttgcsaggattatcagcttccccttggagctgcgcagtctttaggacggtcttttagccsadcstatacttkcckctcttcatcaccagctgcagcttgttgttgatgttctccccgctcttcttcsccttcttggtgggagccatcgcgt

SEQ ID NO: 76623 - DNA, 186 bp, Triticum aestivum
  Clone ID: PAT_TA_76623
gccgaggtacagacagagcacaccaatttwcaacgggggcscccawtacaacacacsccaatcaaatcaawttactgcastaataataaatacacacacatcaccttacacaatctaacatyctttttcccaaccaacatacaatgaaataacaaatataatacacctatgttatatacctccccc

SEQ ID NO: 76624 - DNA, 540 bp, Triticum aestivum
  unsure (1)..(540): unsure at all n locations
  Clone ID: PAT_TA_76624
acctttctgcgagagtkgctcgcagccckbggggactttcccgaaarcactttgttttgcattctagaakatagcccgtatctaatagcttkcgcacaacaactcgtgcaagcaccagcggcagtgcaatcaacaagttggcttttgttccaatagactttggytccaycctcctccacgkagrakcttttdraatacgtatwacgcgghaaaagyaamcgaattgcgaaatgaacgactggatattrcttcgtgctaayggccctgatatagcggacaaaaattcgcttttttcttaattcgcttcccaaaaagacatctcgaaaggttcctngtacctccggccgccgacccgsgctaatctgaattcccygcsgcctgccattggcggcgygtgaagcattgcgackgtcggggcccaaattcgccctaatagtgagttcgtattatmaatttcactgggccgtrcgtttttawmaaacgtgcgtkgactwggrgaaaaaaccctcggtcgttaactccaaacttaaatacgtcctt

SEQ ID NO: 76625 - DNA, 283 bp, Triticum aestivum
  Clone ID: PAT_TA_76625
agttaatgcatgggaacaaayttatttgttgtccytttggaacatataattagctacaaagatgaagcgttccctttttccaacttcttgagccccmccacagatctctcacaggtcactaccaagctgaagtggatcttggtcgtcgattttcgcaccagacgatcagtttggacgcatattttactccsagttgcaacctatccagatccyttctaaagggcaacbtggtgcatgtagctcccgttgcgcagggtccaccgcagggtccgaccactytggt

SEQ ID NO: 76626 - DNA, 336 bp, Triticum aestivum
  Clone ID: PAT_TA_76626
acatgtgccaaagggtcaatctcaacagaaatggcacacttccaagatcctgggcaatcctagctactcaagtgctataaccagccctggagaaccagtcccaagccmtcgtcgtcatcagcatctgcttcacaaactcgactctccgcagccgctcctcgaggtcctgcttcgacgcatcatccatcacaacctgattcagcctctgatcatctgaggaaggtgcagcatgatcaacctcctcggccttgctgggctctggatcgatgaccgggggcgcgacggtgcagatgaactgggagagcagagggtcaggggaatgatcatcagctaccg

SEQ ID NO: 76627 - DNA, 232 bp, Triticum aestivum
  unsure (1)..(232): unsure at all n locations
  Clone ID: PAT_TA_76627
attcttggtasttctttacaagcttcgtgttcttgttcatcttcttgagactttcaacatccatgtagtcaagtcccattttctcagcctggtcgabatgctgggsatcaycaacgcatngcacaccctcatcttttgggcygggggatatkggggcacgcttcatctygawgccgctcgaaaacgttttgttcctttttgttgggtgcataagtttttygaagatccgatc

SEQ ID NO: 76628 - DNA, 194 bp, Triticum aestivum
  Clone ID: PAT_TA_76628
ctgcagatgagatacgtgagggacagcatctggcgcggctcaccggcgccgagccaagaggaggaggccgggctgccatgtcggcactcaccggccacaactaccactgaccatgtcatgatactcttttacagcataagtgtagggaaccactagttagccgatcaaccaaatccctcccttgtgattatrat

SEQ ID NO: 76629 - DNA, 548 bp, Triticum aestivum
  Clone ID: PAT_TA_76629
acatatggatatacaaatacgactatggggkgaactactaaagcagaagatcaccagcakwaacctgcatagcaaaattagaggatcaggtttccttcaacaacaaaaagragagaacactagccataatttaactaaagtaaatggtccacccatagcacgagtggaaggttagagaagatagggaaccaaattccaatggaattatagaagccaccctgttgttaaatcggggggaacatattagtggaaataataggattgtcacgttcttcatggagataatccaggtgagcgatgaggtaggcagtaggcgaccatggcaacctccctgggagagagcggccgtagttattggtatatccagccatcatcggcgccagagacgaggtagatgtggtggaacagtgccatccagcctgtggcagtgatcgcgcgtccgaagatgcgggggtagtgagccgaccaaccggagggcagcagctgcgcaccacgacccgtggtgactaggttgatgcaggggcacgagcagggtgttaaggacgtcg

SEQ ID NO: 76630 - DNA, 250 bp, Triticum aestivum
  Clone ID: PAT_TA_76630
acttgtatacgtgtaggattgaacatatattaatggcaaaatgttccagtgtttgcttgaacgttatgactctctgagcatttgcagaattgaacagaacaacacatgcagaattatgaacaaaactgaactggattccacttgttgctcctaacacttaactaaatgcacagaaaactgaacttgaactgaactaaatggcaactattgcctagagtttgaactgaacttataagtaaatggagggagt

SEQ ID NO: 76631 - DNA, 180 bp, Triticum aestivum
  Clone ID: PAT_TA_76631
gcttgtactttcatgactttatgtcactttattcttatgtgctggagtagttcttttactgtggaagagadgtaaagggcaatttggggatgaacattccacaaacgtttttctttttgtgagatatggaaaaaagaggtagataaccaaaaaaaaaaaaaaaaaaaaaaargcttgtac

SEQ ID NO: 76632 - DNA, 225 bp, Triticum aestivum
  Clone ID: PAT_TA_76632
acatttgtttaactaaacgctgctggmccggtgtaactggatgtaaactgtagcatggtgaatwttacaarggttaaaaactrgcggtggcaggatgatgtgctttaagagaacttagagaagtcgagagatgctgcaatgttctgttacycgatkggmatbtacagtgcgtttcttgtrgatacttcgtttgcctygttttgctgcatcaatwtttttcgcact

SEQ ID NO: 76633 - DNA, 548 bp, Triticum aestivum
  Clone ID: PAT_TA_76633
ctcgggcgggggaggcttctcgggtcttcggggggggatcgagggtcgtctctcggggkcgytcttctcgatctctcgggcwgatycggtctcgatcgtctcagggggaggtcggtcamatckggtcaggtcaggtcactcttctcgatcyycyctctctycaagtcgaggtcggtctcggagagggadswtcaaggtcagggtcgtcggggagggagggaggaaagaagtcagtcadagtcgggggggggtcaatcgttcgctctttycgtcagtcgatcaatcaatctctcagggagtctctsggtcgtcatcgatyctctcgtcgtyckcaatcargaggggkcagggaggaakgatctgtckaggctactagagcagtgtcctgtttcttgttgcatggaacgttagccttcatttacttgggtargagsgagkgkcctgtttccagctcttttgtttggttttctttagacttgggactgaacgtcttgttttgttttgggcgtggagtgatcgggcgttgtatatacagtaagtaatctaag

SEQ ID NO: 76634 - DNA, 303 bp, Triticum aestivum
  Clone ID: PAT_TA_76634
mccatacccatttactycctaaatatagagtgtgttaatttaagtcgaacattatatatgtttgacaaagtttatagcaaattatgtaargaactacaatacttaataaataaagtatgaaaatatatttgattaaaaaaaaaaaaaaaaaaaaaaaaagcttgtgacacatcctagttttggaattgaactgtctaaacatacagacacctattatcatgctagcacacagtttttcgccgaacgactccaccggcgaccaccatcctccgtggaacgcattccctcatcgcgagctagcgt

SEQ ID NO: 76635 - DNA, 267 bp, Triticum aestivum
  Clone ID: PAT_TA_76635
aaccgcgagcgggtcgattatttcgcctacttttktctgtctgtcagaaataaagtgtttgctagaaccgacggaatgccaatatagaacatgaaagcgaaaaatttacacgggaaagaaaggtctaaccaatgaaccaatgaaagccagattgcgctbrctgcwctdttctactacaaagaatgaatgatgggggcaaaacgggggtcctgaactctactctgcggcgggatggatgctactccatggacagaaggcggcatgccg

SEQ ID NO: 76636 - DNA, 249 bp, Triticum aestivum
  Clone ID: PAT_TA_76636
actgttcttgtgttgatcctaatccctccttgaccatcttcagttcctcaatagccttttgatgcctttctttggctactgccaactctgtttgagcwactacactggccccattgtcgatcccccgctccacttcttgtgccctgagctgtgcaagttcagaatcctgctttgattgctccagttcaacctctgctctctccagcttgtgcttcagctcctctacaagccttttggtggtctctagct

SEQ ID NO: 76637 - DNA, 393 bp, Triticum aestivum
  Clone ID: PAT_TA_76637
attgcacacaacataaaacaagaaagtcacaamycwaccatwtatattcacttctarcagaaatawgaacttgggtgtattttaattcararatatacaartcatctagttcagtttagtcagggcacgcagtaagaagtagtycccaaaggtaaaggcttcgcattggctgcagctagctatgtaaaacagccggatattggatgtttaaattgaattgttgcacccctaaacttggaattctggttcagttttagctcttaagaaatgccggtggaatattgctcaacaaattaaaatgaatatagcacataaatccgacctgacagcccctcttttcttcttctctcacctcctcagatattaatatattgtattaaatttcatatttag

SEQ ID NO: 76638 - DNA, 433 bp, Triticum aestivum
  Clone ID: PAT_TA_76638
acaacatttcataaacatggcattgggcattgtttgtccagttcccttcaaaaaagaagagatggctatagagagtggatccttctaacataacagagcagaggagtgggadctataaacatgcctcactgaagagatgaaaaatgttgtgcaaggcattggttgttaagctccttttaaaaatgaaggaattatagtgcatttgacttataaaggggttgtgaaggacaaaatgctatggattcagagtagtgggagggcacagtttaccaacggtgcaaggacaaaaagcgtgaccttgattccaaagttccagctcacatagcagaattgtatagagaggatgcctgcattttgaaaactctgttatatagtttgaggctatgtttctttcaattttcattattaaaaggatcctattattgccaaaaaa

SEQ ID NO: 76639 - DNA, 178 bp, Triticum aestivum
  unsure (1)..(178): unsure at all n locations
  Clone ID: PAT_TA_76639
accatggraragggaattaamaaamaacaawcacacggsttgcganscamacgcatgcacaaaaccaaaargcatggcarattttacattgarcacscatgcscaraarcagcccytgagcagcccmaggrcgacgcmcatgcmcgaaccaaarctarttaattcscyacttctggaa

SEQ ID NO: 76640 - DNA, 433 bp, Triticum aestivum
  Clone ID: PAT_TA_76640
tgttacacggctaaaaaccattcggattcgmccaaaataaggattatcacttcaagagctttatccctctytttttcgrgagcgacttctctactakgctttctcaaggatcaaaactcataatgttgtcgcaatacaccagttgcttcacatttttagcaatcatcataggctgctgctcagcaccactcgagctcatytaggytactcttcgacctscccgggcggccgctcgggcaggktttttctactactgtgttggtccatttccagaatcttaaggagtgttyttgtttagacgattaccttggatgatgttttgccctagataatgtctttgttctggamcctttaawamattgtatcttgaattccttcttgaactytttgagaktttgttttgccatgggctttagtcatttcaatggttggc

SEQ ID NO: 76641 - DNA, 267 bp, Triticum aestivum
  Clone ID: PAT_TA_76641
acaaaaatatggattaatttcctttacatttcacagtcacacaggaagaacaaaatcttctacagcmacatagtttccttttgtgtgagctcccttttgtavcagktaatgttcacaggaagaacaaaatcctccacttccctaacaaaaatcacatctgcacctaagacgaacccacaaacaaacggrttccttagcttgaggttcagcagaacccccttgaggttcttctgggcgacctagacggacccctcctccgtcatcacc

SEQ ID NO: 76642 - DNA, 221 bp, Triticum aestivum
  Clone ID: PAT_TA_76642
acacttctttttccactgcaacacaagccagccagtcgctggctggcgctccctccttcccaattcgtgtcctccggcctcccagtatccatttatagttttggtgtattabcttttatggtgttatgcttagcaagtgcattggttgttgtatactgctactaatctaatactccctccgtagtgatctaaacgctctatatttctttacagagggagta

SEQ ID NO: 76643 - DNA, 319 bp, Triticum aestivum
  Clone ID: PAT_TA_76643
acacgactgagccggcgggctgcagaycaagccacacggacagarragtggtgcggaatgrttcggttrcrggcctgctrccgrttcrrgtcatacgcwyycbcbgcccggcartgggcttccgrtrttcrtctttttgggctgctacctttgsrttttttrtgcrtccttctgcycttttttgttgattagcacaccgcccctgctcctgtggactgrcggcgcctcgrrgtggagctggrggrgrggggrccrcgaccggcggctgggtgcrgcgggrtttkgccrctggtggggggkcccggctgctgccgggtcg

SEQ ID NO: 76644 - DNA, 193 bp, Triticum aestivum
  Clone ID: PAT_TA_76644
cgtagttggtgactcgcaatggatgcsacgatcggcgacccattgttggcggcatccgtggagcgggcatttgaraarcagccgctgcctgggttatgggagcaggtgacmcgcgggcagtgatcgtctcggtggttctctcaatcgtcttcgggttcgtgatcctgaaaatccacatgtcgaccggcgtggt

SEQ ID NO: 76645 - DNA, 194 bp, Triticum aestivum
  Clone ID: PAT_TA_76645
acatktygcatgcatgavctagaaaattacttttttgtagccttttctttgttcaaatccttkagkgggccggtggrttaataactctgggcaattttctbtcwtkaaccttctgcttctgacttggatgatctcgttgaaacaaacatccatgtttgggtaaactgatgacgttggtcttgatctaaaaaaaa

SEQ ID NO: 76646 - DNA, 265 bp, Triticum aestivum
  Clone ID: PAT_TA_76646
actttgcytggctaggtgctacggtgacatcgcacacatggatgctatttgccatttgatccctcccttcacaggccactacctagctccatgcaccccaagccgttgcbttttttagtctaaaaaacagatgcttacgccggtgtcaattaggtgttaccgkatgcatgtagcacgtargtatkgtcaktggcgcaratttttcaaaaagtagrttggaccscagtaactcckatggcgktttcackgggaggggcatsttggc

SEQ ID NO: 76647 - DNA, 213 bp, Triticum aestivum
  unsure (1)..(213): unsure at all n locations
  Clone ID: PAT_TA_76647
gacgsttgtamaatrgmcggccagcgaaccgtaatnaygactcatcccaggcgcgacatgggcgytcgcacgtncccatcgcccccccgccccacgscgstggdgcgcaacyvgattgtccccscgcccccccsgccagsttmctaccaktttctacccaagccgcccactggatatgatgagttttcaacttctcaaattaagtagaaccaa

SEQ ID NO: 76648 - DNA, 317 bp, Triticum aestivum
  Clone ID: PAT_TA_76648
atgtcgaattccaccaacaggctgaaggaaatattctcagaagtcgaaaaggagctttcatccagaaaaggtgtgagttaacgccggtgcagaacagtgacaagattgtttgaatctgtcgctcaactaagattaaaagaagacaccaaagatcagcagtcatgatgatcataacatagttcggcgcasagcatcactgcctgcttcgcccctttgctcagcccagatttttgcacagatggccagcatatcaactgacatggatatgttttctcctcacgcgcgcatttgawcaatctgatgttaccttgataggt

SEQ ID NO: 76649 - DNA, 237 bp, Triticum aestivum
  Clone ID: PAT_TA_76649
acaacctattgcatcttactccattctctctgcaatacaaaaaggtgggctgaagtttgaccttggccatcgggaagaagttgtgcggtgtgacattatgagaattggcaagcagactcctctccagctgagcttgtcacgagattgtgcttgctggcatcaagctatggacttgctacaaaaagatataatggtgtgtttggtgcttatacaaggccctagaagatgattatatgt

SEQ ID NO: 76650 - DNA, 203 bp, Triticum aestivum
  Clone ID: PAT_TA_76650
acatgacaggagaaatcatgtgayacytccaaaagccctagaatggaccttaaattggtgcatcttccagagtatgtttgacagtaaattctgcgttcgaaaagattttctagcaagcccagctgcattgaaaaaacgacttgtatttgttggcattgcaatgttgatcctgtcgccctgccttgtaatttgcccattggtgt

SEQ ID NO: 76651 - DNA, 165 bp, Triticum aestivum
  Clone ID: PAT_TA_76651
gtgggacygagaaggctkggcgagccgggtcygchgcggttctgtaaaccgaakcgctgggaggcttcccccygtctcamragtgaccaactggactgaattggtttthagaggttctgtctctagtggatctgcttggsgctaaggggaaggctgtctgagttc

SEQ ID NO: 76652 - DNA, 276 bp, Triticum aestivum
  Clone ID: PAT_TA_76652
ctwwtatctktkwtwwtatcatttrraargcattyarccckaccamccacwcaacastggacgtaggtgrctgaatttgaaggggctgtcattgcactwygtyccatcwtgtygmttactcgatcagacaaakatccagtgccctcacgartaagctttcyaccgtcaaaatctgccaaakgtgaccamtttgcttgcyacygwcctggkctktctcayagttatcyattatccaargcttccgtgttgtgcttccagtgaggtcaaaaaatrctc

SEQ ID NO: 76653 - DNA, 250 bp, Triticum aestivum
  Clone ID: PAT_TA_76653
tttttaagmaaggggatchatamaataaggrkatgatgcagttaaaataccgtttctbcgtcactcggatcatcaratgcaggtgcaagsaaaaagcttcaggsasacataagttamagcaacctcccagcccagttyacaaaaaggaaagcaaaamaaagcstcactcactcagagcccagggcggcygcccctgtcgaggscgtagtcggtyatgccmaygccggcytcgttytggtgcttgatgaaa

SEQ ID NO: 76654 - DNA, 273 bp, Triticum aestivum
  Clone ID: PAT_TA_76654
accttgctgtccccctttacctccaattcaattkttttggacratctgatragaagatgagcttgctatgctataagaacasgtaagaagaaatacscctccactbtttgtttatgattcactcttttktttcagagaagtaaccaactsaraactaagtatctatktaaagtagstcctgaaagtataaaaggattgtgcctagttcacctcctcctatgcaccaagagrcctgcccgsgccgccgctcaaatcactactcaattccccccc

SEQ ID NO: 76655 - DNA, 379 bp, Triticum aestivum
  unsure (1)..(379): unsure at all n locations
  Clone ID: PAT_TA_76655
yacccatcaycctcacaacccaatccccgtagccctctctcyctcctctctcacaacctcacagacagatctcgaacaaatcggagattygctcatcatcggkggactcacctcacagatyactcaactcttyacaaaatccccytcgcayccycycaatctctcctcgatccctcatggaattccattygtcattcaggcacctytttcgacccattcatatccaaagaatccgaaccggtttcggnggtatcgccaagaggggtttccamgaatccyctctcgaagaacgcacccaamatcgctyttattytccactcccacgtttttccatccatcgacccatccaatatccctcgatccatcgcacgtccacaca

SEQ ID NO: 76656 - DNA, 226 bp, Triticum aestivum
  Clone ID: PAT_TA_76656
gcgctgctactgctgtcgcgtggccgtggaaktttkttttttttcgatgaaggagtgcatgacggagtgcgtcaaraaaatggggttcsccsccggcggctgggggagggggtggvaacgcctytccgatagbttagctaccttgtttttycagaaaaatktttaatccacsgrggatggatktttttgaaataagataggagaataaatgaktggtttcytactt

SEQ ID NO: 76657 - DNA, 431 bp, Triticum aestivum
  Clone ID: PAT_TA_76657
acagagcttactgaaaaaggggaaatcaggccacgcccgagatgtgagccctgccatcccaaagttccttgcttgccaccctacatcgtccccatgatcttttcagttcatgccatcccacgatccggtcaatgcaacgggctacactaacaatctaaggtcaagtcacagcttggattatttcactaactaaagaaaatcctaactgacgaaactgrhctttgmaagcwacattwacgcctgacgaaactrattttawwtraaactytgacaacmgcyactaactcacmgtctgacactgtggtcatcgtaratgaggacgtgcatgcrtgtrgcgtgtgcgctgctgctcgcccacgctgtcgtgtgtgtgcatcgtgccgrctatgtgtcgggtcmtccacagggcttcgttctcggtatcgacggtg

SEQ ID NO: 76658 - DNA, 261 bp, Triticum aestivum
  Clone ID: PAT_TA_76658
acaagcggccgcggagaagcaggtgcaactcgctattgccaaagtggacacggccaaaggagacaaggcgaaattagatgcgttcatgttggcctacaagaaggtcggtgagcaagtcctcgccacgccgcccgctcagaagttcttggtcatggagaaaggctttactgaggctgcttctagcctggctccgtaattggcacctcgttcacctctatattcgatttgtttcttatttccattgccatgcatgcacatcgt

SEQ ID NO: 76659 - DNA, 415 bp, Triticum aestivum
  Clone ID: PAT_TA_76659
ttttgtatactgaagcacaaatattggattaatacaatggyccatccatacttacaagtttatttacactagcaatgatgmccaggcactataaattacataggtcattcgaaaaggtatgccmccgacaaaatctaactaaagcatcatacaacaagtctgtttcctatcagagtgactgaagcagggctcactgctcagtagtaggagcagtaacgctttacaaagctctcttggtgatggccaaaacggaatcctcctcggaagggatgcaacacatcagcgtcaagatagcacattttacatmccctctccaccttgctatcttcacatccacatttcctcgtcagaccagcatgtgggacatgaaatcgacggtagcatgtctygcaaacacagtccgatycaccattac

SEQ ID NO: 76660 - DNA, 332 bp, Triticum aestivum
  Clone ID: PAT_TA_76660
gtggaaatcggtgtttkttgacaacattgacttcgccaaagaattggagtaaccatatacaacatggaytttgccaaagcactktaaamatagacyctttascttttcccatcgttktaaacatgrgcscataggcttkgggagaatatttaatctctggagaacamcaaatggaacrggggacaasgggrgccaactccrgttttatrgatgccattccccckggggargttaaattttgwtktgaawtttgagcaaktttgaawtktgrgytcrgargaatggggttygatcagattktaaaaaatgggtktgttttaggatcwtgadtg

SEQ ID NO: 76661 - DNA, 492 bp, Triticum aestivum
  unsure (1)..(492): unsure at all n locations
  Clone ID: PAT_TA_76661
aaagttcgtagggatttgattgatggaggcatcactatttggrgctggattatccatttttgcagcatcagcaatgttgtttttgtttggratggccagttcycaatttctaaatcggctatactatacttcttgtcaggkatgatatatttttcaactatacaagcacttgggtaagtcaggaaaactgaaccaacgacaaacattttactgagcagcagagaaacgtgtttctacgaatgtgccaaaacygatgaaactgacatgatccacaaattaagcaacacatagcatagagcacatgatccacaaattaagncaacacagagcatagagcacatgatccacaaatttaagcaaaccgrgcacatgatccagaaatttaaccaaatcgbagagcacatgacaccacactaataacatctctaacgagtgatgaccagcaagtaagcaaatcskagagcaactacagaaaaataaaagggrtaaaat

SEQ ID NO: 76662 - DNA, 279 bp, Triticum aestivum
  Clone ID: PAT_TA_76662
gttttttytgtttcytgakggakgaacatttaccccaaattggsgtttgtttggggggaaaatttatahatgyatgtataaaaaagaaggaaacaagataaggaaaggttgggtttttgatttawagttytttttcttakgttatctttttggtttatggttgaggttyyttgttgttttggtatttagtmrgggttagttwttrgtcarggtrgatttwtgtttgaattggttggaattaatttgtatykgttttttwtgtgrgttttgkgtttgtgt

SEQ ID NO: 76663 - DNA, 251 bp, Triticum aestivum
  Clone ID: PAT_TA_76663
actcatcctttcttattgttttcacacctgsccctcttccaaatactgscctgkagscatccacctttcctaaagggtggactttkatkgrcmratcaatctgggcaacaatctccacaaattcatactcacaatttttaaagkcttctggagkccatccasscctccagktctttkaaaccggccaarttkcaccggaasarggggttatttcatattcattttttctaccagtttgtctagcaaccaca

SEQ ID NO: 76664 - DNA, 330 bp, Triticum aestivum
  Clone ID: PAT_TA_76664
acaaatgtttccttcttttgaaaaggttctcgtcagcatctgagctttttctggrattgcacaatagcattctccctttactgcaggattccatcactcaacattatggtgggacactgcgtctctagttcgaagttcaggtattgcggaccgcttggtgatagaaggggcagagaaggtgcgtaggggtctctgtgcccttgtttatcagtgacgaccatggagtgtgatgactggctctcctgggtctgtggatatgaactgaaatactgaatcagggtttggaatgcgaacattctccccacactatgtataaaaggggaatcatgt

SEQ ID NO: 76665 - DNA, 249 bp, Triticum aestivum
  Clone ID: PAT_TA_76665
cycrccgccgttgcaaccaaagctgatgcgtccgcscgcgcsaggcsgcstccaaktctkwaggtcatgaggtattgstgtttrasgctcytcgtgarggtttratggaagaaatrcaagcggatccaacsgtgtgtgtctttrgwraaaatrtcggmtcactatgggggttcttatcacacggkgaccacagggtttrgcctgaatatccyttssgasacccttcgktgktcttagacacayccaaat

SEQ ID NO: 76666 - DNA, 182 bp, Triticum aestivum
  Clone ID: PAT_TA_76666
gctgcaattagcacctttttatccatcacctatccacaacatgaacttatatcatctagttgccccaactgggagacttgagtcaagcaaatatcccaaaacattatacaaaattcgacaagaacaagaccaaagacattaaatgtaaaatgactgggttcaacttgtcagcacatacatgt

SEQ ID NO: 76667 - DNA, 317 bp, Triticum aestivum
  Clone ID: PAT_TA_76667
acaagcaccgcctctccggttgttcttgaccttgcaagactttccctcgccacgcgctcttcttcgacacaccaaccctctcttctctactcaccccgtctatccctcttgagcttgatgtaacatgtaggagtagactttagaagtgatgctgccatagatgcctagtaaagagatatcgtatgtttgttgcagatttggtgttgagcactttcttcatccttttttcagctttctttctccggttgctgtttcttagactcagtaggataagttaggcagcttccttttttattttgaagtgcgacacgatctgt

SEQ ID NO: 76668 - DNA, 481 bp, Triticum aestivum
  unsure (1)..(481): unsure at all n locations
  Clone ID: PAT_TA_76668
ascccaggmacgtcaacsccgagaccsccgcmayaccgccygycmygcygycgycaaagcccyygccggacayggamcccgaggammcyacaaavagggaacagtygtygtctggmataacgaatctgcccgtsccttcycaaatggmaaavtyaaaggctcggayagacatgaytgcccatgccygtcaaaktgctgaragagtaatcgntgagtgcmgtaagaatcatggtctaggaacgcgtcagggggaaatmttggtcyaatgttggataaggganaagctggaaagatawaggagcaggaaaatmtacttaragcgggagtaaattatggtgaaggattggrggtatcgggagacsaaagggagatgtattcatctcttcktagnkatctaattgaagtahgtcgggggggaanacgctaatmgaattcacggagrggnaatgggggggggaagyatgsgaagtcgggggcaatt

SEQ ID NO: 76669 - DNA, 315 bp, Triticum aestivum
  Clone ID: PAT_TA_76669
acatcgggttgtcggagcccaaattctcgtcggcttacttccacggacctgcccgggtgcgtgatagcctgcattggtgcctgttttatcgcccaggcgrgaccccactggaggattgtgaggctggatgggaactggtggtatttgacaccatagctgagtcatttcggcagatgsatgctccagttgatcscaccaagtcatgcatccttgagatggatgacatgcttggcatctattgctgtaacaaggctgcggaagttgttgatatatgggtgttgccgaactacgacagtgaggtttgggacttaaagt

SEQ ID NO: 76670 - DNA, 235 bp, Triticum aestivum
  Clone ID: PAT_TA_76670
cacaccamcgcvgcsgcaargaaccamcaagaammacmcacaacmsascvaacmaccggcgmcgccgccaaragaggggggagggggagccacaaaaccsgcacgcgmamcgagggaccgcscgagccagcgmcacccccgcvacmsccagascggccagaagcascggagacggggccacsggmrccsgaacscgccccscccamacacgccccagggaaggagcccccggcaa

SEQ ID NO: 76671 - DNA, 473 bp, Triticum aestivum
  Clone ID: PAT_TA_76671
caccaaaagcaaycaygcaycccccggycaaccacacgaaaagggagccgcayaacccccccacaaccacccyycacagagaagagccccccggggacacccccagagaacccgacgaaacaaccacaaagaggaggcagacacgcgacaccccyaaggccccccagcaagcccacaaaacccyggacgagacaccgcccgaagcggagacggccgagaggggccaccccccggaycccgacgcgacgggcccaccacgggcccayggggyycacgabggaagcccaccacacccgaccccgaagcaaaacgaggcccaggaaaccaagccaccccggggagcagcaacaaccccccagyggcaabgggtyyygahayygccccccacgamcaccccccggaycagtagtgattygagccagcggatgtgcyggtagcaacacaycayyccgccttgggtttgtcagttcggt

SEQ ID NO: 76672 - DNA, 263 bp, Triticum aestivum
  Clone ID: PAT_TA_76672
ccgaccgaaacgttacgaagyttcagtaattacaaggttcatacgtaaaaatataaacaaaacgaagaacaacacaccgawacaaaccgaacgattygagcacttttcgtttytcgagtctcgacgaagwaaaggkaaawttaawatatccaatgcatggcaacatccgtctgtccgytaytcttcytcgrtcgttacatgccacaccatgcggccgccacggtgrcggcckccrtgtggkgbytgccgayttgttygggcgg

SEQ ID NO: 76673 - DNA, 248 bp, Triticum aestivum
  Clone ID: PAT_TA_76673
sacccccccggsccgycgccccgccyaggccgycgaagccaagacagacgcccttaycaycycgcgaaccaaagaacaagggcgcgcccccccgaacacccaagacccaaccgccgcggaacccgcayacaacaaggccaccacaccggcagagagagaccccgagaacacacgcagacccgcaaccaccacccccgcccacaagcccccgggggaaccgggcccacacaggsagcacacacgcacgc

SEQ ID NO: 76674 - DNA, 394 bp, Triticum aestivum
  Clone ID: PAT_TA_76674
cacccttttgatctttttattaaggatcggggcacgagggacattcttcttagtgggcggctctgccaaggtctctatcgtctggagcaycctggcgtcgctcgcgtcttcagtggagttsgggkskcsccgtcacagtggcatgctcgtcttggycccccgggccmcccctattgtccgtcatwttttgcgtcgtcatgagcttcctagtttgtctagtaataaaratgtagcagtgtgtgatgcttgtcagcaggggaagagtcatcaactycctttttcggagyccagtcgtgaggtgaaacayccgttagaacttgtgttttcagatgtatggggycctgctcagacttctgtcagtggtcataattactwtwtcagtttcgttgatgct

SEQ ID NO: 76675 - DNA, 510 bp, Triticum aestivum
  Clone ID: PAT_TA_76675
ggrgattatgcggaaacaaggcaatatgctggaratgttagggtgaaatartgaaacrgaaatctgtgaacatatcagatcaaractggakkggktttgkgaskgcstttttatcaagttatacactgtttactgacttggtgctaaagcaaagagggagaaagagagagagagatggctgcrccgcctgcrcgtgatatgaccaatctccagttgtagctttactgaactacacatgacatatatgtagtgcatctccatttgcttgtctcgtctcttgcctttctttatcttctagtgctggtaaggkgggaattaaacacaaaattatatgttataaccatgacatctgacttttggtggaggcctggragatcagtatgaagagacttggttttttttcttcttgaaactgcctgactgtatgaactcttcctgtagaaatgaccagagcagttcaatatgtttgataccaacagttgtaatgctgcatagtgaawaaatgtttgt

SEQ ID NO: 76676 - DNA, 197 bp, Triticum aestivum
  Clone ID: PAT_TA_76676
tgscccvachtcscatkctkcccccccccatggccccccccgraattcgattagcttgttcscgsccgaggtcgtttctktctttktctttcggtgsgcttttttkgattaattbatttactaacgagaaatctttttkatttgaggtgcttaaataattttcggattatadttttcktcttattattatkytttgc

SEQ ID NO: 76677 - DNA, 171 bp, Triticum aestivum
  Clone ID: PAT_TA_76677
gtggtcagcgtgttgctggagartggtgcagttgtarrggctgcacacttatctcgctaadcktgrtgcggddbdgctttckcttgrwgcttcgacagtttcgttaattgtatctctcttctcaaggaaagggraattdwgggrgcatgtddagttgcttccggtaragtw

SEQ ID NO: 76678 - DNA, 433 bp, Triticum aestivum
  Clone ID: PAT_TA_76678
actgaaaggatatggaacacacagactatggggacaaaccgaaattggtaatcatgatacttattacctgaacatgcattcacattcattggtgtggcacttagttgtaactaaaatgcacaaatataacaaaatatccatagtaatagatactttaagccccatgttgtaattgtaaccgagcacatatataagaaaatattatagattaaatatttatttaggaatcaatgaaggttcgcctcttcccatgccttatcctatggaagcaaaatggagatgcgttgctccctgtagggttcactcggaaggggtaggaaatccttcagattttrattttmcctatttctctgacctcggcgggtttggtggtggtgatctcgcgggagggaggccttccccaccgacctccacttcctcctcatgttgctcg

SEQ ID NO: 76679 - DNA, 169 bp, Triticum aestivum
  Clone ID: PAT_TA_76679
tcttaaaccacstttktbtcccaatacatttatsgtgctggtcstctccgcctccctggtsaccctcaatcaacacaggaatcccgctyarargtccattarcatacgtcacctactaaatatatwtwctgcctaaataaatctttcatactagtatgtacctccgccc

SEQ ID NO: 76680 - DNA, 232 bp, Triticum aestivum
  Clone ID: PAT_TA_76680
ttctcaaagtggtttggggtgagcgagtgathatytkgttgaagtagtaaragtttatggtcctaccttgagaccctaaagtatgattttgtwattacggtgthatgttatsgattatytggagtytgagacatcgtatgttgttttgytagttgtttatttggagtgttttatttgtggatgbattttgggrgamatgttttatgggatgttttacggtgagtbgttagtt

SEQ ID NO: 76681 - DNA, 255 bp, Triticum aestivum
  Clone ID: PAT_TA_76681
aggcacytgatgatatccccygaattatggacgcgacaacattacygaatgcytgaaawaggtttgcacytgaccacaamagttwcyaatagcgagccmcygacaggcyaaagtgcytcatttcgggcyggtgaaraacytgttgatyccyggcatgaycycgggggtcttgtccygcacatargcycygaggccatgcycggcgtacgcctgcccyccycatggttcycaarcacyccygcygcccyccccatc

SEQ ID NO: 76682 - DNA, 421 bp, Triticum aestivum
  unsure (1)..(421): unsure at all n locations
  Clone ID: PAT_TA_76682
aataaaatcctattaaccccctcgctcacatansctcamatccaatttatwaaaaaaatatcttatcctctttnacaaatwataattgktatatcactyttgtnctactccacacamcccggcgaccccaaghttcaataaccactcaaacattatccatcccttttctctttctttcctcttaaatactccatacmaccatataacaatctttcgaaaattcttcaatwtttgcgtaaaaaatccatwttcaataggttttggttcacataatcgtataaccccttatcaaaattcatacsmcgttcccatgcgtttcaaattaacatttaacacattaataaaatacamcaacacatytccatagaaarcamcttttagaatatcatcttcctttcctttgtcctttagcaaaacataa

SEQ ID NO: 76683 - DNA, 334 bp, Triticum aestivum
  Clone ID: PAT_TA_76683
accagatctatgatggtttacgcactgttaaatcaaagaaagatttagaagaagaagagcagctagatctaaccagtgattggtggactccaaagttccttgcggttggagaacttggaacagacttcttacgcccaccagtaagaactgggttccattgttctcatggacggcactcggttgttggcgacgcggaaggcaacgatcaccggattccagccacctggccggtgagaagatgaggcgctgccaatggaagctgctgcggasgagctccttctcttggaggccgatgtagacctccaagctccaggcgtgcgagccggcgccgcgc

SEQ ID NO: 76684 - DNA, 333 bp, Triticum aestivum
  Clone ID: PAT_TA_76684
acagacagacacacacacagcgccagatagcaacaagataaaatcactgactccctccaactagaccatcgaattcaaccaaccagcatgtatatatrttctcctgctatattgcttcctccaactagagcatgtatatatatatgcctmaaaaarmmtctctctctcwctctgcttccgaatcatctagggtttccaagacattatattgcttcctctcaccagcactccaccacaaaacgcctgccttgttcaggaagcaggcggcaactcaaagcctcgatgcacgacccagggcacctagattactatattattgagaatactccttgt

SEQ ID NO: 76685 - DNA, 555 bp, Triticum aestivum
  Clone ID: PAT_TA_76685
actatggatgctcgccatggagatcctcgcstctccagggktgaggacagcacggkgcacgasggtcctgatcsggccagkgctcaggacctccatgtagtctccgcacgtggacgkgcagcgcgtgccggggttgctggaccactctccaggggttgctacttcggtcaagaacctccaggcctgaacagcttgcgagcaagatggtgagaaatccgtgatcggrgtgcggkgcsagccctrtsgccgaatcgccttctggttctttcgggtagcagttcacttgcagtagckgcaatcctctctgaaatksgkcatgctggtagtctttgcccagksccaggccttsaagtatgggttcsatcagckgcagagccaccctscttacttsrgctgaaattttksccaggtcckccckggaggttgggggtttttctggssaakattgcaascattcactgaggggatgggcataatgctttaggaatgtccgtgccggacgagtgccgtcctttgagctggtgccgtatcgaacaggccgtcggrtatcatctg

SEQ ID NO: 76686 - DNA, 607 bp, Triticum aestivum
  Clone ID: PAT_TA_76686
atttttyagtggaacattatytyatgcgtgcttgcttgcttgcactccctcttatttttactacttgtatagtttgattgatagatgctttcyatgtctgtatggaacctaaacaaacatgccatacaaggraatggaaggcttgtgtagttttagttgactaatcatcttatttgttttttggctgcatctgacatacattcttatgcctgtttactccaggtcaggctcacgtttcccctcctgcccgccgatgtatttctcgcaaacaggaatgaagcgtcaatgatatgaactgcaacaacaattgacaaagcgccatggrttgtggcttggggctaaaaccrrgcyatcttgtcttgccatcttgtcaattactggtttcccctcctgccgccgattactggttttagccccaagccatcttgtcttgccgtttttggtgtgttggtggcttggggctaaaaccactgtttacggkcgttgatgatggtyatattagytatgagatgtgagggaaataytgtaayytywaatgtgtgtcatyatgtgactgttgtgacccttcatattatttctatgttgagattgtgagatttgtatagga

SEQ ID NO: 76687 - DNA, 249 bp, Triticum aestivum
  Clone ID: PAT_TA_76687
actgcradtgttatctatagacgacctgggtgagttattggcggggkgtgcaacctctgagcagacttccagtcaacttgcgacgcgtcaraactawatctcatttggtttaagcatctttccagttttattgcctggatcaacatccacatgacccattgcttgcatttgatgcagaagagcaaaatttgtctgttggaggtttgaagctgttgggtttccatgtaacccaatgccactcgtattagt

SEQ ID NO: 76688 - DNA, 180 bp, Triticum aestivum
  Clone ID: PAT_TA_76688
accaggcakgcctggctatgttattcctcagggccaaattatatatytttctctgtcgacaacctgtccaaaaagactatgcgkaattgcctcaagctagcaccattccaccacaaatgtgcagaggcatgcatcatctatgcatgcctggkgcggccttcctcttcggkcttatcatcc

SEQ ID NO: 76689 - DNA, 354 bp, Triticum aestivum
  Clone ID: PAT_TA_76689
acaacaccakcatcgacggrtgcttggsasggcgaggggggtsaagtkggtgatggggtctcktgacgaagastgaggaasgcgtgsctggtgtgcggaaaacttggctttctatgatacgcgtctcgcgtcctttgtctctkcaggcacacccacaatgkcaaccggakggagctcatgagtttctctrctattgctcgggtgcctctccctcgsttcargctcktgtkgctgcgstgtagggctkggtcrcrgatgdraaacttckgggttgrtggcargcccagcgttttccagacgacgtaaagctacgrcagttgctacaagartactgcraatggaccatagtgaart

SEQ ID NO: 76690 - DNA, 265 bp, Triticum aestivum
  Clone ID: PAT_TA_76690
acgrccgrtcrtcggaggaaacatgcgcgcctgcatgctctgttcgttcrkkcgttcgtgactagctagttcktcttgaattcagktgctattgtctttgrtttksrgsctggtgcgtgcktgcatgcatgakaggtggrrtcaagttccggccggcgtcgrgtttattgttttttttcgagttcttgattgtttttcgrgrkagctacccgcttatttcacgcggtaagtttatrrttakkaattgatttaatttaaacaaaaa

SEQ ID NO: 76691 - DNA, 187 bp, Triticum aestivum
  Clone ID: PAT_TA_76691
actgtataagaagggacggtggagacacttgagcagataagagaatatgaaagtgctcagagagcatgttaatacaaaccaaacataaactagactgattcttcattttaaccagattcactccctgtaagttcaccaactatgtacatctttttcggccgtgtcgttgattagtctgttgtaacgt

SEQ ID NO: 76692 - DNA, 238 bp, Triticum aestivum
  Clone ID: PAT_TA_76692
gcgcgskcaagrcacacacacactckcacacgcacwctctcacgcgcacacacacactckcactcactcggcctcgstcgcgggcccmccacacacacactctcgcacgcgcgckcgggggtctctcccacgcscacacacacacmcacacmcccscccccaccctcttaaacacgcactcycbctcacgcgcacacavacacgcagggtckcactytcggggtytctcccacgccca

SEQ ID NO: 76693 - DNA, 470 bp, Triticum aestivum
  Clone ID: PAT_TA_76693
gcagaactgataccaagggcgtctttaggaggcatgagaggggaatgaagtgctcagatgggatattccacaacttcagtccatcaaatctcggrgrgrgagagagagagagagagagagcatatgtatcwaaatctgaagaaaggcatggaagtcgcggttgttagaaggcacggagggaacttgacacgctcaacggccacctggagttggtcgtcaagctgaagtggctcgtctcgctctattcggtgtgatgagtgcccagaattcttcggcttcttagtatgttgtggtgttcaaattagcttcttgctctgagaattgtgctgaagcgccaagcvagattgctgtggaacatgttcgattggcatgatgaattcsaatggaaggaatttggatgcatgcatgaatgaatttctggtttcccaacagagttgttgatttgggatgaatggatggatcatgctttt

SEQ ID NO: 76694 - DNA, 673 bp, Triticum aestivum
  Clone ID: PAT_TA_76694
cggcaggtacaacaaaatattccctcaagagtcgagattaatgaaataagcctttcgagaagcattagktgcaacagtttcagttctgatttaccagcatagacggagatattggagcaaaagcgagatgaccacatggacgcatcatatgagggttgatgamactgttgatgcctcasctatcaaccagagaggttggcgtgcttgaagacaagcaccaatatcgaaggggtgtaattcaactccgtcaaagataaggtttagtcctggcaaggttacatccttgctgtgtgcatcttcttgatctggctttccttcatgggtggatgactgtwcgtcagavatgtgtttggtggtagcctcttcctgctccggagagagtgaatatgacctgacagtcctcccatcaaagcccacaacttctgtgccgcatctctgtcggacagcaagttttagcctctcgtgttcacttggggttcttgtgttggttggtgctgaaggatcatttgctggatcccatctgctactaatactattgattaamgtgcgaggtagatcccttgagcttcccctcttgttatataactgagctactggtccagttgcttgatattcactacaaagttctctgagacgcctccttacattttgcatcacatcataatgttcagtg

SEQ ID NO: 76695 - DNA, 170 bp, Triticum aestivum
  Clone ID: PAT_TA_76695
acaggttcaaggggaccagagatgcttgatgcaatggggaagaagggggtagaataaggtcaggkgattwactcacgtktyttataccacagtagctatttccctttttgtytttttwtaatattttggttctggtgttacgaawtcawtcaatytatattctatagacg

SEQ ID NO: 76696 - DNA, 430 bp, Triticum aestivum
  Clone ID: PAT_TA_76696
gcaggtcttccttttcttgtgaatccaccaacccatggtctttgtgtgctgttgaatctgttgatttgtggtcctagtgactggcgcttcctgaatagtgggtagcagcgcccaaggatctgctgcgctagggaggaggcgagatcatcgatctgcatgctgctgttgatgttgtcgtccgtgcatttgatttggtcgtggttttcatcttgcaactctcttggaaacagctttagtattaggaaggtggctacgttttcttccccaagcgcgcaaccagaggcaccatcgcaatttccgctcgaggcagctcgacacatcaacctcatcctccacagcggcaaccgtcttcgaagttgaactgcagatggagctgctggcattacaacaggaacccactatagcatttgaggttgatcaaatgtatggt

SEQ ID NO: 76697 - DNA, 166 bp, Triticum aestivum
  Clone ID: PAT_TA_76697
accctcgtcgtggcaacgctgccgttctccttgttgctgctcacggactcgcctgccttggtggcattgcggtctgtaagagggttactctccgcagcggacacagaggacattgccctcggcagcctcaggggaatgtcggctctgtwctgcggacggcttcggc

SEQ ID NO: 76698 - DNA, 179 bp, Triticum aestivum
  Clone ID: PAT_TA_76698
acacagtgccttttctttygcmgtcatttgcttgtattagcacaaactaggattcactaatatggtcacgttttggtttagctttgttttcgtttcagttgcaaaghhwwtcgctaccatgttaawcwhttattagggtatttwwttgtgcaaagttgtgctactagtaaatgttatgt

SEQ ID NO: 76699 - DNA, 394 bp, Triticum aestivum
  Clone ID: PAT_TA_76699
tacataattatttaaatcaaggattcgtgtatgttcagaggaaacttcaaccaggtggtggtttaagacttcgaagtgtcgaaggtagaacgcgtagttcaggcgcccgctgggaatavccaagtgcacgcgctattggaagtctcaaaggaggacccggaggtaatctgaaccgcacagcacaaggctgagccatccgaagcccctcgggaggataacgatgatcagtcgtcttaggttttgaaagaggtggcccgtccctcttcggccagggacattacaawgtttaacagaaccaacaaccatccgccacaccggagtcaggaaaartacccctccccgcaggtgttctggtcagacaaggggtgaattgcctagaacaggttgtaacagc

SEQ ID NO: 76700 - DNA, 229 bp, Triticum aestivum
  unsure (1)..(229): unsure at all n locations
  Clone ID: PAT_TA_76700
tgccaaagaggttcatgactcatwgaaggaggactgggaagacctcacgatgacagagtgtccaggacctggtttaagacaaccttcgcwtcggggtcawtgtagtgaggggtcccacgtagtttcacgccagatccagcgctgagaggagtgctcccaaggacccgrtattggatccccntgacattcagcctggaactcgtcggaacggcgctgaagcccttcccaa

SEQ ID NO: 76701 - DNA, 229 bp, Triticum aestivum
  Clone ID: PAT_TA_76701
attaggcatcatgttaattcctcgartkaaataccgctsatattctgcaacttcagaaaaccgaggatgccaaaggctbtcaattgtgaatatctcagccgtyactgaggcatgacaatgccaagctggaactacaaaaatgatggacccttctactgcacgtgttctcattgayccagtgagctcaggccaagagcttctgcagcggytttgacaccagtagtacctg

SEQ ID NO: 76702 - DNA, 178 bp, Triticum aestivum
  Clone ID: PAT_TA_76702
acaagcttttttyttttyyyycccccccccccacgcataacattycccattgacaatgtgtctttcyggcttggcmgccttaycccaaacytatacatcaagcagggtcaatatacatactgstggagtatttcacgaamtgsaamgstggattccgtcagttccaaccaaccatagc

SEQ ID NO: 76703 - DNA, 350 bp, Triticum aestivum
  Clone ID: PAT_TA_76703
acaacataggcggctgaactgatcgtagaagtcaaaacaattgtaattgttgattcatgaccggacggrtagttacaacaactgttatgaacctagctagtcatgccatctgcaggggattaggaagacaaggggaaggaggaaataatattgcgagagaatatattgattcttgcttgctcccaaagaataaaatgcctgctcggatatagagctaacttaactttgacccgaaagacatggagatagtcggaagtatcaagctcgggcaagatgcgttatatggttattgagctgaaatgtgtatatgaattacaattagaggccctcctgttgcaataacttctgca

SEQ ID NO: 76704 - DNA, 388 bp, Triticum aestivum
  Clone ID: PAT_TA_76704
tgcagtttgttttctcattcagtgacaaactacacacaaggtgcggtcatatacatcatggcagcgccggaaggrggcggatgacagccacgctgaaaggagcagagcacaccgtcgccatgggaggagcaccagaccatcattcttgggatagctccatctagaaagggtggtctctcctcctacgtcctcgtcggttccatcccgttcgttctgccgcctactgcctcacatgccgcgcgggtctgggagagaaagaaaaattcgaagaacaaggagagattgttgaggcagagacgtgacgatttttgaggtcatgatcatcaccatgaagcagaagaagtcatcatatctttgccatggcgagggtctcacctgctttgcgagt

SEQ ID NO: 76705 - DNA, 190 bp, Triticum aestivum
  Clone ID: PAT_TA_76705
accaatgtgattttgcttgcttgattgatgactgcttgtcattaattagaaaaaagacgaagaaaaccttgtctattttatttgaggagaatcgtgtagcccattcactagacaaccaatactactacttgtatttgcatgtttgsttggktgcttgcttgtagcactatcaagtgtgaggaaattcagt

SEQ ID NO: 76706 - DNA, 182 bp, Triticum aestivum
  Clone ID: PAT_TA_76706
caaaggaacgaaaccgcagggagcaagaaaaamaagaamaagaacagvaagcaacccggaggcrccggggsaggamggggamagcmcgcgcccggaacagcggggamgagccggaagaacaagcgacgssaccgacaacccgcagcgcaaagccgagcaaccacacgccaaagacgggsgag

SEQ ID NO: 76707 - DNA, 407 bp, Triticum aestivum
  unsure (1)..(407): unsure at all n locations
  Clone ID: PAT_TA_76707
cgygcatgctgyccccccatgccgygtgcgggaatkcgagttsgagcgyccgtccgkgcaggtacrccckcgcgctccacaaggccctcakgttcttcaacccccagcggtcsggtcatctgcccaagcacaacggcgkgagctggrggggcaactcsggcaksarggacgscckctsggacrccaccctcarsargasctkggtyggrggcttctaccrcncrgcgaccccaccaagttcaactaccccakggcctggtccatgaccatcctcacctscacggtgatcactacctcsccccccaccaccctaatcactastsaattcccccccccctccagctcsaccatatsgcasacctcccaaccccttscatccataccttcactattctatactctcacct

SEQ ID NO: 76708 - DNA, 645 bp, Triticum aestivum
  unsure (1)..(645): unsure at all n locations
  Clone ID: PAT_TA_76708
tgttcgtggggttgattaattatgatgagggcgcagctcgctctagggcttgtgctcttgstcgttgttgcgtcsaggagggccgtaggakggggggatggggatgttgactatggsggtggagggaagaaatvtgaaggtaycggsgaatacaccasaggtattgagaagaaacscgaaggtgtctcggctagtgctgagaagaaawccgaagsvatctacgctgatgttgagaagaaamcagatgatgtatctggattcgatgtatcgtccagcgcgaagamgaaaactgamgtcgcatccaaaaatgttgaaacggagaagaaamcggtaartryvtytggrtatgctggcaaggagaaaaaawbcgaagtgngcactaaggctgctgaggagaagaaagctgaagcggcctccgagaagaaathmaaaagaaagagtgagccctccsagccttccaccatcgagaagaaamcaaaaagtaaaaatgagaagaagtcsaaaggaaagaamgarctctctggataractggtgcggagaagaaamcagaagaaaaagtagataaacctaacaaggagaagcgaacggagctgaagaaggragagccgcatgtaatggttatgatacstaaaagattgcacaag

SEQ ID NO: 76709 - DNA, 215 bp, Triticum aestivum
  Clone ID: PAT_TA_76709
agacctcgttgktcatctsagcggcgtccttgctcggacctgctcgrtcacacgcttgtcaatacctccargcttggtagatcagagtggscagtggtggkcgggcttgccagagtcgacrtggccaatgaccacgatgttgatgtgagtcttctccttasccakggctgaracksggrggarggrgaaggrgcgcgagrgggggcggcgggggg

SEQ ID NO: 76710 - DNA, 306 bp, Triticum aestivum
  Clone ID: PAT_TA_76710
acagacctgccctattgtctagcctaaggttcctctgccaktcaagtracttatgaagttgccactgttaacactgcaagagaktctkttggatgsaaaaacagtgtggrraatgtstgatggagagggakggaaaaacatcactgctgacagttgtaactggtgacagctggtaagtggtaatcccatctgccaaaactctacgggctatggtcttaacctgtgcaatcgttcgtggttcgctctgcctaagccgtgctaggaacacatccttgtattgaaaacttaattgtcttttcagttagt

SEQ ID NO: 76711 - DNA, 364 bp, Triticum aestivum
  Clone ID: PAT_TA_76711
acagttattcagaccagagttagctgcaccagctcagctgtttgctcccatatgagctgatcaaggtctgacgccatctccgctgcaatgttgccattatccatggtttgccactgcatgccgcatatatcttgctcaaccatcgtgcagatgattcgccaaatgccggtcgcatccggggcgatggcctctgccttgttgttcaccattctcctgtccctcctctccttgtctgaacatttcgagacacggcaggaggggttcgctgctgcaggaggcgggtcgccaccgamattgtcggagttggcttgcagtagcttcctcsttgatctctgcagttgcctcgccgccggccgggctttcg

SEQ ID NO: 76712 - DNA, 314 bp, Triticum aestivum
  Clone ID: PAT_TA_76712
gaaraaaagaaactgcacaabtgaagctttttttttaaaacaatcccggtgaagcttgtttaatttcctcgactastaaattttytcatgcaactacctactccggtcccratccagcctcascttcacctgaccccccccctaattttgkgggrggratyyttttgctactagtagtaactagtcatgatcactgttgcaccatttatttatyttatatcgtcacaactttccaytktttskkttctttctctacctytttgtcaatcgtccgctccagctcdatcaaacaatccatgctcctaattttttgt

SEQ ID NO: 76713 - DNA, 250 bp, Triticum aestivum
  Clone ID: PAT_TA_76713
accatcagatatcttkatactgcttatgcrctarrrgcrtgtcctgrctgtcgrcacatatattcatatagracagcragagacagggttcgacgrcrcgccaccrcrttccatcagataagrtcrtccaggcrccatgttccatcgrtcrccagtrgtcgccgcrgggcrcttgccctccttgaratggtggaaccgcttgttgtccctcacgatgagctcccgccccacgatcctcgacatgatcttg

SEQ ID NO: 76714 - DNA, 177 bp, Triticum aestivum
  Clone ID: PAT_TA_76714
cagcacggccgggraaactcatacatacagctgggcctaacaacaacattgcagactcrctcaggtgcagtyyttyaggrtytcaacgaggccggcacgctgctcgtcggtgagctgctccgggragrcgatctcgagcttcacccgtrgkcgccccgcgcgcctctctgttcggcg

SEQ ID NO: 76715 - DNA, 183 bp, Triticum aestivum
  Clone ID: PAT_TA_76715
caktatattkctacttactcctcttcycgttcyctaaatatatatgtctttctatacatatwttaaatagaccacaatatacaaatgtatgtagacatattttaaagtgttagattcacacattttgctttgtatgtagtcacttgttgaractctctagaaagmacaaatactcttacgaaa

SEQ ID NO: 76716 - DNA, 410 bp, Triticum aestivum
  unsure (1)..(410): unsure at all n locations
  Clone ID: PAT_TA_76716
acaaatggtggctgtttctttctattgactaasvatggccgagctgagccaagcggctcttgtyacatcacgagaccaagcaaaaamacggagaggnyaaasmaraasragccttcccttccagagtcacaaaccgctcgggaaaaggaaaardataatccaaraggcacgccacaaaattagcttcggstgtcagtggctactctatctactagcttaavtcagagccagagccgtcctgcattctggtttgcvagcsmmatttgtgcccgacactgccggggacgatggttagaatcaatcaaaacrtgtgcagaacgaacggcgcaaatcttcctaaagagaaagtgtgggaaggkattattagtggtccagctttaaacttctctcgaraacgacacgtatcaagt

SEQ ID NO: 76717 - DNA, 262 bp, Triticum aestivum
  Clone ID: PAT_TA_76717
aaacatgaaaarrttgtgggcaataaccgctacagaagagctggacgatggctccacgttcgattgtgatcctgcatgcatcgactgggactcrtacctcrtcaacacacacattccggctgctctgatgtatgcttccaacaataatcagatgaagaaagctggcagtgcaaaggggagtagatatattaataarctctatttctaatagtaatcatatatgtcatgtatgtatctgttgtaatgtttatatatctgatgt

SEQ ID NO: 76718 - DNA, 615 bp, Triticum aestivum
  Clone ID: PAT_TA_76718
ttckcggccccactccggcccccacgagttcttcacgatccrtttgarctgcatgarcctgaatcttgatcgagttgacagcaaggaggctgrtcatctggrgggsaataatttccattaacaaattttcgacagcatccaaatgcttcgggagacakccatattagggagtcatcaagccatgaggcagcaggttttgctatgtaacttgtttcaggrgataaagattgtcttgctatctcattcagaagagagtttgaattacactggttgatggaacatatctgattagtattttccgatgcagagctgtaattgaagttcttcacaacaaaatacagtggcggtcaactttcatatacttctcaaggtcgtcaaagtaaccctgtaaatacgaatctcgtggaagaacgattttctgctccaatccgggttgtagtctagttgacattgcaatgcttgcaaatgctaatccaacaaatacagcaatcacgataaacttcactggtcggtaaccgaggattggcccatgaatatccttcatatagcgtgcacaaagtgaagsggctggtggccaccattgtcgccagcaacagtgctcgatttaagtcttgc

SEQ ID NO: 76719 - DNA, 269 bp, Triticum aestivum
  Clone ID: PAT_TA_76719
acttcctttttatcatcaacacattggtgccagttgagtcattctgagcctcaattctaaccatgttttccccacgttctggtgaacccatcgacactggatgatatattctcatctttattatctaaracaccagtagagcagttatgctggggcactttaccaaggccatcctcagctctgtcctcgatgtttgcattggccagataggctgtaacattttcatgcaataaatttgttggagtctttgtttcaccatctttatcagt

SEQ ID NO: 76720 - DNA, 505 bp, Triticum aestivum
  Clone ID: PAT_TA_76720
cagcgygccgcccggghcagggtactatactaatcacgcgtcctgtcctatttccgtggctttctcctggaccagctcaaacgtgtcacggatgtgtcgcatctccgycatggtagcacctattgcgagacggataacgaacttgttgtccacgatagtgtggtatcatgaaggctttcccactcgcgttcaccacattgagaagcttacggttcaaggcgtccactgtgtgtcaccctcataccttgggcggaagcggaagcacacaagggagaatctcctcggcacaatgacctcgaaccgatcgtctgccttcaacgccaattcaaaccacttggccatctcgacatgcctcctgatgttcgctcgtaagcccacagcgccgtatctgcgtasaccacccacaactttatggctcggaacctgcgtgtcaatgcaatctgccagtccttgtaatcgatcatacccgtcttcgccagacttccatggctgatatcattgaggt

SEQ ID NO: 76721 - DNA, 444 bp, Triticum aestivum
  Clone ID: PAT_TA_76721
acttcccaagtggcatccgcagccaaccgccgccagatcaacaggcgcctccagctcatctagcaacaggaggaagctggtgtttgacaaagtgtgatggataacgcgggcccggctcttctcatccatcaatgacatcatttcgtagttgtagcccaaacatacacccaatgcaagctgcacatccgtcacggtggatctgctgccaaacccaaaatagagcacatggtggaaaacagcgaagattcggtaagactgtcgcagctgcatgagaagggaagatttacccactccactcacgccccagatccctagcaagttatcatgggctagcctgctctccaaaaagtcatgcaccttgttaagacaactctccattccccacaaatggcgagtttccaaccggagcttctgcagcctcatctcacgggcatgagcacgggt

SEQ ID NO: 76722 - DNA, 582 bp, Triticum aestivum
  unsure (1)..(582): unsure at all n locations
  Clone ID: PAT_TA_76722
tttgttagtccttttcttattcatctgatgtgtttgcgtctgttgggagagctgtgcddrctttgcydtydtgtttttctcarrttccaatattgatcttcgctcctcttccaacartctttccgtttcagcrcgctcttcttttarcctctcctcaaggttttctctcttagcacgctcgaagttaatcctctcttgtgtgctttcacgttcagcttgtaattgatcttgtaattyggtgacctgatggctgagctcagagtttaccttttggatctctgttgtagcacgttcttgctcttcaaattgtgatttaatcyttttcagaaccacttcgtgttttggcyatgtatcyataccaatgttggggatatcgcttatygggaacttatcggtcgacccatgataaggggtaaatcggcaagnttatcggcatatcggccgatttatcaccatatcggctgatttatcagcgagtttatcttatcggcyagacaacgataagcgataaatcggccgatttatctgaatatcgggagatatcttgaacaatgatccatacccataaaggctgtgatgaga

SEQ ID NO: 76723 - DNA, 162 bp, Triticum aestivum
  Clone ID: PAT_TA_76723
gacgggaaacggaaccttactgttctkttaggtagtataagtaagtggagatagagatagagatgaagatactattacttgacagaaacatacgtasgamscaggcaatcgggatgttttmgaagtctgaaattaaaaagaaaaaacacgacacaatagagt

SEQ ID NO: 76724 - DNA, 477 bp, Triticum aestivum
  Clone ID: PAT_TA_76724
ctgcatactcaggtgtgatcagcagccggattatacaccatgcttcacatcagtgcaccagcgccgcatttcagtagcaggctacgcatcttgagctactggtgtgtatcagcaagctagcagagtcaacctagctatcaggttctattagcacggrccctgagaacttccaagtccatgtcgtcagggtcagttgcctggatctcaaagtgcaccccgtcgagctcgtggcggaattgattcctggacacagcatatatggtctttgcacggrtgcgagaatcatcaggagaccaggagatgaagaaaatcttgctcttgcggcagttgtcgtcgctgacgaaatccaggtcgtagagggcgtasggcagtcgtccacaggcagcgaggccgtgaagtcgtcatagctctccccgggcgcgccggtcttctcgaccacgacctcctccgtgatgtcgtcgatcttgaatatcacgt

SEQ ID NO: 76725 - DNA, 219 bp, Triticum aestivum
  Clone ID: PAT_TA_76725
acgaagagtcccccccagccatcgtccacaggaagtgcttytagacagstgtyttcagatctattctccawgcatacccttgtctagtagcattattaggtggtggttttkttggacaaatgttggccgatggcctstctatgggygtatctacyctattatgtgtgtagtctgatttgatggatttwttwttggattytacaacttcmycgctgtttc

SEQ ID NO: 76726 - DNA, 320 bp, Triticum aestivum
  Clone ID: PAT_TA_76726
gcttaacagagagttgacaatcttacaaagtggatgactgatcacaaagacacattcagcggttcaaatcaaagttcagcggtctccaaaagatgggcgatctccaaaatagaggcagagttcctcggatcatcacaacgcaggcatcacaagttttggagagaaactagatacatggatcatataggtgcgtctagagacgatgaacagtgagactgcatcactagtttactgactggctcctattggcttcacagacctgctcctattggcattttatcaaactggactatcatcaagacatacgtcaccaccatgaa

SEQ ID NO: 76727 - DNA, 217 bp, Triticum aestivum
  Clone ID: PAT_TA_76727
gcyacctgttatcctctgctcgtaaaagtctaaccagagcagggcactcaagaccttgtgttgtcgaccccagctttacccgagcacccacaaactatstcctgcatgcactctgtcctcttgacatttagccatctcttgccataccggatgccaaaaccttctcccacgaaaacaagttgtagaagtcatacacctcggccacagagtcgaaagt

SEQ ID NO: 76728 - DNA, 347 bp, Triticum aestivum
  Clone ID: PAT_TA_76728
gccgaggtacatggkgtttgaagaacagggatgatgcacaggggraagagagacagtaggttctgkagcgtttcggtagsktcacccgcacggctcatacatacggttttggkgctctgatgtccgtgcttgtcaggtagacgcgatagtggtatatgaktctgaagaacagrgatgrsgcgcgtaggttccataggatttcgaatagsttcttcacccgtacggctcatgcggtttcggtgttccaatgcacgatcaaaacctaacttttcctgctctttgatttataacctagcacccgggttgctttcttgcactcacagcagccattgctaagctcctgcccg

SEQ ID NO: 76729 - DNA, 224 bp, Triticum aestivum
  Clone ID: PAT_TA_76729
acagaaataaatcttgaatctgcacaaacaattgatgtcatgaagtgcaaaaactaaagcttgaagctttgcaaaatatcaactgatttagataactaattcggtagatttaaaacaattacatggaacaatattcaggagacacagttatccattcaattaaacaatcgcacaamcagggaagaamatmctcatatccagagatcggcttctctcaacattaa

SEQ ID NO: 76730 - DNA, 369 bp, Triticum aestivum
  Clone ID: PAT_TA_76730
acctcaagctgagatgcctctgtggacacaccatcatatgcatgatggagtctctgaaagttgctaccgatatcatcgaggctctgctggaggtcahcaagttttgtagcatgatctgaaactttctctgtaactctatcttcaaattcattcatggaagacaaattttccatgcatatttaaaccataactttcagatcgccctccaccttggccttctgaaatgacaatatatcgattatcttctccaaatctttcgcattactgtwcatttcattaacttgacatgccgcgtcacctgaactctctcgagtttctcatgtmagtmagaaacttttagtattgcctcttcgaactgttgctccaagc

SEQ ID NO: 76731 - DNA, 376 bp, Triticum aestivum
  Clone ID: PAT_TA_76731
gccgaggtacattccatctgtcagctgrgtttctcagagtctacagcccagcagctgrcagcaagatcagatcaatagctggsgagaaggttatatttgggsgccgrcatgtgtggaataatgtcagctgaatcaataggaaactatggagtssggrkastgktcgatgakttgcacaagactgggatcttcacttgggattrcttgcaccatctgggttctaacaaattcagtctatcacgraattatatcagaactttggggraacatggtcttagtcgggagtcctcagagaaggaaatgrtgrtaagtatttgcgtgtgttaaacatgtagatacgacggaactcaaataggctgaatttgttagaacccag

SEQ ID NO: 76732 - DNA, 257 bp, Triticum aestivum
  Clone ID: PAT_TA_76732
acatgatcttggcatactgtatttttcaaacttgtcaagagataaattattattctgtcctatcttcaagtgattaamattatagtwtwmtgctgccactgtaatcttgattaatgtrattcaggaatcagggcagtggtctgcagawagaatgtrgctatatawctmmhctcgaggagcatcacacctatttmvcttagmmgthttymmccttacattmcmctcagcagtgtgtgataattcgagacaaggggatt

SEQ ID NO: 76733 - DNA, 230 bp, Triticum aestivum
  Clone ID: PAT_TA_76733
aaagagaacacatagcaacattgcccacaaaactgttgaacattgttgctgtcaattcagcatgggttcgctgacaccaggtgcccacaaaaccaacgaaaggagaactagaaatgcacccacagatggagctttgatagcattattaatttgtgcaactaaaaaaacgtcaccggctcataaccttcgaacagcaaaatccttccaaagaaccgctcccatgtcaaagt

SEQ ID NO: 76734 - DNA, 605 bp, Triticum aestivum
  Clone ID: PAT_TA_76734
acataacccggggaccaaattggtaaacaataccacaatcttgaaaagaaacatcaacatcagtaaattttagaacaccacaactacagtcttgtgccacttgcggttgcaccccatgaratgcaagagaagcgcacatagtggcaagcagttggctttgctcggcaaacaaaacttgcagaatattttgtaagaattttggtaattttactacataacaattctcctaattcctaaccaaaaaaacattacccaaacaactgcaggattttttctctaaaacctagacttgcaagagaaacatccacaattctacacaaaccaatgctgatatcatttgtagaatttcctgagttcgttcttgctactttttcacatggcagtcagtcaatttgacaattttwtcagtgctcaaatattgaaatatatgtycttatagcgagtatgttcagaggaccgtagagaaaaacaggtttgtattaattgacttgttaattgactctctacagcccctcaaaaattatacacaaacacaatcgtcaaaatccggagccgaccctcaagtaagctagctaggttctgggcttagtgctgaagtgcatagt

SEQ ID NO: 76735 - DNA, 257 bp, Triticum aestivum
  Clone ID: PAT_TA_76735
gcaaagaatcactgcccgtgtagaaaaagtaattccaaaaaaacaccacaaattcattgcagtcgggttccagcttcaaagaatcactgcccgattgttcagaatctgtstgacgcagcagctgcaaagaattaaaaaaaaactgccggtgtagaaaaaaaaatggaccggttgttattctgaattcctgatctstacgcgaaaacaggattgttcactgcaatctgctcctcttgaagtctgggagcgtgagagac

SEQ ID NO: 76736 - DNA, 212 bp, Triticum aestivum
  Clone ID: PAT_TA_76736
accattatttgcctcagttacatttggctaactttggtctagtataggcttgtaataattaggcatgataattcacatgcactatgagttgatctactcgaataggattggagggcaacataattaattgctgatcctaatgccctttatttagtggaacggtttatggaagtgtaatgaacaactcagtaagagcaaattttgtttwtctc

SEQ ID NO: 76737 - DNA, 314 bp, Triticum aestivum
  Clone ID: PAT_TA_76737
acacggagtccttcacttgtgatattgatgccctatgcccacctgcacgcagaactccatgaaccaccaatgattcaacagagtatgggtcttcttcttcgtcactgatttcaggggtcagtgtgcgcaggcttttcatgttccacagatcatttccatctttcaaagaaggggcaggcattgstacgtccagagcagtaaccatgttctgcctaccctgatcagatattatgtgcacaagttcgcgcatatcaatattaccagatgaatgtgctatgtttgaagccggcccagcgttttgtagtctaaacggt

SEQ ID NO: 76738 - DNA, 414 bp, Triticum aestivum
  Clone ID: PAT_TA_76738
tttttttgcttcatatgaattgaatttctcgattaaataatcatagttgatatcaatgtcaaaccttgaragtgaaaggtttcaggttctcatcgaaaccactgcgttagtaactcgatgcattcgttttgtcttcactttgtcatagtagacacatttgccccattctgattttaaaactctgctacacaagttaatataatgacaatataagtgtcaaagataatgaaaatgtttgcttcctataagcttataaacataggatggtgccctatcttgagtgtattctatcagtaggcttgcgsaagataagatgacttgaatgagaacatcaatgccaaartcatccgcggctcacaaaaatgacaggtcacagcaaaagtaaagtgtcctgggcagattattaacaaaagt

SEQ ID NO: 76739 - DNA, 306 bp, Triticum aestivum
  Clone ID: PAT_TA_76739
acacggatgtaggccgccaaatsctggtaacgccgccaaggcmmmtcgcaccttgggacgactgtgtatgcacatacagggaagcttcagaaattgcgcttgcaccgagggtgsasayaycsgagagccygtgtcagtcgyctgcggtatgttsbttgcatcccctgggaccaaaatgctgcgacgtcctgaggacagacctyccggcacagagcacagaagygtcgttggcatgsccascmgyagagaysgttgttgtttccgatctttggaattgggttgcggcaagtgggacatgggtaacca

SEQ ID NO: 76740 - DNA, 251 bp, Triticum aestivum
  Clone ID: PAT_TA_76740
ttgtattagtmttaggggtagtaataattgaaaawartgtgwgamwtgtagtacatagacaagatgtattaattgtacgaattcattatgaamgagatcgagatacamgtgrtttaggaatagtttaagtacgacgttaamcaattggagaacatgtcgtttgaatagtttgtgtgtttcgtggagttagycgtcgagagcgachtgtagttcaagtacgaagtttatgattagttggagttcttgttata

SEQ ID NO: 76741 - DNA, 376 bp, Triticum aestivum
  Clone ID: PAT_TA_76741
acatgtgagaagatgaatgtagaacaaatgaatgcattttcaagcgccatggggcggggccgagacgagggcaggagaaatgagcttgcatgaracgaggcacttgtcattcgtggcatccttttcctttgcacaacgcttgaagcaatccatgtcttcccctatggctttcttgttggccggggtggccatgatgtagccgaacctcgcggccgtgtaggggcagtcgatgtagcagcggtcggagcaagcaggatccttgcatgccatgtcgcagtccacggcgcaatgggaggagaatgcatagaccgtcttgttgccggggcagccgccatgcttgtcgacggatccgttcagggcatcctgccccccggac

SEQ ID NO: 76742 - DNA, 488 bp, Triticum aestivum
  unsure (1)..(488): unsure at all n locations
  Clone ID: PAT_TA_76742
attaccgtgttcccccccracrtacaccracttccctctaractcgcccattraraactctcccaccyttccacctcttvgatccacttcatccttcatctcagatcttgctgatgctctcgtcgaaccccttccatctccctctccgatracgaccaaaaanmtcaaccatactvactctcacatccatatratccattacctraccaaratmttcttccsctcggtcctccccttcttcctcctcttatcaccaacgctactttccgctttccaaaatactcttcattaacctccttatttttatccatcctccgtccttaaccattttcccaattctaactamaaaccctatacacmataatatctcccccacaaaaaaacmaaaacttttttcacttatctctyccccataacatatcaacatccccyttctataaacmamtcatctacctcccccccccccccctccaaatcactactcaatt

SEQ ID NO: 76743 - DNA, 257 bp, Triticum aestivum
  Clone ID: PAT_TA_76743
accgtgtatacttcttttcktcaaacccactattcatcctatatatgasacctacaactgckgcacagkkkgaktattccctatrrragttggatgcgatgttatctgaaaggttcagccggggcggtttcttcgagaagggcagccgcctgaraacattcggcagcttcaagtgccgctgatgaactgcccccttcatcttcataggttagrccgrggttaaaccatgcaacatggttcgttctgtccagtctcag

SEQ ID NO: 76744 - DNA, 437 bp, Triticum aestivum
  Clone ID: PAT_TA_76744
ggcctscctggsgccaggtacbaagccaaattkgacgagccaacccagttatttcaggctccagtttagcctccatccccagatgttccttggagccscatcagatgatsatcccgattaccragacgamcsaaatatcttaacrmcgcccgcccaamcgagmsagtyggtcgatcamcaatcccattgcctgmcggcaaccagagcttagaagagscsttgmactgtggagsctcatttctgttcgatcgstgcaatggcagattckattcgacgacsaaactaagggcagcaaggctscagtcgatacbmccaggagtaccaccgatmtccccaggatmccaatcctgmccgatcgatsgatgatgcataatgamgatgmbataaggamckmcatgsymcgaagaaaaaggagagttgaccatcctaaaccatgg

SEQ ID NO: 76745 - DNA, 383 bp, Triticum aestivum
  Clone ID: PAT_TA_76745
ggagacgaccaccaatttttggaaattataacatgkcaaccgatccaaagtgtcaatgagskatacgrctgaaacccaattattcccagacagcagtcaataatatacacacacagtcaataaacaagaaacaaaaacacgaattcacaatcacataagtragttgatacaacatagtcatatcgrgagagggcgacggagttcaccgcgatyttactctgacggctcgctcgcctcgctcttcttgggctgcggkgggggctgggggcggctgtcgtagtcaacgacctcggcgtcggtaacggagcgggagtgctggacgatggatcggccgatggagttgatccactcctccttctccttctcggcgtcggcgatgaagt

SEQ ID NO: 76746 - DNA, 551 bp, Triticum aestivum
  Clone ID: PAT_TA_76746
ayyaacttataaagaaaatgtgcatgtatcaagggcaaaccgytagattaaatttcaggattatcactctcggatgagcttggacaskttgagattatcaagaatggtgagctccaagaactcatggtaaatggaggggctctgatgttgcaataaaaagaaatggcagatgtttttycaggaagtcatctcaacaagaccaaatgcatgtcaatgctctgttgagtgggcttcattagatggagcaatggcttcgttgagaaccagggagtgtcaaggtcatgtcacgtcttcbcaccgagatccagtggagacagctgggcctgtagctcagaggattagagcacgtggctatgaaccacccacggtgttaggggttcgaatccctcctcttgtcggtcaccatcgagctccaaaatatgtgatgatgtaaattgttttatgtgagatgtttaatgtgtactgccggcgaaccaagacbtaggccctctccccacggatgcggcgggcgagctggatgtckttgggcatgatggtgacgcgcttggcgt

SEQ ID NO: 76747 - DNA, 307 bp, Triticum aestivum
  Clone ID: PAT_TA_76747
accatctaatgcagcagctgcaaaccgctgcccgtaataatcaaattgaacagccgatatggaagcaagtgcataaggtggtggaatattagcagcagggagaacaccatatgtagctcttgcactatctttaccaaactcccataaatacacatgtgtattgcttgaccccactagcaacaatggcaaagagggatggcgtgatagtgctcttgaatggatattctcaagggttgctggaggatcaacaaaatcctcaaattcgtcgggttcgccccacccaaaccctgatgccccaataccagaa

SEQ ID NO: 76748 - DNA, 177 bp, Triticum aestivum
  Clone ID: PAT_TA_76748
atggcttttcractgtattcactttacttggtagcatatctccgtgcttattgccaattgctctttcccttggtaaggaagcattttgtcgcaactgtggactggatttttcacccttcgcaccacctttttccaaatgagcgaattgctgcttgaagcgatccaccccactagggt

SEQ ID NO: 76749 - DNA, 339 bp, Triticum aestivum
  unsure (1)..(339): unsure at all n locations
  Clone ID: PAT_TA_76749
acttgttggtccgctacagagtggctcccgctccaagttgggcacaaaaccccrggagcrtgttgagggcataaggcaagcwgacaagawatccgccaaacattgtgtgttcnactttgtttttggttctgggrattgcctcttcgttggcctccwggtgatgacttccttwgataggraccggtctccttgtcttcbacccgctcgggttcggcyccwagagcgagawrgagatgaargagctcyagctcyarghgatcyaganmggccgcctcgccatgctcgccttcctcggcbtgtccctgcgggccatcttctccggcgtcgggcccttcctga

SEQ ID NO: 76750 - DNA, 283 bp, Triticum aestivum
  Clone ID: PAT_TA_76750
acaacgcttattctcaccggtagaccatttttttattgccagctgaataccacaaattttgggacagaacaaatttgsagtaacatatttagkgcctgaraatgcctcagtgacatcatagaaaaccttgagcctatcacaaagttccttagcaatcttccaatcatctttggttggacatcagctaaatagtttctcatgagccttcagcttttcaaaaatatctatatatattctaatgcratgcttagcattatgtaggttgagttccatctggttttac

SEQ ID NO: 76751 - DNA, 233 bp, Triticum aestivum
  Clone ID: PAT_TA_76751
cgggtacataattatttaattcaagctacwacacgaaggwctgktcgaacaccaagaattccactcaggactgttwcaacatgtctcagtacaacatatccctggtgcgtcwggatggctyctcygattcggaagatwtattagattgtagaatatcgtcgggktgttcggacwtcaccaaycacwcattagaatccgacaacttagwgtctctgtcgtccaactgcttagaa

SEQ ID NO: 76752 - DNA, 349 bp, Triticum aestivum
  Clone ID: PAT_TA_76752
accttcccggaggcgacatgatgacattgctgatgagaaaagacacattgaccgaggacgaggccaggttctatgtcggtgaaacaggtctgscamtagargcaatcsacaggcacaactacatccasagagatrtcaagcctgataatctgctcctagatagatatggccacyygagactayccgaytttgggctatgcaaaccgcttgactatgcagccttccctgacttgaatgagaaggatgtcacggctaatagaacatcatcggctcatggtgatggaagacagcaaactacgccgaaacgcacacagcaagaacagctggagcactggcaaaagaacagaag

SEQ ID NO: 76753 - DNA, 212 bp, Triticum aestivum
  unsure (1)..(212): unsure at all n locations
  Clone ID: PAT_TA_76753
actttgcatgttccatttccrttctcratgcaaaagacgcacatrrcttgtgttcctggaaaaacaatcatggacaagagctaaggtaacgagcgcacacaaagctaskttttgtctgtcaagtcttcggtggtcatcttgttgatgagttgctggtgagtccctagaagttgtggctccacggctcgttcaccggcggcasgtncngaggt

SEQ ID NO: 76754 - DNA, 460 bp, Triticum aestivum
  Clone ID: PAT_TA_76754
actctactccagtatatgctggttacattctacactctgttggttacattctaaactctaccagttacatgaatgggagcatcgatcagagttgcgcccaarrraattgarataaatcctatgctctgctaaccaatgagatgactatccggcaccggcatcagtgtggttcatcgatctgattcgtgtgctcgggattctgaagtgaagcccccatggatcggacgtgcttctgtctcccctgtatcatcacaaacttttgagttgagcagtccttttcggttcctcatcagatgttcttcatgcttcatgcatatagtcagacatagattcctcatctttttctcgcttttctttgacggcgatgcacttggaggcaccgatgctttcgctcttcaagaagtttcgagtgttcaacagtggcttgttaaggccatctgtcaccgatgtgtgacctggt

SEQ ID NO: 76755 - DNA, 646 bp, Triticum aestivum
  Clone ID: PAT_TA_76755
acaagacattcaaggtcattgcggttgtcgttcccatgatcccgtcgttcgcgtatgttcgtttgtttactcggtcattcctagagagtataaktcatgtgctctgtcttggttgataatgtatacttctcttgctttcttactgttgaggagatggattagatatatattgtactccaaactcttatagattatgcaactagctaatggttggaactttaatactccgctttatttatacgtagcacaacctcatgttagttgccattttattgctatagatatggtcttgttctgattgtatatgtgatgattatatccatgtgtatgtatgtggtcttcaaagttgttgaaagatttaaagcgtaasaaagctcgtcaaattccttcggtgcgtcatatattcttatgtctccttcctatgctttagaggtttatagtaagaagatatgagattcagtctttccttttcagtatatctggaagtatatgggagagattactaggtcacacatatagttcagttattaagtttctaaataagttcagccccggagcacatattttgcatcactgcttatttaccattgagatctattctctccggttcatacagtatgtttacatttgacttggaattggcagt

SEQ ID NO: 76756 - DNA, 230 bp, Triticum aestivum
  Clone ID: PAT_TA_76756
ttcaacaccaacgatacccaatagtccagcatctctggcttggtcaactagatccgccgcaatattaaatctgtgsayaaragatcgctgggcatcttcctccagatctgctattctttccaggaaatcctttgcggtgcctttaccggcatcacccgtatcctttgatttcttggtaactttggtgttgaaatccaaatagaagtcagagtcgttgttctttatccatg

SEQ ID NO: 76757 - DNA, 246 bp, Triticum aestivum
  Clone ID: PAT_TA_76757
gccctgtccggatagggcagaagatcaaarctggtataactrgcctcatcgaggccgagtttaatgttcagargsgsggtcggacattkwckscakgrtgtagcaatcaaraaactrtgatctgaatgtaacattggatkkgatscgatcgtcgacctgtgctgtctacaagcraraccagagtgcagtcacgactgccttgtaactgtrattccgcgcaccattctggagtctcccattacgtgt

SEQ ID NO: 76758 - DNA, 177 bp, Triticum aestivum
  Clone ID: PAT_TA_76758
acacgaacaccggcaacccgcagccggcagatgatcccttccagcaacatttcctgaagctgccggcgtcaagcccctatgacaacttcctcagggctgcaggctgctgaggcgaatgagtttcagcccggagcagcagcagcaagtctgtcgtgtcacgtctcgacacatggtaga

SEQ ID NO: 76759 - DNA, 233 bp, Triticum aestivum
  Clone ID: PAT_TA_76759
catgagatgccccattggtaggtgcacatattaatyttagatytcagtcacaggtcacatggagagaaccaaggacgtgaaaatttggaaatagacatattggggggaaagaagaggggacctgamyacgcaaggggtygtggacattgactatcaacagacaagygcataagyccagccgctcgasyyyytcgagaaaagmacagatagatgaagaggaagtttctcaatgt

SEQ ID NO: 76760 - DNA, 166 bp, Triticum aestivum
  Clone ID: PAT_TA_76760
gcttgtacagtctcgaactctcggygcgggcccctgtcaccgccacgtggcgccaagcaggcccacycgccagcccattcatgagacgtcgccggtgctagygcaaacgcagtgaaaasacaaacttttcttctcaacgaaaagatagagatgaaaactgatgagt

SEQ ID NO: 76761 - DNA, 187 bp, Triticum aestivum
  Clone ID: PAT_TA_76761
cctggycgtctcccgcyctgcyccgtstctcccttgtcgtcyctccctccctccggstttccctcctgccttcccctgacctgggtwgcccgggtcgtctcccghcthmstccgtcyccttccscgttgtwgtygtygtttgtthttttgstggtgvwttctctttgwggtttgttttttggtgtgg

SEQ ID NO: 76762 - DNA, 354 bp, Triticum aestivum
  Clone ID: PAT_TA_76762
acccatacacctgtcctcgcggagggccttggcttcctgcccaactgtggtgtggctgataggcgcccatggcgatctcggtgtcccgcaaaccgtccaaggacctctggtttatattggctgagccgatgagaacaaactcatcatcgatgatcatccctttcgagtgcacgtagatcatgaacctcctgaacttctgagccagacgcaacggggaattctcattagaatggcttgtcggtgcaggaacctcggctgtgacttcacgtttaccaaggcagtagaagttcaggtaatcctgtggatgggcatcgtccaacccttcctttcggagagcgtctgcaataatcttgt

SEQ ID NO: 76763 - DNA, 373 bp, Triticum aestivum
  Clone ID: PAT_TA_76763
ctgaattcaccttatattgttgaagttattggtctatcaattatttatctgtatttcattttgccaaarragcaracaaacagaagagccaaacattgcatgcttcgacagacgaaacctgcccacggaggtggtggcgccggtggtaggcggcaatgaggcaacaacgcttcatgaggcggtcaagtctgtggtcgtgagccgatgcatccaccaacgccgcaatcgagtcaacttcaggactccattagtgatagttggctgtgttaaaggaaaaaattattaggataatagaaactgttgggataatttctttctatagtggatgaagttatttcaagtaacatatcttggtttctccctgtagtcgtgt

SEQ ID NO: 76764 - DNA, 640 bp, Triticum aestivum
  unsure (1)..(640): unsure at all n locations
  Clone ID: PAT_TA_76764
gcagggacaagggccstacccgtgtctkgaggctcttgascagrkgaatgagcgccaagaggccctcagacaagccccgtgcgtcttcccgcgtkcaggatggttacargattggtggcakkggaggtgtgcskggtgggcgsgttgagacgggtgkcatcaagcckgggatggttgttasctttggscscactggkctgasaactgaggtgcaagtctgtgtgagrtgcacgcacggagtccgctgcgctgggaggcgcttcgctgngtgyacaatggtcgcgctttcaagcgttgaagaracgttggskggtcaagggatgctgagagcgtggggttgtgkgtgcatccagactgccaagggattgacccgtgtcaagggagggsagccraactttcrccgtctcarggtcatccrkcagtgaagccasccctggtkcagratccggcaaacggctaacgcccccagttgcttggastagccacaccctccccacatttgcttgtcaagttttggctggaagctggttgaccaaagattrgacaaggcgatstkggtaaaggagatttgagggttgcgcscaaagttccytgaagrarcggtgacgctaggtaatcgtgaagatagatttcccaccaa

SEQ ID NO: 76765 - DNA, 475 bp, Triticum aestivum
  unsure (1)..(475): unsure at all n locations
  Clone ID: PAT_TA_76765
gaataaaatttagaaawggaaagtgtggatttgnttgtaattttgatagtttaaaagaatatttggtgtkggtatttgtgtartggagaggatggaaaaggtangktaattgagnaagggtattgataatgagtaagaatattagtattatagggatttaagatttgtkttgtgtgggtgggngnttgaaattgaatttktgngggtgnkatggggggggtagtatgtgatgttggggttaatttgttgtatagtgagttgtattataatttawtggktgttgttttataaagttgtgaatgggaaaattgtggtgttawrgaaattaattgtgttggagnatatttktgttttgtgagatggtgtaaatagtgaagaggggwgnaawgattggggtttggaaaagttgtggaggtgaaatggggaatggatgnggggtgtagggggggattaagtgtggggggtgtggtggkta

SEQ ID NO: 76766 - DNA, 444 bp, Triticum aestivum
  Clone ID: PAT_TA_76766
actttggtgatgattgctcgacaatgtcaagcctaagggtttcctttttatttccattgctgactcgtgtctcccactcttgaactaggaaaggagagcggaagarctccacactgcagttgtagtccgtgaacaggaaagagtatgagccctcggtcttaaactcgcgcctaccagaagcctcaaaaaccttcctcttgtccttgacagaatgcctcaatatacaaaccagagattcccacatgttcctgttgagtgaatcgccaacaaaaactagccttttccccctcagcctctccaacatgtcggttggattcaatcttgggatgttgcatccactgggttgccaccggagcttctcataagctcggtccggccgaccattgagatggcagtcgaagggttcatcaatgtgaggacacgatcccccggggtagagagggt

SEQ ID NO: 76767 - DNA, 265 bp, Triticum aestivum
  Clone ID: PAT_TA_76767
ttctcggtgacattcgkcatgagagttcacatcgcggcatcccctctctgcgactgctagcatttggggrggcsattaaggcatttggrgkggktgragtgtaactactgggattcccagactagtgcaattcctggtgttcgastagaactaagctcagtattgcgtggsaccgctcarttcckgaagggaraagattckgaaagtgcraaatcaggktccraaaggargacgttcccaaaaacatattttgaatgccagtaag

SEQ ID NO: 76768 - DNA, 580 bp, Triticum aestivum
  unsure (1)..(580): unsure at all n locations
  Clone ID: PAT_TA_76768
aaagggaggtgtagagvggagtatgggtrgagtgattggtgtgaagggggtrtatttgagaggatggktagtggraagttgtgggaatgtaggaggaaatgggtggttgtttgggtgngagttggggagggaattgagagtaaatgtggttattatgaagataaaggagargattggrgtgrtggaggatatggtaccagataaggaaaactgsggattggatgastgtgtgggattaaamagcaagaaagaacgtgaagagttganggtbgagcsgtgcgaagagttggatadgtsgtgsatsaatgtgggtaaggggggggagatcnagatgagvggggsaacncacgtagaggtcatggtgttgtgatggttaaatataatggcaggctggggataaactagagagtaattattcagcttttaattatcttagsagaagttatggggacagttataccgagcttgrtcgtgcamgacttggggaggatgttgagtaaccyaaaggagactattgttgggatagggstgtggcgkggattgttgctggtaacggtgggtaacattamcttgacacggc

SEQ ID NO: 76769 - DNA, 283 bp, Triticum aestivum
  Clone ID: PAT_TA_76769
gtcgcaaccgttgcagatcagctgccacccatggcaggagtgagtgtggatggctggatgcgaaggbgtgaggacaaacaggagtgaacgtcagtaacttagtttgctgattctgagagctcaagattttgaagatcattatgttatgagagctcaatatattgatatccgaaacaaatacccacgatgcagaagagatgtattgtaatgamatttcttatcgttctatgcatcgctatgctattacacaatttgttatataasacttgttgatcctccgggt

SEQ ID NO: 76770 - DNA, 163 bp, Triticum aestivum
  Clone ID: PAT_TA_76770
cgttataaatccccagattaaagcccgcttcaaarwhcatygcgatacgtggccccggatgataaaggggygatgcttgtgggctmamcgttgacctgttttatcagtccgtcgtgcgtycctgaaaaccccccaagtagvgcatgcgcaaatgctgcgcgct

SEQ ID NO: 76771 - DNA, 462 bp, Triticum aestivum
  Clone ID: PAT_TA_76771
aaattcttaatactcttcgcccacacaacamrttctgcgraacaaaacacatagcctatgcggracaaaccacacaatctccrtctgtagctcgacaaaaatccatgctccggccttcggcgtaaaacaggaacgagaagcttgcgcgattcaccggactttcaccaactccacttcatagatgattgktgaatctttgggcaattctacgaccaatttaccaccattgtcgcacagggatgggggaatggttagcctcctcttctctccaacgcacataccagtaataccgaggttccatccacgcatcactttctcagaaccaagcttaaacttgtagggcttttcctcgccattagaatgaacagtttttccatcctgcagcttgccaacataattgatataaaccttgttgccctctgaagccactttggcatcttggtttcctgctgacagatcttc

SEQ ID NO: 76772 - DNA, 561 bp, Triticum aestivum
  Clone ID: PAT_TA_76772
tttattagtgattagtgtggttgcgggcgaggtttygtttgggagggkcgtkaaggcaattaatgskaaatkggttttattttttgsttkaaggaaagagaatgtattkttttgtktttagmgtgttttttagagattttttgtttgttgtggtgsgaaaaaggagagagtagaaaaggtttgtgatattgtgaagagggagsttggggttggtgatgagaatgtagtttttgggttgtttaagtttggtgatkttggtggtgatttkttggataaggttgagattgtgatgggggttgaggagggttttggaatkagcgtggaggagttgagcgbgcagawtattgkaaaggtggaagaaggggggaaadttattgagagggttgttgyaaaataaawatattttttgggaataatgtggtaargaatggraawgttggtggtggagatggattgkatttgargtggtagattttawtgtggagagttggtgagatatgtatkagtgtttttgtgtgtgttgcgatattaagarattatttattaagtggktgttgaagg

SEQ ID NO: 76773 - DNA, 352 bp, Triticum aestivum
  unsure (1)..(352): unsure at all n locations
  Clone ID: PAT_TA_76773
acccaasctncaagaattccctcaaaatgccaaacttcaaahcacaaacagcatggtttccacctstcttccctatwctgtcaattccttcatcaggatcccccccataaactkggacctctttkgacttgcagaagttctctatwctgtcatctaattcaacaaccaagtaatttwtaattccaactcttttaatattartaaaccacatctcaaacatctwtwtcaccctagaatttaccactgcaacmatkatttctttcttcacaacaacctcttwcaatatcttaaccactctygaattggtggattcatcaggcctgactcttggatttattctaagaaacttcac

SEQ ID NO: 76774 - DNA, 303 bp, Triticum aestivum
  Clone ID: PAT_TA_76774
kasrcttcaaatctgaatagkacataagcatctcaaggcacaaakctgaatattacacaaggttcasctcgcggtkttsagaaatttgcmagaagtragagaggrgagaagcagcagcagttcagagragractaggagcgagcaaggagrgaagrgcagcagcrggkgsgtgggagrgggggcagcgrgcagtagtaggggttcaaggaagaaagaagrtgcagcgagcagggatcgtgaggagagggagcagcagcagttttggagagrrggaggagcagcagtgaggggaaggagaggar

SEQ ID NO: 76775 - DNA, 310 bp, Triticum aestivum
  Clone ID: PAT_TA_76775
caaagcggcagakgcggcatkgctttcatccaacatatttgttgtyccactacattccataccgtgcttttgtcggtgcggtgtgcatatttttttgtttcacttttgtctgtgtctacaccagttagtcagmcmccatgggcggtgyccatcttcatcatcatcatcatcttcttcttcttcttcttcttcttcyyctyttycttcttcyyctyctyctttggatmcgtgtvgcgtgcggamtaaagttggtcgaccaagctamcgggaataaataaagccycmctgtgctagcagtgtattccatgtt

SEQ ID NO: 76776 - DNA, 193 bp, Triticum aestivum
  Clone ID: PAT_TA_76776
ctcggatgtggaaaaactagatgcaacatttatggaaaaaaagagatggatttycccccmmcbctbgcctgtccctsccactyccccggattgtwttgtgaactgagtcttctmcgttccagtgctccatcttcctataaatacatctgaaaaagtagcaggaacaggcaacagtttgcaarmmavtgamggt

SEQ ID NO: 76777 - DNA, 541 bp, Triticum aestivum
  unsure (1)..(541): unsure at all n locations
  Clone ID: PAT_TA_76777
cctgatgcgttggcstgcytsccmagtgcwtgyctttycswtgwtttwtgtggggcamamaagcawtwtwtytgtttggtgtmattytggtgattytcaytgaaggatgtgatggaagtatagtagtgtgatgatgatgtaaraaaattgtgtgctcaaytgttggattaaatcaaratttaagtataawaatgtacttgccgggggggcggttggahwttgawttycggcsgsggcaatggggggggaagaatgvraggtgggggcaaatttgccttatagtaartrgtattaaaattaattggsggtsgttttaaaaggtggtgattgggaaaaayttggggttaccaaatttaatkgctttgaagaaaattsscttttngsaagktggggtaatarrgaaraggggggaaaggatkgcmttttaaaaaagttgggaagttgaaatggggaatggaggggcgttgtaggggggaattaagrggggggggtgtggtggttaggcgggggaacggttaaatttggwagggsttargggcgg

SEQ ID NO: 76778 - DNA, 337 bp, Triticum aestivum
  Clone ID: PAT_TA_76778
gkccagggtcctgtgggagaaaaattcaggkggaactagrkatttgaagaagttgagattgattskttaaatatgtaagamatttgcagaaatttatggaggttttaaacaggaaatcatggtagagttgggggrgkkrsgrrcrcatagccatgtcttcttcctccatcttatgtgagagctgggttgttcacttgttgggcgaccacttgagtctattactgtmatatatttccagaattaatgtatacctatgacaacaggtatattgttcttctgamacaggtctaatgtttcatcgacacaattacaatttattcatagcgtgsttaamagt

SEQ ID NO: 76779 - DNA, 268 bp, Triticum aestivum
  Clone ID: PAT_TA_76779
acttttttactcatgtgggtttcggtcttttgactatatgtggttttcaatcttttcatctcttggtttacttgtcattcttaatttatccgccttactattctcagtcttgttttttattgagagacacaaccttttcaatacacttctattttaatttttcataacaacggctgtttttttgttgcaactttgactctatgctattaaagtaaaccaagtatattaaaataaaccaactatattcatatatgcctcagtaattggt

SEQ ID NO: 76780 - DNA, 305 bp, Triticum aestivum
  Clone ID: PAT_TA_76780
gtgttttcamttgcatagctcacagggttccaacatttacaccacttgastgstctgastcctacttgtgcatggtcccaggtcacttgartatggtggttcctccgggtcaggcsttatttttgggtgaggttgstggkcccttcctaytaaccttcaccctgcttccccctgccyccctagccttgaagcccyctgayttcagaaacccgaacycgcttgggttgagaggagstgcctagggaaacactaactgaggccttttagccttcgacaccaccaatcaagcaaccccccagcctggg

SEQ ID NO: 76781 - DNA, 309 bp, Triticum aestivum
  Clone ID: PAT_TA_76781
acgaacttgccctgaatatgtagaccttgaacaatgccctcttgatcagctggaacaccaagcaatcaccttcaactagctcattgtcgacggcaaactcgctccacccggtgataagactgctactgtgtggacgataaagcaccttaaactcctcctcctcctcatccaccaaaaccattctcatgcgatggtccgggagatgctccatgctgaacagcgaggtaagagactggggcatgggtttgacaaaggtggggtagtcggagcctagctcatcctgtagctcttcggccttggcgatggcgt

SEQ ID NO: 76782 - DNA, 187 bp, Triticum aestivum
  Clone ID: PAT_TA_76782
acattcaacactgaactgacgaacaaactcggcaaacacccaaagaaacctgtcttgaagatggaggaattaccacttccgtgctgaagggctatttttttttatgattgttccctggattcacttctacccgccactagcccattcaagtctttgcaaagcctggttggtttttgcaacattatgt

SEQ ID NO: 76783 - DNA, 203 bp, Triticum aestivum
  Clone ID: PAT_TA_76783
acatgatccatagagctgaaagctttaacaaaaggcatcatatgctttatgtgaccacgctcaaaataatgttgagcacaattatccagatactttgttctaattgcagaaacctccaaagattttgaattctcaagcgaatgttcctcctctaactgctgcagaaactgtaggcccagattgaataattttttccctttcga

SEQ ID NO: 76784 - DNA, 237 bp, Triticum aestivum
  Clone ID: PAT_TA_76784
agcaattgcgcggccatcgtcyccgttacgtgtcgcgacggaaggacggagacgygccggcgycccakggaycccctgbgtaygcattcmcctbgtaataattcttactggtcatatgttttgtagytctbgcaatgcatcaagcttcttctyyttttgtytctcycatttttgttgttacagaacyytymcttgtaaattagttgcaaatcaatggaactagcaggtcatggtggg

SEQ ID NO: 76785 - DNA, 528 bp, Triticum aestivum
  unsure (1)..(528): unsure at all n locations
  Clone ID: PAT_TA_76785
gttttctgcccttggctggcggcctggcgctcccccccgtgcgtccttcvgtccttctktccggbsgcggcggggggrctcccggcggcgggcsggttgtcctgttgttctrtccggttgtgccctgctggttgtcctgctctccsgctgrctgcsgtggtgttcttctcgccgtttgrcgmtggctctccmgggttgcctctccmgatttccgccgcmgccgggggggtgcccgtcctctttggcccgcctagctgcccgcccagcttcccccccccssccgcscgcsccgggccccgccgggttcctgctccstctgctcccgcsaggcctgcscggcctdttscsttttcccscggtwcnggscggctgcccgacmttycttcgcttyggccctctcctgttggggcsccgctcccccttgtccttgrgttgctttycscgcccrgvccggcttttycggccgmgcccatccctgctgccccttycgttggtctccctggtgctccggctgtctttgcccgtctg

SEQ ID NO: 76786 - DNA, 397 bp, Triticum aestivum
  Clone ID: PAT_TA_76786
ccaccaaggtgtctgcccaamastytttcctccccgagcacataatgtctttcmcmtggaytagtccgrcatggtaatgyagttaccyatttccmatcattcaattgcytgacctastcamatyasagatggtttagaacttgcagatttcccattacgggaatcttgsttggcgsttcaactgtagtaacagccttcttcacatgatgattgtccgtgtatgtcttcccatcaggaggtcgttcccgtcaattatctttcattacattgcggggattcaaaagrgcatcacaaggagcttatctcctggvagttgggratcgtagtsaggaggaacctcatggtgscctgaccaaaagacmgtacstygggggggascacgstaattgaattcccg

SEQ ID NO: 76787 - DNA, 179 bp, Triticum aestivum
  Clone ID: PAT_TA_76787
gtgcaaattatccaatgttacatatgtcaatgtgctattatcaaaragcaacaaccaagcattgccattctatactgctggtgttgatgcaaatttcgattgacgtcattagatcaggtccttcggttttttvaratttttcaagccctgtttggmacgccgaacatttccctgccact

SEQ ID NO: 76788 - DNA, 163 bp, Triticum aestivum
  Clone ID: PAT_TA_76788
ttcatggtggtgacgtatgtmttgatgatagtccagtttgawaaaatgccaataggagcaggtctgtaaagccaataggagccagtmagtaaactagtgatgchgtctcactgtwcatcgtctctagacgcacctatatrawccatgtatctwgtttctctcc

SEQ ID NO: 76789 - DNA, 170 bp, Triticum aestivum
  Clone ID: PAT_TA_76789
agttaactcatcaaatccacgacatcaaatacaacataaatacaacaatgttcagcatacaatacaacaaagttcattcacaatacaatagacatagagacgaaactaggggtattgttgcccgtgtcacgcacatcattcgtgcatgacatctttttgaagatcatggt

SEQ ID NO: 76790 - DNA, 201 bp, Triticum aestivum
  Clone ID: PAT_TA_76790
gtagtgattggcggggkgggggccggggtagatggcaggatcgkgtctacagtaggagttrggagcgkctgtrggtagkggggtttggttttgtkgaactgacktgaggtgcggtcsggtatccattcattttggccgcgcggcgctgatcrgtgggggggrkggrtggcccattaaattgatgcaatgcacaaaagtggt

SEQ ID NO: 76791 - DNA, 677 bp, Triticum aestivum
  Clone ID: PAT_TA_76791
ccrggcttcctatgcccctactgtagcagattagtaagttagattgaaaggttattttacagctcaaacttaaaactcttaatagrgrtataccgctarcgtgcaacagtgtattaccaacttaactagctcttcaagtgctacaaagtsgtttgtttctgctatgatgacttccagtaaaacctcacctktcaattatactaccctgacsaatacggagtaagtaggcttggaagcgcacaagcctcggtctaactggagtcgccaggtaaaattaactccacctacttattcaactctaaaatctgttacaacggaaaaagtaaagtcctgtttagtctactaaccacctacctcttggtgctagactccggcaacatctactaattctttgactactatgaattctcattctctagacactgacccttccccccacaattaagagttggagttaaccaggcctgaaaccttgttatatggcagtggctttacaccgcaccattcaacagggcccaaaggagacttctatttgcgcttactctaagaccaacgaaagtgctaatatcaccaactccttgacgtattcaaacaggagagtagctaggacacytagagtctatawtygccgtgctytaactagcttgcacggcttggaactgtatacacacaagaga

SEQ ID NO: 76792 - DNA, 300 bp, Triticum aestivum
  Clone ID: PAT_TA_76792
ccactytctcaccatcsatsacgaattgtctcacctgatggctaasamytccttcaabaattttayaatkatacgcagcagcaactttctgaattggttcagtgagatkgttattcttcttgcgaggtctaagaagsgtcattgcracttctgctgctgtgtttgcagcagcaagaacattagctgctcttccagtaaccggcccacctttsatgacatgtgtatgagcsaccamagcaataaaagbatcaatatggcaagcsatatcgatstthacgatgtaattttatttgagtacct

SEQ ID NO: 76793 - DNA, 265 bp, Triticum aestivum
  Clone ID: PAT_TA_76793
acttataatattatgkgcatgtgcatakacatagccatcggtagcattcacatacgagcatgctttctcgagtgcatgtcgggaacatggacatacacatattcttatcttaggaacaaacaagaaagataaatggaaaaggaaaacccaaagcaatgtcagagttgacaaaaccgcaatggcactttatatgtggcccgtggtgagtgagctgtttaggccttgccggactcctcgcagcccggtggcttgaaggcgatgaagc

SEQ ID NO: 76794 - DNA, 197 bp, Triticum aestivum
  Clone ID: PAT_TA_76794
gagtaatgcgaggacgcggccgtggatcaggatggacgcctccggcagcagcagcagctggaggtttgggtgcgggthtatgcagccccccgccggttgcgcggtagtcgttgttccgggtggwggtggtggtggtggtwwtgggwwccgtggtwccgtcgtctwcwgcwccttwccttwctccccgcttttttttt

SEQ ID NO: 76795 - DNA, 413 bp, Triticum aestivum
  Clone ID: PAT_TA_76795
cgtcctaaccaacaacaactwcgcctccaactwcgtcgtcctctacgcgctcctcgccctgaaccacttgtgcggcagtcaggcctgcctccagattgcgtwcggatgttgagccgtgactgcggcgacgccwgccacctwtwtcwtcctwcwgagwwgwwtwctcwagagagatagcgacgagagacggaaggtaagtgtcgtgtcgttgagagaggtttawtagaggtcggcaagcggacgacacagttgagcgcgagcgagcgagctagctagccaaggcaggtttawctgacggatgttaaagcaggcccagcagatgatgctaaagtggaaatttgcgacagaggctgccatgatttgctctctagccgtgcgatstgggagactcgagtagggaagcccacgacagg

SEQ ID NO: 76796 - DNA, 222 bp, Triticum aestivum
  Clone ID: PAT_TA_76796
ttcctaatatcgaaactctgagttagctttataatgcccgaaggggatctaataatatcaatgtacatgtaagttccctcttaagacattctactactactatcatcatatcaacctactctaaaacaactgagtgtgactcaggttagtctcctttctgtatataagcactagagctcctctatctatgcacgacgttttctctagctcaaagcttactgg

SEQ ID NO: 76797 - DNA, 355 bp, Triticum aestivum
  Clone ID: PAT_TA_76797
acattttactaccatcacctggcaatcctcctacactcgcaaccacctaccaattgcttgtaacaatccactgtaattgccaagtcaaatagtcaatgtgtgcatgcggatggaaacaccttgtggcggtgatctttttttacagttggtggagaagatgatagaactgtccaaggagaacgtgaacgccaagaagggtagcaccctctcgcggcgctgtggcagctgcatctggtgaaaggtgacctgccatccatccatagtcgtgctcgcaggaggatgaggaggaattgtggtgtttatagcagtaacattttctttccggagcggggtcgtatagtaatttactagtagt

SEQ ID NO: 76798 - DNA, 394 bp, Triticum aestivum
  unsure (1)..(394): unsure at all n locations
  Clone ID: PAT_TA_76798
cacaccctatacgacctccagctascrgccgcnttaactcatgagtaatgcgaggacgcggccgtggatcaaccacgcggactaacatctttkgctaccactagaggttggtggkgtcttggtaccagtaggtgtctctggtgcytgttgccctgaccttkactacatgagcctcctgcbkagaggaacaagtcgcgtgaatagctgtsccacaccagccacttacattwcccgcagtkttkacaggcaaggtgtcaaantagaacttaaagtggrggttgctctaccatkagsctcaggsagaaaggrctacaaaccaggancagctttaccaattwttattcaccttttctagctgatccaasccggkggggcgsacgkttaccktaacccg

SEQ ID NO: 76799 - DNA, 186 bp, Triticum aestivum
  Clone ID: PAT_TA_76799
accgtgttccgtatatccgcagcagacgcatggcccagataacagacctcgaaagcaaaatgggttcatccaacttcatatagtcggtctcgacaacgatggggggaagccgaagtatgggaggacgcgttcgtggttgaagcatggctttgtcatcctacagattttmttaagttctgaagtctg

SEQ ID NO: 76800 - DNA, 264 bp, Triticum aestivum
  unsure (1)..(264): unsure at all n locations
  Clone ID: PAT_TA_76800
cacgttgcgccacccgacggtggtgatgtcttcgttgggncccaagccagcctcwctccwgctggtcgggagwtctaccaagaccgaagaagactcccaacamcgcccgtaggctcagtwaccaagcctcaacaaggtttgaagtgcwtgaaacaawggtgcactactaggcctcaagacaacthawacttgtaggttagasacacactbttgtttagtthtgtgtttttggrctgcaagagagaggcgtaggaaagasccgag

SEQ ID NO: 76801 - DNA, 216 bp, Triticum aestivum
  Clone ID: PAT_TA_76801
cgcccgggctggatcactaagctctgtatcaatggrcactttctataatttaccgcttttaacgtccattttrctctattakatkgrtkaccawttctatttttkaacctctggkgktcaggttaagktcagcaatgacggtcttdcagktsccctwkgckactacgsacacaaccaatgccaccaccaaaaacacaacaaacaacacaactgcgg

SEQ ID NO: 76802 - DNA, 293 bp, Triticum aestivum
  Clone ID: PAT_TA_76802
aaagtctatacctccccttttgcctcgtgyttttayttgacacctacctactataccttcaaccaaacactgcctgcgttsctaaacaaattatactgaacactcttkkacaagagtgagtacttagaaaggagctgctaggttgwatayayytcagcacaagaaaccacaaycyaggtttagaggtactactgcttcgtccgcacggactaccctgaactagcgccctcctttktataacctgtacccgaaaagtcacagtttcagtgctctacagagtaaatgttctgcta

SEQ ID NO: 76803 - DNA, 351 bp, Triticum aestivum
  Clone ID: PAT_TA_76803
tggatcwagcctctaccaactgtcagagcttgggctaacggggcttcagggcttgtgacggttcctgtgcacctctatgctgtccaatcaagstccaagggtttagggagaatacttcdatgccacccgtctacgccgaaagttcwaaacacaggttcaacagagggaagacacggtggtcggccgcggcaactagtaacttggggaccacgactaagggaagagtgttttgttggaaattgcctatataataggagaagtagaacttgtctggcaacctgacaactcgctgttagaactggctgtctaaaccaacatggacttataatgtccacggccgcgtcctcgcat

SEQ ID NO: 76804 - DNA, 298 bp, Triticum aestivum
  Clone ID: PAT_TA_76804
gctttctgccctgtgttttacagcagctgagcttaggatgttgtccgtctgawagttatggatgggtaccagaacgagtagctcttcgtacttgtctgaactcttgccaaagcttatccacttctggtgccaccaacagcttaawctgttctcagacacctttttctgagtggtctgactacacttggcacactactgcagatgctgtgactgcagttggttctacactacagactcttctcgtaagttgctaactgctgtttcacacctttgggatccacggccgcgtcctcgcwtt

SEQ ID NO: 76805 - DNA, 219 bp, Triticum aestivum
  Clone ID: PAT_TA_76805
grggtgcgagtgcatcaktgrggaccttsactractgctgckcaggttggacacccccggkcacatcagtgcctatavcctttksagtaacagactcsagaaaacttctttctactggcacactcacatctgcctccaaaartgctcttctaatatcccccatccgttcagcgatattctcctttgtsagtcgatcgacgcctcccagcttktkccacg

SEQ ID NO: 76806 - DNA, 193 bp, Triticum aestivum
  unsure (1)..(193): unsure at all n locations
  Clone ID: PAT_TA_76806
cacacgctcacgtctctacacrcacaccacctgggntgcangcacctgcamacmcgctgcncacaacctcacacacgcggacgcgcacgcgcgcacgcactcackcacacgcgcactcactctcactctcactckcacgcgcgcgcacgctcactctcccactcacacactctckcactctctcacgcacgct

SEQ ID NO: 76807 - DNA, 261 bp, Triticum aestivum
  Clone ID: PAT_TA_76807
actcagtaatgtctattttgtgacgcgtcttctttcctttyaggacctgcacaagtttcggccaaggaaccatcatcgggcagcagggtgtccccggagttctatgcmacamcggtcattgamctcggtaagccttgcacagatagcctgtgcaatgatgaatgcatgaagatctttccaggtcctggcaactgtgagaaaggcaagtgcttatgggggttttgctgaagaagaaaggcctagcttaactggcatagcagt

SEQ ID NO: 76808 - DNA, 169 bp, Triticum aestivum
  Clone ID: PAT_TA_76808
acctctccacggcgtcgtgtgggcctgcggcgtacagttggtgatggcgaasggcgctcggctccggctcctgttttcaagaatgaggattttggytctgcacatgaagtagtgagtgtatgattgtatatgcggaaggcaaaaagagcctccgaaatgatacccatga

SEQ ID NO: 76809 - DNA, 444 bp, Triticum aestivum
  Clone ID: PAT_TA_76809
atcaccccaacccttctccaaaccaactcttwggaacctatwgttwgatattcaaaactagggaatatcttctaggaatyastagacttaakattactcttctascttccttaaaggagtaactagaraccashaaagagtctaaattctatcaktcaacatcattatcakacccttataattatagggtttcaagaaattaaacaaaaggkaaaaastctccttatcctagaacaacttagaaaacaarggacaggtaaaraactacaccccagttccmrtagrcttagacatagraaggggsggggarragrgattaamaraskcaaaatcaaactcaaacacaaacttactastagsatactcatccacaaactattccttcaatacbaaatattcacamacaatcaactcttccacaacgagstcactaacattcaccca

SEQ ID NO: 76810 - DNA, 199 bp, Triticum aestivum
  Clone ID: PAT_TA_76810
ggaggtactaatsttaagcttgtcaaggagttcggaattgaccctaacaacgcctttgcattctgggactgggttggcggccgctatagtgtttgcagtgctgtcggtgttctgcccytatctcttcagtatggatttccaattgttcrgaaatttctggagggtgttccagcattgacaaccrcttccacacatcttg

SEQ ID NO: 76811 - DNA, 289 bp, Triticum aestivum
  Clone ID: PAT_TA_76811
actgcaagttgcatgggtagcagtggagaatccacacgcttgctgttgtcccttgcagaggtccaggaaaaaragtgtagtggttcaggaaaaatagagaggagctgctctgttattcatttagtcaatattttggcctatctccttctgtattatgatttccatcttgagaaaaaaaaggcaaaacatgtaaagctgtatggttgttctatgtttgcratttckkgkkttgtggagaattaaaggatcgtgtaggcttgcccttgaatccaactgtttttagtttttt

SEQ ID NO: 76812 - DNA, 219 bp, Triticum aestivum
  Clone ID: PAT_TA_76812
gagacaaaaggagcagtttacattactgggcccactcagggccaaagttgtgagccggccggttgactcttststtggtgacggccacatctcccctggtgtcgccctccagcgcktcatgccttattgttgcgccttgttcaccatcagccgttgtcgtgccttgatkgcttggcattgttctcggaagaacaaccttktctktttkttgaacacagt

SEQ ID NO: 76813 - DNA, 326 bp, Triticum aestivum
  Clone ID: PAT_TA_76813
acattgctcctatgacagycatggccatgatgggaaacayggcaagtcagacgaagctcgacttgatgtccagcmatasmcggymagacmymmycacaagaccgcstgtgtctctcacmatcctgagcgttaggacaccatgcagasgsaggasttkaagggtgtcaagtycggcaagaycaattcgtgccatttcamaagtatataggggtagcaaatagcaactaccattgtgccagtcaccamctcactcaytyccctscyggtaammccatcatcacttaatagamacacatggaaattgcagacactgctgaccagtytgc

SEQ ID NO: 76814 - DNA, 313 bp, Triticum aestivum
  Clone ID: PAT_TA_76814
ccgcccggacaggtctactgtctagtgataaagccttgtcactcaagctctgggacatggacaataaatkgtcctgtattggtatatttkacrtacgtggcactgtgagacaaataatgtttaaccccaaacataccagcactttcgctactctttgsgrgggktactggtccaggggccatgtcatacagatgtggaaaatcgatcaggccagttctgtccgcagaatatatatcamtaacgttgagaccatcgactttttcacttacactggtgatcagcattttattgctgamattsacaacaagattgt

SEQ ID NO: 76815 - DNA, 310 bp, Triticum aestivum
  Clone ID: PAT_TA_76815
aaactatacmgatgttmaaatgtattgccatgtcatatcaaataaaataacaaaatagttattttcagccacaaaaacatacatgcatgactacatggatatamstaaacaaasggaaacaataataatcssaggcgcggcggagcacgtttgttcttgtactatgtgtatatgtgtgatggatggggcaaacacggcggcctctycccatvgatgmcccgdmattvgadctacttccggtcggtgsgcatgttgtccagttcatscatgtastcacgatgcttsgagagacagaacctgcgcaccccgt

SEQ ID NO: 76816 - DNA, 218 bp, Triticum aestivum
  Clone ID: PAT_TA_76816
ccgaggtcggccgaggtacaaccgccgcttcgtcacccgccgtcgtcggcttcggcaagaagcgcggccccaactcctccgagaagtaggcscgccgcmcccccsgagccaagaaaaaggctcttcctttgcgctagttttcctctcgtttgttgttacgcaagattatgatgawggaagagacattactgaagtgttaaagtatgcatgttttgccc

SEQ ID NO: 76817 - DNA, 359 bp, Triticum aestivum
  Clone ID: PAT_TA_76817
ccagtcacatgascacggacgcagagaagcgtgaacatggtgsscgaagcagggagacaagggatgctcagcccgaacaggggatacaacctagctagacctaccaaccctgaaccaagagtggcaatgssgrvscrgsaagaataccarcatcgcgaaascaaatcggggtcaccacgagcgagtaagatagcgccttcaagaaggaagaacgacgtcgagacgccatcgccatscggkccggagggrccagacctagggkttcacctgascttgaggrcggggctcgcsccgagggccttgacagcgsstccaagtagaaaawcgasatccgcaaacgcsgccgctgctagcaccgg

SEQ ID NO: 76818 - DNA, 225 bp, Triticum aestivum
  Clone ID: PAT_TA_76818
cataccctccaacccacccactttaatttaatttcctawattacacctaacttactscgagataaaagrrgrtratagtaatttattactaccacgacaytaggtaatcgaccacataatccacattatrcctgccatgstgtgttattgctsgtccatgatsgggacctggccggscggcsccyggaartgagtagkggagggggggggaagkggaggtggrcg

SEQ ID NO: 76819 - DNA, 468 bp, Triticum aestivum
  Clone ID: PAT_TA_76819
acacatgtatgctcaaattcatgaagcaagtgacatgcgatgagtatttggragataagatcaacagaragcttcaatgtgtattcagcatgaactcaccatcttttgctacacgacataagcctaggataacaacatgtgaacattgaagatacgtcttgcagaaactatgaccatcatgccttgctcaactcaacctgacataagcattcttcacttgttttctttcttccatacgcacttactttggtgagaatactcctctctaattgtccatccttcaacatggtaatcttctcaacatcacaagtcgatctttaagaggagcagcaacctcatcaaatcccacggagcccaaaattagcaacttgcagtcaccatggcttgcatgatgtccaacggtctccagtggggtgtcagacgtgatggccgaccactgcttccgctcctggttgcagcacctcggcg

SEQ ID NO: 76820 - DNA, 236 bp, Triticum aestivum
  Clone ID: PAT_TA_76820
ttattcgcatgattcaracgacatgccttttacaagtgcaaaagtgtcgggcgtgtgcttgcsttcagaatttagratacatatttcaattgagctcagcttgcssggggttactcgtagccgcaagtcwcagtctgtcaggttccatgacatttgtcgaatcawcaacattgcawgccawgatatgcactcattgttctgaaaatctgcggaacagatcatgaaacatcaagtgt

SEQ ID NO: 76821 - DNA, 275 bp, Triticum aestivum
  Clone ID: PAT_TA_76821
actgctccggccttctctctcggtcgctttctggactggacaggtggatggctatggcttcaggaggrggcrrggcgrrgaacaagtccacgagtgcgtgcagcggttgctgtcscggcggggcggctgactccgaccgcccgccgcgccgcggatccagggggaaattaaccaaacatggacctgacctcatttaccggccggcctgattcaacaagctgttcggaagtgcatgggttcagaccacatgcyttcctcgggtcamtgtmtaccgt

SEQ ID NO: 76822 - DNA, 161 bp, Triticum aestivum
  Clone ID: PAT_TA_76822
acatttacatatccgatggccatcaaaggatttgattgcmtgctcaaacagtatgctcgctttcctcccaatggttrtcgaaaktaccggcgkatacgattggcgttaraagtatggggkgagtaaacgtcagtmtgaggcaggaggggtgtgttgatsgt

SEQ ID NO: 76823 - DNA, 604 bp, Triticum aestivum
  Clone ID: PAT_TA_76823
acagcagcagcagcaggtcgagtgagaggacaattactgaccaccacggaggcggacaccaggtggagggtggactccttctggatgttgtagtccgcaagggtgcggccatcctccagctgcttgccggcwaagwtcaggcgctgctggtccgggggaatgccctccttgtcctggatcttggccttgacattgtcgatggtgtcagagctctcawcctccagagtgatggtcttgccggtgagggtcttcacgaagatctgcatgccaccacgcagacgcaggacaaggtggagggtggactccttctggatgttgtagtcagcgagggttcggccatcctccagctgcttgctagcttakatgatacgctgctggtcagggggwwtgccctccttgttctggttcttkgccttkatattktcgatggtgtcagaygactccacctcwwgggtgatggtctttcccgtttttttyttytywtwtttytkcttctttwggcggtggggraggaggatcgacaagccccgagtcgatcggagacgagatyagcyyggkayyybyygggtccgctgccgacccgcccggccggccgcccgacccg

SEQ ID NO: 76824 - DNA, 242 bp, Triticum aestivum
  Clone ID: PAT_TA_76824
ttaatataaatmcttcttaatctaaatatwacaaaatamcaaacacataaattacaaacctaaatctacaaaaaawatayccaaatcttctatwacaaaatcaacwaaatatwacaataaaaaaaaatacataaataaaaaactwactcaaacatcccatactctwtctaaaamcctaaatcaaaaatacatatcactaataattccattctcaaatcaaatcaaaacctacccaaacaacc

SEQ ID NO: 76825 - DNA, 293 bp, Triticum aestivum
  Clone ID: PAT_TA_76825
acttccctccacaaggggctcctcttcctgtatgccaatcagtcagttacatccaaagccatcaacggggtgcaatctgtgttattgcacaagctccggcatcagcctcagtaggaatgamatctcccgctgcgtgaaattgggcgtcggcgcggcatctttcacagcttggctgcccagatcattgacctccgtgtcggtctccgggacagtcatgaggtccgacacggcccccgtcmyctccggcacgasgtcgacgatgaccccgttcacccccatcasgtgctgcatgt

SEQ ID NO: 76826 - DNA, 472 bp, Triticum aestivum
  unsure (1)..(472): unsure at all n locations
  Clone ID: PAT_TA_76826
agyataggacaaatwtatyaatccaggaggcaaaayatgastsamtcgaaagaaggagaaaggmrymcctatytycayscasaggggsttatgagnatggssatsttsggtaacaggttggcgntaaggsagsgtggmtcasasggggtgggaggttgtaggttgtcathtagatgatgtttggaggaatgaagatagatagggcgagggaaggatgtgtgcgtggtttargggtgnatgnattaatgtagtagngaagaaagtagagtaggggakgttgggkgngaanagggtaattgaatttktgcrggggnaatgggggggggnangsatgcaaagtngggggcaattwggagtatagtgagttgtattaaaattaaatgggggttgttttaaaaagttgtgagtgggaaaaawgtggggttaangaaattaattgcgttggaggatatkdkggtttwggkagctgggt

SEQ ID NO: 76827 - DNA, 196 bp, Triticum aestivum
  Clone ID: PAT_TA_76827
acccactaggttcatatttgattgaaccaggatcctgctgttaagatgtgtaactgtgtatggcacagcaaagtttacattctgtgcggtaaacgggttagtccccttcctgtgttgttcgccaaaacggacgcttgttatcctctctaaaatggcagttcagtcttcagcaaggtgcggcgcacttcgatttgag

SEQ ID NO: 76828 - DNA, 354 bp, Triticum aestivum
  Clone ID: PAT_TA_76828
acatgtgtaacctacatgaccacattaatgttattacaaatcaaatgacagctggcaggctgctgcrcagacaactgaatgcatggactgacgttatggttctttcaggcaattgccctgctgtggaagacacaaaactgtcttgagagcttggtcctcattttcttcagtcaaagagatgtagctccgtcatattcatcaggraactatatgagtgcagacaatgacacatccaaactttgttctcatttagtgtatccaagactgtaaataaatatactaactatagagcgtgcgtagtctgccactgtatgatcctacaaatatgcttacatattagavataattgcatgt

SEQ ID NO: 76829 - DNA, 660 bp, Triticum aestivum
  Clone ID: PAT_TA_76829
atcaatccttgctgctcaaaggaaagcmagccgcaaggattgatgataaacaaacagaaaagaataacaaggggctaatcaattaagacgtctttagcagcacatcatccaatggcgccaataccaaacaattgatgtcaccaaagtcgtcactgccatgcatctgagaraattgtagtcgaggccatacacagtgcaggggttgtgccggcgagaccttggaccgggaggaggcgaccttggacaaggagtgctggagaggctcctctggcctggccgagtgaggagcaggtagccatcagtcagtatcttctccgtggcccccttcacgcaaccagatgggagcaaaccaggagagcattatgatccctctagcagttgcttccaatctggcaagaattgctcgagcctctaagaccaaccattcatgtaggcataccaccgccacctgatgagcgagcggcttgatggttggtccttcatcttcgcctcctcataaacagccagaccaagtagcattcaacataatgctcgattctggcgcatagttcttcaatatgtaagagcagataaagatacacacctccttatgtctgacaagcaccaaaacctttgtgggaagatgaaccagtgtatcgtaggagattagcaagaagcagt

SEQ ID NO: 76830 - DNA, 187 bp, Triticum aestivum
  Clone ID: PAT_TA_76830
acaaagacctaatcaagcaagccaatcagaggaaacataaccttgctggtcaacaaaacattgtccaggcccatttcaagccatcttgrrggktcaatrtgttgarttcctatcaatcaagataagactgatgtaatagactggcgtaaaactaatgatttgcagtatatgataaacaaccttttgt

SEQ ID NO: 76831 - DNA, 247 bp, Triticum aestivum
  Clone ID: PAT_TA_76831
actagatatttcacataattccttcgtcggagaactacccaccaatgttcttggtctaagacaaacatatgcaatggatttttcttccaattgtttcataggaagcattccagaatcactcggaaaacttaacatgctagcctacctaaatctatcatgtaactccttcagaggctctattctacgcccattagaaaaactaaaaagcttggcatcattagacctctcatttmacamtttctctggt

SEQ ID NO: 76832 - DNA, 392 bp, Triticum aestivum
  Clone ID: PAT_TA_76832
acaacatcgtcagattctgcaacgtgggcgtgcatgtcatcgaggagcacatcctggccttcctttggcagtgaggtgacaaattccgccagctccttgagcagataagagaatgactgaatatcgacaaggaagatgagccgcagcaacaagtccaatactttcttacagggctctgtgctctcttcccatgacctccacaacgatctgtcctgaatcatcgcagtagtgcaaagatctttggctttcacaacaaggctatggccccccmaaagaatggcagggctttttgcaggaagatgctgaacaagcgccacaactcctgacgctaatccttcaaatggagttaccccaggataagcctccaaggatctcctgatatagtcaaaggc

SEQ ID NO: 76833 - DNA, 317 bp, Triticum aestivum
  Clone ID: PAT_TA_76833
acctttcadatgttaaatatgctgactgamaatgctgcagttgcttgggaagattcagggcgtattagttcctgtgggctcatttagttggatctsacwtggcgggggactttststgtctgtctcgtgtgtgatgsyacctgacwgmttgtcattcasatgamtatgtggtagtctagcaayaygtttgtcaaagactttcgtatgsttgtmtttttawdattagawtgtttgtwttytctgttgggtgatgtawttctgtacagtgtttggtgtatatatatttdttggtttgatttggatgttggaggstatgt

SEQ ID NO: 76834 - DNA, 445 bp, Triticum aestivum
  Clone ID: PAT_TA_76834
actggttctgtaggaacacagcttctaagtagcaagccatcatggagttaagaccaacactttcttagtgccctcatgaagcttccttcagacagatgtcacaggggctagggccatctttacacctttgactgttgaactgttcgccaaagtgacccagaagagtttgcctgcgacactcagtcttcagctcgcaatacgcctgcattttctttgcttggtccattgcaaccttgaaggtttcactcttgaagtyatcagcactcctcagcatgcacacgatgcggctgaagtctttcttctgayataacaccacacaatgcgctggaaggccatctcttccagcccgcccagactcctgayagtagctttcymtcgatttcsacagcgtgttgtggacaacaaagctcacatcaggcttgtcaatccccatgccgaagbattt

SEQ ID NO: 76835 - DNA, 193 bp, Triticum aestivum
  Clone ID: PAT_TA_76835
accgtgcttcccaccacccgcttcgtcacgtccctggctcgtgaagaacgtgactcgtcttggcaaaaactggtctgargggccccgtcgaggcccctggacacatagaaatacaccgccgtctgctcaccacaacggtcgctggatgcgaggacgatgaggccgagaaggggccaagcgcaccgcgggaggc

SEQ ID NO: 76836 - DNA, 511 bp, Triticum aestivum
  unsure (1)..(511): unsure at all n locations
  Clone ID: PAT_TA_76836
tttttttcckygcgmgttccctacttgycgctsagayagcgsgtgatcsccgtgtctcccgccscccggtcgcagacattcgggctgsttycgcacgctgmagawttctattcgatttctygsctgggagggtgagstattttacctttggtaactgacavggssaactataamaacymtatgttcaavgttcggtcgttggttttgggttsgaatgttgttggggktattggstatgttggggtntaatttctattgggattgttgtgttgttgtacgttgggamtattatgtgttgbgaaamttattggcctggactaattggtggggaggacgtgttgtamctctygttgaaatgtgttnaaaatgtttccgcgtggggttatycttttygttgtttaggatyggaatttttdcttytgacctctycccgctgacyygtcatctctttggaatttttagagcaaggatcagaagtggaatgtatcttcattaaaagtggtattadgta

SEQ ID NO: 76837 - DNA, 635 bp, Triticum aestivum
  unsure (1)..(635): unsure at all n locations
  Clone ID: PAT_TA_76837
ggctagaaagccacgtgtagagcggagtatgggtagavtgattggtgtkaacckgstatatttgagaccatcgttactgcmamcttctbggaatgyagcacgaaatcgctccttctttccyggcagtggtdataacgbttataaakttcataccgagggttttggggatgttavtggtatgattggaavtacccgtaccgggabtactaccgttttgaccggtgttattattatacgttatcsttctngyygtcyaggatcggaatttbtdkttyttgacgtytycccgsgtgactkgtcatcgctttggaatctttagaggakgcatcagaagtggaatgtaccttcatcaaaagtggtgatcahgtayccggggtttacntcaagtttggtaaggattttaastggtgtgatttttaaatcttgctactcaggaggtkgggggctttctgttcgatctttaatttggtggaactctgttakcggasytcggakcgtctbtttatagctygttgaagggtktcctcccadakcatcaagtctttgwygcttytagtgtaatttggttttaggtstttgtattaaatctaaataatttaattaaatatcttgtcaatcttcctaaattttcatgg

SEQ ID NO: 76838 - DNA, 555 bp, Triticum aestivum
  Clone ID: PAT_TA_76838
acaatctaaacctttcagaatacaggtatatatgctgaaagttgtatacaccaaaaactgaatgavacatgagatgggaatggataggctaagctgcctccgttgcaaaaccaaaacaaatacacatagcaaccaggagccttcctcagctgcttactgtttccagtatcctaataagctaaagaacagtggatgcttccctctattctcgaagggaagctccaggagtcccactagaaatcgagctgcgagccttgcgtcgaggaggagcaactgcctgatccaccagacgaaggcccactcgacccgtccaccggggcctgattcagccgttctagcaccagcgacctcctctttcgcagcttcagagaaaatgtggacgcctctmatatcacaggaacctggctgttggtctgtgccaccttatgamcatgtagaaaaccaaccatatcttgataccctgtmaggagtttcgccaagtccttgtcctcatctggggattgcttttattgacagcagcgtgtctgctaggtgctgccatctcttgcagavaga

SEQ ID NO: 76839 - DNA, 197 bp, Triticum aestivum
  Clone ID: PAT_TA_76839
ttacgggacaaccgaaccagagagaaggycctttgcctggcscctgatcggagctgagtgggtagtgatcgatgattagggagkgagtttcctgagatgcgtgatgtgtctgtgatttytatytctgctcgcacggtgyccgrgggkgttgtgtggctagttttctctttcagtgcgcaatttcaatgaaatttsgg

SEQ ID NO: 76840 - DNA, 344 bp, Triticum aestivum
  Clone ID: PAT_TA_76840
acacatttccagccgctctcctggaaccttcggatgaaaattgcccatggagcagctaaggggctcgcgtttctccacagtgagmaggccaaagtcatctaccgtgatttcaaaacctcaaatatcctcctagatgcagtatatatatccacagccttgaaggatcttttactttgtgtccaaaaratatctctatcagtcgatctgacagtcagattttggcctggcgaaggacggaccgaccggtgacaagaaccatgtgtccacaagggtgatggggacatatgggtatgctgcaccagaataccttgcaacaggccacctgaccacgaagagcgacgtgt

SEQ ID NO: 76841 - DNA, 240 bp, Triticum aestivum
  Clone ID: PAT_TA_76841
agaccttttagatgtttaagtacaagtgtgyacgttatgcyttyasgattgatgccatyaagkgggkgttttgarggaataatttgckgkatttgttatgcagtcatttattttttttytagtaggtykatttgyataattaaagttttgtgagttggccsgtgtatgaaattgtttttcacmaattttagtatttttattttttggaargtgaayattgtattatgttgawtgwttttt

SEQ ID NO: 76842 - DNA, 237 bp, Triticum aestivum
  Clone ID: PAT_TA_76842
accarccaggtggcggttcattgaacgtgggattatcatgctgccacgttctgctgctggagccactcctgggatggygkgacggagggmcsatgttggggcatcahctcgtcgtgctcgamcggcaggttggtcatcgggggacgtgtcgctgcccgtvctgaaccagctccggatgaaatcgccttcgtaggtgaagccgtccgccgcaatgtgagggtcgttcatcacatcctg

SEQ ID NO: 76843 - DNA, 198 bp, Triticum aestivum
  Clone ID: PAT_TA_76843
tgagattagagtttttagatgagttgatgstgttgtgaratttttgaatctccyyagttgsttgsttcaatttggagctaaratgammcaatgcgcaagagaggatatgcgtgggcgaggattyttgtaaaagtkagggagagsgtggaatcgatatagtttatkaargatatgtatttgtttaattatgtgtggtaa

SEQ ID NO: 76844 - DNA, 272 bp, Triticum aestivum
  Clone ID: PAT_TA_76844
caactcgctagcgtcctttcgatacgtccaaattaactaggaggctgagtgaaacgtcgtgcgtctggtaaacacrtggcaactcgaarcgtttttatgacaagcttagtgasgsgagaatgrcaactcacggagcgkttttttggttgttttttttcttttcagacggcaactttagtttagaaaacakscragggcscggrktgtttcgtgcgacacagacrgcacttatcatttgggttaattaattttacgagacatagtagcactga

SEQ ID NO: 76845 - DNA, 337 bp, Triticum aestivum
  Clone ID: PAT_TA_76845
cgagctcacacaccaattgctgtgaccgagacgttcgggatattggcgttcaaggatttacggtgaagaagatcacggcgctcaggcaggggcaccacagcttctacccgccggcatcatggatcatgccttccatcgtatgatggctaggtcatatttgaattggtaaacatgatcggtggaagcaatttgactctgcccattgaggcatactctccattttacagtagccatttttttatttctttgcaaacaaacccctaacttgtatgaaacatgtgtaagtwttattggaaatattttwawctctgatggaagcaagataatatttarttaa

SEQ ID NO: 76846 - DNA, 175 bp, Triticum aestivum
  unsure (1)..(175): unsure at all n locations
  Clone ID: PAT_TA_76846
tctgctyccgatcagactgctgacyggcgaacacacatcttaccatgttggactctgctcgcactacgcccgcchcwtyttgatttaatbaattatktactcgtwccggtttattmttattcgaataaantccatcgatwctagtaaatttccggtattdgcgcagacagtagcg

SEQ ID NO: 76847 - DNA, 196 bp, Triticum aestivum
  Clone ID: PAT_TA_76847
agracaaaawcatagaatattaatataarrrrrtcmtagaatatgccttatgatgatttcaggtttttcaactatcaacccagcctgagagtagagttgcctgagcaaggggaatcatttgrrccctatragsgaccaatamtgctaaadttttgctcaaggggtctcagaattcaattttcvagtaaacatctgt

SEQ ID NO: 76848 - DNA, 217 bp, Triticum aestivum
  Clone ID: PAT_TA_76848
cgccgacgtacamcmyyccyaascacmttcmttacaccgggtcataaagattctcttgcttggtaaagtwtttggttgaaagtwctaaracgatgatactgtwacrwtycgatggagcyctgctwatbtyctggctccttgccctgatggrcaccacacdwctgcbctgcyhcctgcmgttctytccctgctcaccatgacccgcctcctcatcttt

SEQ ID NO: 76849 - DNA, 208 bp, Triticum aestivum
  Clone ID: PAT_TA_76849
aaggaattgtagagttggcgtgttaaaattaaaataaaakggtwgraaraggtaaggkaggtaaggtysttgttaaarattaaagatgggraaaaagggatgtttkcaggtaaaaatatgataaattaggtagggttttggaaaggggttggkttttggggaaaagaattaatagggyaagttgggggggaaaaaggtaattgaattt

SEQ ID NO: 76850 - DNA, 175 bp, Triticum aestivum
  Clone ID: PAT_TA_76850
tccccaaccccaatccaagaccaagagcaacaggcccccmysavcrccatggtcgcatcgtcgcttaacccggaggccccgctcttcatcccggcagcgttccagcaggtggaggacttctcaccgcagtggtgggacctcgtcaagtccaccgcbtgghttcgcvaccactggt

SEQ ID NO: 76851 - DNA, 402 bp, Triticum aestivum
  Clone ID: PAT_TA_76851
agtmttactgatggtatctttcctgtcagcmatcttggcatagtagtcttgasagttcactgacaaagaatacggagcaccacgaacaatcaccacaacaaacaagaacacagttccaaaaaagagcatcaatgctttccagtggattgawctgaagtaagaccttttgcactgtttaagcatacagacaggracatttgcagtcatagggattacgaagatgccagtagtcatagctagctcaaggtctcgctgaaccttaactgaagagaagtcagctttaadagaaatgagcattcttattgattcacttggtgctaagctaaatcccttgcagttgttcaccgtaaatccatccaaaccacaatcaactccagaaacttttacccttgtgactcgaag

SEQ ID NO: 76852 - DNA, 526 bp, Triticum aestivum
  unsure (1)..(526): unsure at all n locations
  Clone ID: PAT_TA_76852
tcccacccaccacaacaaaaaccacccccataaaawacaaayaccactcacaatacctcaaatwncccccmacmtcncahycttccccccccattcccccccccmaaattcaattatcnynttcccccccracthacthacaagttmtttmacwttaaaaattacacacttctttatactatatcthataaamatnttcaatawattaaaatcayccctcttataatcctatttatatactctatwtwaaagccctatattcctcttkagattctttctatttaakattgtaanckcttkaaktcattcasgcatcttcttcatkgcaacaagaagrtbgatttcatcgagcaattcartgaaaascttctagttaagcaggatggggasaacckkgaaakkcgggatgtgacaraskggkagatgagagrrgtgrgcagcaatgrgkgtgtgackccatcagtttttatttttttttwayttkccgggcggccgbtsggartgactaggggaggggcggcscccg

SEQ ID NO: 76853 - DNA, 252 bp, Triticum aestivum
  Clone ID: PAT_TA_76853
gcacaacgaagaracaatatraaggaggggrtcagccaggcgacgacaccaaccaaatcaccccaasgaacaakacaaatactgaracagggaaatggtgtaggcaaaccagatgacatgsatattgaccaaggtgcgaaccacbytcaaacataccacaggttctaaaccaaacaccacacagcaracaktcagayagacagacagcagrkraagccagtcgggcaggtgagagggaggraggcttggcgt

SEQ ID NO: 76854 - DNA, 216 bp, Triticum aestivum
  Clone ID: PAT_TA_76854
acaayaccayacacaaayccgccgtggaaaccccgaaccyycaycaacayaaggccggcacytatytgcagsayagcacacccgatgcatgcayagagaycaygagtgtgtgtatctwcttcgtggggatttgggagtcgctgggcacaatcatatcactggagctgttgcctttawtaaggagatcaatatacactcgaaagaaaaaamacaaag

SEQ ID NO: 76855 - DNA, 545 bp, Triticum aestivum
  unsure (1)..(545): unsure at all n locations
  Clone ID: PAT_TA_76855
ccsccccaacccccnmccaacccaancnasgccmccncaaaaccaccacaccccccccccaaaaacccccccmacacagcccgcccanaccccaanccacccccccaacccccacaaacccccamcccccccccccmcsacccaasaaaccccaccccccaaaacaamcanccccaccaamccaamcaacaacccaamccccaccmamaccccacccaccacccacmaaaaccacccccacaaaacmccaacaccacccacaaaamasccaacagccccccaccccccamkcgcccccccccaccccngcgccrcgaagkcgayggcgascgccckgccggccacggrccsgggsgasgtsgkggcgaaggaggggraggcggcgkgsccaccakgaaggcsaaggscrccakccaggkcgtggastggygcsccacgggskykaagtgcggcatkaactaccasccccbkaccsaggtgcccggcggcgacctggccaaggtggagaggscsgyctgcakggtgtccaastcsaccagcgtggt

SEQ ID NO: 76856 - DNA, 697 bp, Triticum aestivum
  Clone ID: PAT_TA_76856
cgaggtcgagttttgcacttgaattttttttatatttcttctttatgaagcataatggaaatatcacaggaagtaatgatattatctccaatctgctgctaaatgaaaccaagttaagctgtcaaaatcctcttattcttccaaggggtgacgattgtgttacggaagaagaaaggaatatcgaagttcaatggctttgtaaacagggtaaacagcttgaccttggattagacactgttggagcagcaatttcaatttttgatcgtgttttaacccaaacatgtgttcgttcaaaatatgccaattgcgtggctgtcacttcattgtacattgcaattaaacttttcgaagaaagccttgactcaatttgcattgaagacattttgacggatttcaatgtcgattactccatcaatgaagtcttgcgcatggagcgtagcatacttgcaaaacttaaatggcatttaatttttccaactgttgaacgattcatctttgctatgctttcacaattgggcactgcaatcaccgtcgatccaactgcattgcgagaaaaggttgaagaattgttcagctcctggaatttaatgtctcaatatcgtccatctttgcttgccttaagccttatctctgtcgtcatgcatccagacgaagacggtcttgaaagtttaaagctttgtgctaagcttatgaaaac

SEQ ID NO: 76857 - DNA, 689 bp, Triticum aestivum
  Clone ID: PAT_TA_76857
cttactgaagttagtttgtccatgtgtgcttatgtgaaaatttacttcagtagtcttgatccaccacttctgataactgatgtgaaatgctttctgttaatcgccttagatacgtggaggaaggatgtacagcctggcgatctaaaagacacaataaatgaggctgcaccagataaaatcaaatctttggtcgtgtcagaggtctcacgtgaatttcatcctaatttttcagccaaatggaggacatacctgtatatatttcctcttgatggggatgctaaatcaatatcagaggatgagcaatcctctatgatactagagaatcctgaatacaaagcacctcggagctttgatgtggccaaggttgacaaaatcattaggcaactggaaggaaaaatgctatcttacaaaatatttgcacgtgacacacaagcttcacgtagcgatggcccagctaccgagtgttttatgttccattctcgagctgcagtgaccaaactgtattctgctgatgagaattgcaaagaaggcacgacggtcatgtgtgttgagctagttgcgaacagattcctacgcaagatggttagggttcttgttgcgaccagcatcagagaggccgctgctggagccgatgaagacgccttgctgaacctgatggacgccacgtgcaggcgcgcaacggctccccc

SEQ ID NO: 76858 - DNA, 716 bp, Triticum aestivum
  Clone ID: PAT_TA_76858
gtgacggtccaagaaccgccagctgcctccgctcccgaagccaccactccaatggacacggcacctgtagaagcttctgctgacccggaggcctccggctcggctcaaccaacaaatgacccggacgtggtaatcacccgggcggagttcgttgagccggggagacctaccgtgctggccaagtgctccgctaagggggagttgctgcagccccaccgggtgaacctggacctctccgactacgccaacctgagcatcggagagctcgtctctggatacatcagccaagtgcacaagagccgggacgcagaggttgccatggtgaaccagatccagcagaagtctgaggctgttggcaagaaacttgaggctgaccttgctgatctcaagaaccggctaaagatgcaagagatggagacccggaaggcaaatgccaagttcgtgtccagcatcgccgcgcaagagaagctgaagacggagttcgacgctgagcggaaggcgtgggccgaagaaaaggtcgcactggtgaaccgggctgaacaggcggagaaggctctctctgagaagaccgccgagctctccggcctaaagcgccaagtgtcccagatggtggccgcagtcttcggtcccagaagtgccaacctgaatcagagtgtggtgaccaagctgaaggccgtatacaccctggtggaacaactctacaccgggtcacaacg

SEQ ID NO: 76859 - DNA, 627 bp, Triticum aestivum
  Clone ID: PAT_TA_76859
acttttactacaattttagttttacgagtatgaaccctttggtttggatagcacttggatttattggtatgagaggaagtacaaggtggcatataaatgttgaagacactggcggtaatacgccacacagtgtttcagtttataggacacctgaaactttgatttcagctggtactaatatacaagaaggtaaatatattagtatagcagcatcgactgtcacttctcaatcaatatccaagggagcattttggaacaatatgtcaggacttggtacttctggcatgtatttgaccaacagtttaacacaaacaggtattggtattgagttacctatgatgagtaattataagtttctttacgctaaacctgataattggactgttggaaatggagatgataacagttatatagacacatatcaagttgatgttatggttcatccaactgtatcatcagctatgaaatttgctataatacagaagaatgacgccgtaggaactgatttcaatttccattttttccttaatgctccacaaatttactataatgcaaacgctggatctgttccagcgtagctgatagtaaataaatcaaaatcccctgaggtgcgggggatctcctatt

SEQ ID NO: 76860 - DNA, 465 bp, Triticum aestivum
  Clone ID: PAT_TA_76860
aaatatccagttgcgatgcagctttcttttgatgggatgtgggtttggggcatcttttgatgtgctaaatatctgcattctttgcatcttaaagcactctgctcttgccttttgttgtaggacatgatccgggcttcagtaagccatggtcagatcatggtgccgttgaatacgagtgcacaatcacagcagaatgttcaggatagcactaaaaaacctgtgtctgtagccatagcgtctggtgctgatgcagtcgaagagaaggatggaaatgaagttagcgatgatgactgggatgatgattgggacactttccaatctcttcccgcaactgctgccaaggatgatgcacattctgctatagttgtttcacctattcctgaacagggctccgttgcaagttctcaagaacagatccatcagggaaatactaatcatgatattggtgatatggatgtagcagtg

SEQ ID NO: 76861 - DNA, 681 bp, Triticum aestivum
  Clone ID: PAT_TA_76861
gggacgccttcgaggtcaagatccgccgctggatccgcgcagcccgcgccgccgtccgcggcgttttcgccagcgagcgccgcctttgcttcctcatcttccacgaccttcccctctccaaccccaccatcgccacccccgctcccaccacgactcccgccgcccccttcgtcgaaaccgtcaagggcgccgcgctgcagctctttggctttgccgaggccatcagcatcggccgccgctcgccagagaagctcttcaagatcattgatctgcacgatgcactggtcgatctgctgcctgatgtctccgatatcttcgccgcctccaaggccggggaacccatatatgtgcagacaaccgagatcagggcgcgtctggctgatgctgtccgtggggtactctctgagttcgagaacgccgttctccgtgacccctccaagactccagtgcccggcggcaccatccatcccctcactcgctatgtgatgaattacattgtcctcatttccgactacaagacgacactttctgagctgatcgtgtcacgaccatcagctagctcgcgtgttcctgccgatggcaatgatctcacaccgtcatttcctgatctggaccttcctgatcctgacagccagttaccactttctgctcatcttatctggactattgtggttcttgaac

SEQ ID NO: 76862 - DNA, 580 bp, Triticum aestivum
  Clone ID: PAT_TA_76862
aggcaccttctcacctccccattcccctctcccccgcccacctgcaccgccagcgcccccattccgcctccgccccgcccgccgccggatcccacagcttctcgccgccgcctcccgcccggcctccgaatcgccggatcccatcgggggtccccgctgccgcagcttccaccgccggggaggtcccctgccgccgcccgcccgcccgccccccgccgagtgttgtggaagctggacacagctggaacttggaagcaggccgagtctatggtatttgtgggtcattgtgctgtcgatgcgagcagagagcatgcgtggcagctgttcttcgggtgatgcacctgagcagaggagctgccgatgcagtcggttggtcgacgattggactgtttgttctctttgctgctctgggcctctactgcattttccagtcaatctacttctggtttcggattcggaaagggaccttgctctcactcggttactttaatggtccctgggtgactcgcattgctctgattctgatcactatttggtggggagtaggggaaattgtgagattgagcttcttgaagagaaa

SEQ ID NO: 76863 - DNA, 771 bp, Triticum aestivum
  Clone ID: PAT_TA_76863
ggcacgaggcaacagcttgcactgttataagtgtacttcttcaattgttgggtttgacaaatgggctgacttgtttgagactctgagactgtgctttgatagtcaagacctgaaccaaaaggaaggtgctgcagaaactatctacaagatatgtgagaactttcctgaagattctattgttgatgctggtttgcgcgatctactaatatatgactttgtgccaagactcatgcagctttttgaaagtcctcatatgagtcttagaagactatctctgctttgtgtgaaccagtgcatcttcgtggttccatctgtaagagccccccccccccctctcatatttcacctaatgattttgatttatttgcaggaggctttcaggaatcaattccttcagggcttacttgaattatcaaagcaaacttcaacaaatgtcaaaaaattggtgtgttcatcatggactctgctcatggaacgccagttaattccagagctatatttggaaactgccattaatttcgtcctgctagctagcaatgaattggatgaagatcttgctctggaggcctgtaaattttggtcgtactgtgattccagcaaagggttgcaggaggtcttgccagaattaatcccaactttggttcaaaaaatggtttatactgatcatgatgattctctggctgatattaaggaatatgaatccatttccatcagggaccaggatctgaagcgccacttccatgcgtctcgattacatagatttgaaactgg

SEQ ID NO: 76864 - DNA, 652 bp, Triticum aestivum
  Clone ID: PAT_TA_76864
ggcgatgattgcaatgctttgtatgttgacggacctggtacccgattggatgccccagccaactctatttctggtaaccttttgattgccgatttccgttctgaatactcaggatttattgaagacactgttttgcccgccgatggtattgctcttaagggtattgttgttcgtgccacttctggtgctgacaactactatgcactcaccgatttgaatggtgcctacagttttgctggtttgcccgccggtacctacgaagtccaggctttggctcttccttcctcagtatctgcatctgaacgacccaacttgttcttgggtggtttgagctctattacaagtggtgatccatttgacgatgcttccagcagcaatgttggacgctttggtcctgccaaatctgtatctactccaggtactgctaacttccgagtattgttgaacgaccgtcaatggaatgatcccaactatgagatgcctcagttgctatatctccgtttccgtgaagataactacttcaatggtaatggacgtagtgcttcttactggatctaccagatcgaccaggccttgtccggttcttgcccatctgctgactacagtgaaactttgttgaatgcctacaacaccgccttggccaccttggttg

SEQ ID NO: 76865 - DNA, 716 bp, Triticum aestivum
  Clone ID: PAT_TA_76865
gaggggattgtagatgtttttctcctgaagcttgtggaatcattgagttagcaaatacatgtagattagtgtcagatgtgcttgatttgttaccctgaagctatcttagataatgtaagcatgtctggctgctatgttgaatcattagattaatgaaatctgtagacatttgtgttacatacgcttggccctatgatctttaatatctttattaatgaaaaaaatatgctgctgctgtagaagcttgtccatgcatttctgtttgttgttccatcattgtgagcttgtccatgcatttgtgtttcttgttccatcattgtgagcttgtccatgcattagtatttgttgttccatcattgtgagtttgcctggtctgcttctttattcttaccatcacccttgaggttcttctttatttcttgtccatgcgattcttctttgcagatgcagatctttgtgaaaacactgacaggcaagaccatcacccttgaggttgagtcgtctgacaccatcgacaatgtcaaggccaagatccaggacaaggagggcattcctccggaccagcagcgtctcatcttcgctggcaagcagctggaggatggccgtaccctcgctgactacaacatccagaaggagtccaccctccaccttgtcctgcgtctgcgtggtggcatgcagatattcgtgaagaccctcactggcaagaccatcaccct

SEQ ID NO: 76866 - DNA, 251 bp, Triticum aestivum
  Clone ID: PAT_TA_76866
tcggcacgaggcaaggctagagagagcgttaagattgagcatgagaagaagctttctaccctgcaaagcttggaatacagagggaggggcagtgccaagctggacaagaccaaggcctccataaacaagctgcaatcactgatcgttgttacgtcgcaagctgccactaccacatcctcagccatcgtcagcgtccgcgacaatgagctcgcgccacagcttgtcgagctttgtttcgcgttgctgagcat

SEQ ID NO: 76867 - DNA, 690 bp, Triticum aestivum
  Clone ID: PAT_TA_76867
tcggcacgaggacgaaaccctagcggccgaatcgcgatccccttcccgtctccgtcgcgacggctccacccctacccctatgatcgtcgatcagatgccgatgccgcagaagcggcgccgccgccggaggaggcctcttgaaggagtgtcccgccggcgccttggtgacggtggcgcatccttgtctggatcccttgtcgatccggactctgatagcagcagccgtgtggatggaggctctccgccgcccggactccccgacgacgagcctgctatgtctggatccgtcgtcgattccgatggaggctctccgccgcccgacgagcctgcaacagagccaaggtaccatgaaattgttgcctcgcgcctcgcccaattggaattgccagtcggctcggaatgggacttggccggtttttcagatatcccttcccgtgaaatcctcgaagcccttactcgtaaatctttccatgatgatgagtcgcgagctgctctagtacaatatcaaatccagtgtttcttgaacgaggagacccaggagggacgagacagagattcacaagattcggccgtcgttgttgttgctgaaccggccaatgatgctatcacgaagcagcaacacaaaagcgactgtgaaaagctaggggcccgcatgactgaaattgagacttacaccgaactggaccaaga

SEQ ID NO: 76868 - DNA, 768 bp, Triticum aestivum
  unsure (1)..(768): unsure at all n locations
  Clone ID: PAT_TA_76868
tcggcacgaggcgacaaccccatggaacttttctgcatacttgctgtttgtgaaaagcaaaagaaccctggggaggcacttctgaataaagcgaaacaaatgcagtggtctttattggcgttgattgcgtcatgctttccagatgtaactcttctctcatgcttaagcttttggcttgagattacagctgcaagggagttgtccttaatcaaggtggatggtatttcctctaaagtagctaagaatgttggatctgctgttgaggtcacaaataaattgccaagcgtgagtaggaatgttgaatatcgttacaacaggaagaatccaaagcggagacggttcttggaggcctctccagatagcttcaaatcaggtttttcgctggacatcgcaagtgggccaaatggtactgcaacttccaatccttccgatattgatgctcagcaggaaagaagaaagcccacctctgaagagactgaaattccagttgatattgatgagaggcttgcatctttatcaagtatagtagcagtgctgtgtgaacaacagctgtttctaccattacttcgatcctttgacttgtttctgccatcttgctcccttctccccttcattcgntctcttcaggcattttgtcaaatgcgcttgtccgaggcttctgcacatttgacatcattttcagcaaggataaaagatgaagcctctcaatcaaactcattcaaagaagcatcatcaataacaggatgggtagttgctacagctgtaaaa

SEQ ID NO: 76869 - DNA, 776 bp, Triticum aestivum
  Clone ID: PAT_TA_76869
ggctactcaaaaagtgctgaaatatcttcacaacaattcattgagcttgtacatagaaactggaggaataggctacaggcagcatcagtgaatgcactggagtcctattgcatacaagtaaaaaggtgcactgaaatagctttaagttgtgtggaggttgaccgacataaaaggccgactataggaaacattcttaatgagctaaacgagacggaaacttcaagtcaatttcctgatgcgttactaaaggaccttgagccaacaaagaaccaggaaagccagcaaactcacataacagaagcagaagaaaaacgggagagagaagaactaatcgaaacaacaaattgctttggcgaagtagtcgacaactgcaaattggataaaatggcgaggtacatgggcaaacacaagacacgggaagaccgagcacgagaggcatggaacctggtggacgagcatgacaaggacgacgaagctttcaggtatgtcaagggtctgaagtccctgtacggcaatggacagtcaacgttgtgccgtttgtataatgccaccggagacaccctctaccaagtcgccaactacgactggtctggccacatcggcagggctccctacccagctactattggcaacggccagtgggcagcatttcatcacatccaccgggccggcgagtcatcaggttcggtagccgctgtcgtgtaccgtgggaaaaataaacatggccaagataaggattacatagttgcctggagtaccccatgtagtttgtggca

SEQ ID NO: 76870 - DNA, 384 bp, Triticum aestivum
  Clone ID: PAT_TA_76870
cctctgcatcgcgcaatggcgccatggatggggttggtgctggtgctggtcgtgctgtgcgtgcggccggccgcctcggccaacaccgtgccggcggcgtcgtacatcgtccacatggagaagtcggccatgccgagccccttctccagccacctgcgctggtacgcctccacgctcgccgcggccgcgccgggggcaaagatgctctacgcctacgactacgccacacacgggttcgcggcgcgccttcgtgaggaggaactcgccgtgctccgccgatcccccggcttcatctcctgctaccgcgacgacgcccgggtggtgcgcgacacgacgcacacccccgagttcctcggcgtcggcgcggccggggggatttgggag

SEQ ID NO: 76871 - DNA, 726 bp, Triticum aestivum
  Clone ID: PAT_TA_76871
cctttgtactcagctacctctggcctcccctagtccacagttcagctcagctccaaggagcaagcaaagcggaagccctcttccagcctcaacacaagaagatatggaaacggaggtcggctccccggccaccgccactgcggcgcccatcaacttctcgctgccggtggactctgagcacaaggccaagtccatcaagatcttctccttcggcaacccacacatgcgtgccttccatctcggatggatgtccttcttcacctgcgttgtctccacctttgccgctgcgccgctcatccccatcatccgcgacaacctcaacctcaccaaggccgacatcggcaacgccggagtcgcctccgtctccggcgccatcttctcaaggctagccatgggcgccatctgcgaccttctcggcccgcgttatggctgtgccttcctcgtcatgctctccgcaccagcggtgttctgcatgtcagtcatcgatggtcctggaggatacatcactatccgattccttattggtgtctctcttgccacctttgtgtcatgtcagtattggattagtaccatgttcaatagtaagatcatcgggacggtcggtggcttgacggcggggtggggtgacatgggcggcggtgccacacaactcatcatgcctctcgtctttgacggcatcctggcatgtggtgcaacacgcttcacagcatggcgcattgcatattt

SEQ ID NO: 76872 - DNA, 697 bp, Triticum aestivum
  Clone ID: PAT_TA_76872
ggacgagggttgtttgttgtttgattgattgccttgagatggattgttgtttgttctttgattgattgccttgacaaggtaaacacctaggccaattgattgctgtttgttgccttgagatggtatgtttatatggcaccattgattgctgtttgttgccttgagattgtacatgtttatatggcacgattgattgctgtttgtgtatggttattaagattgattgctgtttgttgattggtatctaactttggtgtatgtagttcctgatcataggtaacagacctggcactactcttttttctgaattcttttgtgattatgtcttatgtggatatcatattctttttttggtattactgttgtccagcccttggaataatgcttttctaagtatttaaggtacagacatgttgatctggacatatcacatttgctctttattgtgttgctaaggacactgatgggttgagttggcatatagtgcaggtatatttacattctttacatttcgcgatgctgatgcctatagtcccaaagcatttatttacctgatatttgcatggatgttttcatgatggctaatttgattcattatcgttgttctgatggtgtgcttctggtggtttaactgaagccgtggatcgctcatcaacctggtatgtctttggatgataatccctctcgaatttaactc

SEQ ID NO: 76873 - DNA, 759 bp, Triticum aestivum
  Clone ID: PAT_TA_76873
gaggtgggaaggtagtgttttctatggtagaattagtatggtgatatactgcacatactcaagccataaatgcttccacgatagtgtggcatattctctgacttcattcctgtgtgttctggaagaggaaaaacaattatgtttgtctcccgccgtgttctggaagaggaataagtattccaacactgatagctcagttagtgtgatatggagatggtttattccatggaagagtagtcaccactttttgtgaagataattcccgagactcaagacattggtcatgttaaagctttaggtgcttggagattatttgctgacaaatctactattgtttccttctaactatctgctgccatttctcattatatcgttctaatatatctaccaaaaaggatttgagaatgcttgcttatttattaagaatttcctctttctttgactggagcttttttagttcatggttgatgtcaatttcatactattaggtggttgtcgatagtgtatgttaagatggaaacattttgccaccaggtagcgtgatggcgtagtcaattttctatctgattatgatcttattttacagggttatagtgcaaataaaccatacaaccaaatgattgttccaaaaattcaaatttgcctttgcacatgtacaggagcatcatggattgtttagtcttggagttccaaaaaaatggttaacctgtgtactacagaggtaatggaacacctactttcacctatatggggttaatg

SEQ ID NO: 76874 - DNA, 771 bp, Triticum aestivum
  Clone ID: PAT_TA_76874
ggctccactgtgttatgtcatggggtgaaggcatgaggtcccagaattcttcagtgtgtgagtaccataaaagttggagagatcacacaagaggattcaaaataaaaagaaatatactcttcaaaacaaaaaacaaaataaatgtcctcacaaaaaaacaagtctaagaccccgtataatacctactactactacccaaagtaagcagtgtacttggtgaactcagatttgacttactatcaagagatcgtacaataattcaaaaagaaaaaaccttccaaaagattagaaagaaagactcccccctccccgtatacttttgtacagttaacagttaacagttaaagccatcacagtccccaagaaataaatagatacaaaaaacaaaacaaaaaacaaatatacccaaaaagaaaatttttgaagaaagaaggctttcatatactactataaaaaaattttgaagaagctcttcttttctaagtttcaattcggttcgctaaaggccccctattatgactgagcaaataataaagtttcaataaaatcgtcctgtattatttgttcctttgcttataatttccatttgtatgtacaagtactcagtctagttcattaaattattggagagacaagtttggaagacgttagaagccctaccaatatcttatatagagataagacttacaaacagcttctatcttgcctagctacttgtgtaaaacttccaaaaagtaaaatacaaaaatgaaaaaaacagtgatgggctga

SEQ ID NO: 76875 - DNA, 571 bp, Triticum aestivum
  Clone ID: PAT_TA_76875
aaccgcccttaatatcctaccttctaaataagaagatatggggggcaacaagaacaagtccgagtacttcgacaagctcaagagcttgctcgagagctacaagtccgtcttcatcgtcactgtcgacaatgtcagctcccagcagatgcacgagatccgacacgctctccgtggagagggtgtcgtcctcatgggcaagaacaccatggttcgccgtgccctgaggaccttcctcgtcgatacccccgagtacgagcgtctgctgccctacgtcaagggcaacatcggcttcgtcttcaccaacgccgagctcaagggcatccgcgacaagattctcgaaaaccgcgtcgccgctcctgctcgtgctggcgccgtcgcccccgttgacgtgtggattcccgctggcaacaccggcatggagcccggcaagacctccttcttccaggctctcggtgttcccaccaagatcgcccgtggtaccattgaaatcaccaccgatctgaagctcgtcgaggccggtagcaaggttggcccctccgaggctaccctcctcaacatgctcaacatctct

SEQ ID NO: 76876 - DNA, 777 bp, Triticum aestivum
  Clone ID: PAT_TA_76876
ggcacgaggtgacggccatgctcaccgcgcccaacgccgacggccgtccgctcttcgccgccaaggacatcaatcgcttctacttgcaacactgcccaaatatcttccctccggtcagcaaagggcctttcgggttgttgaagaccatgaccggaccaaagtacaacggtgagcacctccgctcggtcgtcaaggagctgctcggcgacacgcgagtcgatcagacgctttcaaacattgtgatccccaccttcgacataaagcttctgcagcctacaatcttctcaacttacgatgccatgaaggatgtctccaagaacgctcttctatcagatgtctgcatcggcacgtctgccgcaccgacctacctccccggccaccattttgaaacgaaggatgaggagggtaagccacgagccttcaacctcatcgacggaggtgtcgcgtcaaacaatccgacgttgctggcaatgaccgacgtgagcaaacagatattgatgggaaaccctgacttctttcctatcaagccggcggactacggcaagttcatgatcctttcattgggcactggagcggctaagatcgaggagaagtttgacgttgcccagtgcagcaagtggggcgtcctcgggtggctctacaacaggggtgccactcccatcatcgacagcttcagccaggctagtaccgacctcgtcgacatccatgcctctgtgcttttccaggcgcttcactgcgagaagcgctacctccggatccatgacgatgggctcaatg

SEQ ID NO: 76877 - DNA, 705 bp, Triticum aestivum
  Clone ID: PAT_TA_76877
gcacgaggaggatgtcacctaacctagcatcgaggatatctagaagcccactttatgatggtaatgtgatttcttttgatgctgctgtactgtcagtttcacaagatgtagactgcctcagggaagaccctgaagaagaaatctatgagaatggccggggaaatcattttaggcaagttagtgaaatccaagaggagccagaggttgaagaggttgcatgccaacatgccatgaacggtgatttggaccacaaggaaagtgcgataagaagggagactgaaggggaatttcggctgcttggacggagggatggaaacagcaggtttgctgggggtcgtctcttcggtgttgaagagattgacggagctataagcatggggcgcagagtttcattcaacactgaggcgaatatgattgctgacagactacatcgggcctcagatgctgctgaagcgtctggatatccatttcgtgatgatgatgtaagtgatgggtatgatgatgctcaagactggagcaggagggaaccagagataatttgcaggcacattgaccatgtcgatatgatggggctcaacagaacaacacttaggttaaggtaccttatcaattggctagtaacttcgctgttgcagctgaagctgccaggcttgaaagacagtgatggagttcctcttgtccacatttatggtccaaagattaagt

SEQ ID NO: 76878 - DNA, 670 bp, Triticum aestivum
  Clone ID: PAT_TA_76878
ggaaaaactacaaagcctagagattacatctgagagcattgatctcatggagagcagctggatgccctatccagcgcaacaactccgtaggcttgtgttgcatggatggtttcataatctgccaggatttattagttcttcatggcatccccgcctctcctacctatggatagaagtccgcaaactgcaaccgtgggacattcatgaccttgggactctgccagctcttcgttatctctacctgaagtcaatcttggacactgccatggaagagcgtgccacgcaaagctccccgcttaatattgatggattcccttgcgcgacagagtgctggttcgaaggtgttacagtgaatccattagggttccggccaggaactatgcctatggttcgatgccttgcgttcggtgcccaagtgtggaacatcctcgatatacgtcattcgataaagcacctaggtccagatggcttggagttggactacttgagctggagcataatgcacctctcttcgctcgagcaactctccgttgatctacatggcgaggaggctagcagcgcaaggtatactagagcggaggccgcgctgaagcacgcgacgtacaaccatcccaaccgtcccaaggtcaacatctggagtcctagaggctgaagagctgaagagctgcag

SEQ ID NO: 76879 - DNA, 652 bp, Triticum aestivum
  Clone ID: PAT_TA_76879
gccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgatcggaaaggagattgagaaggctacctcaagcatcttccc

SEQ ID NO: 76880 - DNA, 716 bp, Triticum aestivum
  Clone ID: PAT_TA_76880
gaggctggaatgactatcaatcggagcatgagttatatgcctcaaccagacacatccacccatgattatattcaatccctagtaatgagaaaccatcgacccctcgtatatatggagtggaacggccggtggagagtggactgtgactctctgagcacgagttatataccgtggcctccacctgtcccaaacggtgcctctcatgtttggatgtttggattcaagattggtaatgataagagacatccatccatgattacatttctatctgcacttgcttgcaacaagggcttcaatccctatacaggagggttaatccatcctctcatctcctatggaccgtgaactacacccacagaggtgcaacaattatccctagccttacatgtacgtggttgatccgtcaactacacccacaaaggactctacctgcccgaaacgttgtctctcatgtctggattcaatccatcgtatgagacaacaagttgcgtgtagagacatctgtcaatggtgttacgttctcatctatagctgcttgcaatgaggccttcaatcaatccctaggaactaaaatagaaaaaaggaatatgcatcttggagcttcaatggcttcgtcattttctgccgtacgctacacctatgccgcttcctccaccaggttgtttgcctgtggaccatcttcctagtgatgggtactacatattttggctctcggc

SEQ ID NO: 76881 - DNA, 698 bp, Triticum aestivum
  Clone ID: PAT_TA_76881
ttttttttttttttttttgcatattaaccaaggtgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtacttgccgtggcgggggtcacacttggccatcatacatgaaagctcaaaggcgctgttggtgatctcagcaacagacagctgct

SEQ ID NO: 76882 - DNA, 777 bp, Triticum aestivum
  Clone ID: PAT_TA_76882
gagggtcgccaccagattctgcagctgtcgcgagccgccgcgggagccggaggccgatgaacgcaaccccttccctcccactcctagctttttccgatggccgccatcaccatctccgacgacccacccatccaaacccctccaacaaacaccactatcctttcatcaccacctgagatcgcttctccctcagccatggatgcggcccctccaacgacatcctctcctgccccctcaaatctgaggccagctgcttcgccaagacgcagctcctgcatccagaagttgtacgacaaagctcgcgtcacctctgtggagcgtgctagcaagcgcaaggctgcctcctcctcctccgaggggggtcgagggccgcgcatcgatccccatccaggaggaagaaggccacggcgcaatgcgtgacctcccttttggagctcccgcttcaggggaccctgcgtccgctcaccagggggaaagccaggcggatcgcgcagtgctgtgatctgaacatcgacgtgatcctctctaacgcagcaccctctacctcggtcagcttgggcaacgccccaacttcacctgcgccatcaacatccgccaatgcctagagacgtcatcgacaatcgagttgtatgtccagctgccagtggcctgctttttcatgagttgtttgcatatgtacccttcgcggctacggcctgatatgtatctgtatctgcatcttatcttatgtaatggcactaggcctgttcaacttgttgctttagcttttcatttgaa

SEQ ID NO: 76883 - DNA, 775 bp, Triticum aestivum
  Clone ID: PAT_TA_76883
gaggcttgaggtccttgtgtctaaatccctagagttcaactttgttagcttaataggtgggcaatatgaagggatgttgtatggtaggattcgccgtctcaccgtacatggcggagaggcaccccaagactcttcaccaaatagaatggcagtgtaccctggtacaaggaacgacatcaaggagatgactctgcagcatgtccggtcactgagcatatttgatccagaagcgcacaggctgcttgctcggctaggagattttaccttgctaagggtacttgatctggaagactgcaaaggcctagaagaaaaacatatgaggcatatctgccagatgtatcttctaaggttcttgagcttgaagggtacagctatcaaagtgatgccatcgagaattggtgatctcgagcatttgcagacccttgatgtacgtcaaacacagctgaagtgtctgcctgcaagaattggtgatctcaaacatttgcagacccttgatgtacgtcaaacacaactggagagtctgccagaaacagtcacaaagctagagaagctggagtacctgctattctccaccaaaggcaataattggtctgggtggatgctgcccaaagggatcaggaaaatgaaggcactacgccatgtgaataaagcggttgtgatacacgacccaaatgttgccaaggagattggtgaattagatcaattggaagagttatgtatctatgttgatacaagagagaatatccccgaggatgttcccatagagcttgcctgc

SEQ ID NO: 76884 - DNA, 782 bp, Triticum aestivum
  Clone ID: PAT_TA_76884
tcggcacgaggctcaagagaactttgttaccgtcctggatggtagcaagcaacaactccctgttgcaagcaagactcgcaggttggctgtccaaaagagggtcgcggagcagggtgaccctctgactaacattcgcccggaaaatctgaggtcatttaataccatggggtgtcattttagtacggatctatcactttcatgctttgaacgtctccgtgtggttgctatagaggaatgtactttcaatgaaggggagagttataatcttaagtatcttgggagattacttcagctaaggtacctcggactatataacacacgtattgatgagctaccgcaagacataggggatctaagatttttgcagacactggacttgaggggaaccagggtcaaagaattgccagggagagttgctcgcctaaggcaactcaagtgcctgcgagctgatgaaggcacagcagtgccggactggatggggaatctgacatccctagaggaactgctgctgggcgaagtcggcaagtcggtaaactttgtgaatgagctgagcaaactgacagagctgaggaagctagagattcggactgagaagttggataagaaccaaagcaaagctttggtgcagtctatgagaaatctagagaaaattcaagtcctaagacttacgatgcgttattggtggccatcacttggtgagctcaactggggagactttgacccacctagacaactccgtgagttgcacctaatgagcatcgcatcctctcagccgcccgcgt

SEQ ID NO: 76885 - DNA, 706 bp, Triticum aestivum
  Clone ID: PAT_TA_76885
gaggctctgcccgtaggcctcgtcgcctgggttcccgccaaggcccgcgccgtcgccaggtggctatccgggggccggctccctgctccggtggcggacggagccgatccgatccggggggatcctccccgccgcaatccgagcctcctcgagctcgacctcgcccaagtggccgcggcggccgccgccctctgcgtcgccatcgtcgccgggatccacctgatcccctctctcgtgcagcgccgagcggactcgtcggactccgactcgagcggcggcgacgaggaggagagcggacaccacagcgaccggcacgtctggtacccacccatacagtcgttggaaacaggggatcgccgtctcttcttccccggcttgactgcctcggcccgacagcttcccgacgctcggcaaggcgacgaccagctgcacagactgtcagatgtagagaacccgttgatcctcacgccaagcacagaacggttttcaggtccatgtgagttgtccaatgaaacaacaaggacttgggtcatgaggctcaaaattactaccaaacttgtttgtttatgtaagcggcaattacatcagcagaatcaggaattggctgaagaatgctttgcagtggtagccaagcaatctgtagagcagatcctagaggttgcatgttcattcagtgatgcaagttggtctgatgcccacatttcgc

SEQ ID NO: 76886 - DNA, 515 bp, Triticum aestivum
  Clone ID: PAT_TA_76886
cggccgaggcgggcctggcgctcgtcgaccttcccgctcccgcgcggccgcctccgccgtcgggctcgcgccgccccgtccgaccacccccgctgcccactcgtcggcatgaagcgccgcggggaaactaacgcgcgaagacggctgaccaagcgtcgccaggccggggcgtccgacctcccgacgccggtgccgaggaaacgggtcacggtagtcgcgtctggccagaggaataaggagatatcggcggcatcccctcttccgattgccccccaaccgtcgtctgttaccgtcgtgtcgaccatcaccgactccgacaggggagataactccatggccaataatcaggggatagattctgatgtaaagaaatcagtgatgaatcctcatcatcttgagatcggcgccatcaaggacaacaagctgtacatcgacatgaatgcttgggcgttcctgcgtttcaagagcaaccctctggacaaaaaagctataagtgtgtatcatgctgaaatttt

SEQ ID NO: 76887 - DNA, 789 bp, Triticum aestivum
  Clone ID: PAT_TA_76887
tcggcacgaggagatcgtcaagaacaaagcttatttcaagcgttatcaagtgcaatttcgtcgtcgacgcgaatgcaagactgactactatgcacgtaaacgtttgattattcaagacaagaacaaatataagacacctaaatatcgtcttgttgtacgtgttacaaaccgggatatcattacacaaattgttgctgctgatatcaatcacgatgtcgttctcgcctctgcttatgctcatgaacttcctcgttatggaatcaaattgggtttgaccaattatgctgctgcctatgccactggtttgctccttgcacgccgtgtcaatgacaaattcaaactcaaatatgaaggtaacactgaagtgaacggtgaagactacaacgttgaagctgatgaagaaggtgctaaacccttcaaggctcttctcgatgttggtcttgcacgtaccacatccggtgcacgagtatttggagctcttaagggagcaactgatggtggtttggatgttccccacaatgatcatcgtttccctggttctaaacgtgaaggtggtgaatggcacactgcccctgatgttcatcgtaaatacatctttgccggtcatgttgctgaatatatgaaatatttacaagagaatgatgaagaattatatggacgtcaatttaaacgttatattgatgctggtattaaacctgattcattagaaaaattatatgcagctgcacacaaggcaattcgtgctgctccaactaaaccacgtggagatttggaattaggtttctttgg

SEQ ID NO: 76888 - DNA, 495 bp, Triticum aestivum
  Clone ID: PAT_TA_76888
gagggtcgtcttcgcccccaccgccgccggccccggcatccccgagatcaaggcctacctcaacggcgtcgacacgcccaacatgttcggcgcgccgcagctcattgtcaagatcataggcagcatctgcgcggtgtcgtcggggctggatctcggcaaggaaggcccgctggtgcacatcggcgcctgcctcgccaacctgctcagccagggcggctccggccggttccgcctccgctggaggtggctgcgctacttcaacaacgaccgcgaccggcgggacctcatcacctgcggcgcgtcgtcgggcgtgtgcgcggcgttccggtcgcccgtgggcggcgtgctgttcgcgctggaggaggtggcgacgtggtggcggagcgcgctgctgtggcgcaccttcttcagcacggccaccgtggtggtggtgctgcgcggcttcatcgaggtgtgccgcggggggcggtgcggcctcttcggcgagggcgggct

SEQ ID NO: 76889 - DNA, 776 bp, Triticum aestivum
  Clone ID: PAT_TA_76889
gaggcagcaagggagaatggggcaaagaagagcgcaagagcaacccatggaagagaggagatgacattgatatcagaatccgtgctcatgactccaaattccaaatctttgctgatcaaaaggaaatcaaggaatacgaacatagagttcccctttcttccatctctcacttctctattgatggggatgtctttattactcatatccattggggaggacgttattacccagtcccatatgaatccggaatccccggtgaaggcattgcccctggcaagaccctcgttatctatggcacccccgaaaagaagggcaagagattccatatcaacttgttgaaaaagaatggcgatatcgccctccatttcaatccccgcttcgatgaaaaggctatcgttcgtaactctttgctctcaaacgaatggggaaatgaagagcgtgaaggaaagatggtcttggaaaaggctaccggcttcgaccttgaaatccataatgaagcttatggcttccaaatcttcctcaacggtgaacgtttcgccacctatgctcaccgcactgaacccaatgacctccacggtatccaaatcggaggtgacgttgaaatcactggaattcaaattgttgattctgctcctcatcacgcttaaaaatgccctccatctctcccctgcttctccagagaagaaaaaaaatgttaacctttcgcctacaaaaaattctatattttacttttttttagagattattcgtatcaaaaaaatattattccttttttt

SEQ ID NO: 76890 - DNA, 681 bp, Triticum aestivum
  Clone ID: PAT_TA_76890
tcggccgaggccggattcgcaggagttgcgccggtggtcgcggcgcgatggctggcgttgacgcggcgaggtatgcgcagagcccagcgcaccacgccgtggcgatgcaggaccacgctgcccttcgccgcgtgctggacgcgctcccgcaggctcggaagcccgaggagatccggacggaggcggactccatcgccgaggaggcgcgagcggaggctgtctcggccatcctcgaccggcgtgacgtccctgggcgtgagaccccgctccacctcgccgtccgcttcggcgacgccgcggcagctgagatgctcatggcggcgggggccgactggagcctgcagaacgagcatggctggagcgcgctccaggaggctatctgcgcgcgtgaggaggcgctcgcacgcgtcatcgtgcgccactaccagcctctcgcctgggccaaatggtgccgccgcctgccccgcgttgtcgccgccatgcgccggatgcgcgacttctacatggaaatcacgttccacttcgagagctccgtcattcccttcatctcccgcatcgcgccctcggatacctacagggtctggaagcgcggggccaacctccgtgcggacatgacgcttgcgggcttcgatggcttcaagatccagcgctctgaccagactattctgtttcttggggagg

SEQ ID NO: 76891 - DNA, 711 bp, Triticum aestivum
  Clone ID: PAT_TA_76891
gaggctctccttaggaagtatgttaaggtgcgttagctttgccttctcatttcattttaagtagctttcagcattactctgatgtccatctgacaagaattttctcaacttggtggtgttattttagaccctgttgtatacctgggctagaggtcgaggtgccatgccctttatttcgtttttgttcctccgagacttgtgtgttcaagtaggtccggattgccttgacacatgcctcaagggtatctacaaggcttatttggtgaactgcaagttgtccaagtctatcagcggatcgaaactgcagcacattcaatttcttgggaattgtgtcaaagaattgtatatcttggaccctcaaagtgcttatcaacatgcttttgttttcattcgtcagttggcagttatcctaagaggtgctcttaccgaaagaggaccaaagacatcaaaggacaaaaagcagaaagaaagaaacaaaccaacgaacaaacagctggaggtactatttctattagtctttgccaagtattttcttgtattttggaaacacaagtgttgtctgctcataggagggatatcattcttttagattatttgctgacaacagctcatttttgggctaattctattggttcctttcgtatgttagtttgatattttttgttgtcaatcagacaaaaagaggaacgttttcctgttgtgaactgatga

SEQ ID NO: 76892 - DNA, 723 bp, Triticum aestivum
  Clone ID: PAT_TA_76892
ctgtaccggcgggtgctgccgtcgccgccggcggtggagttcgcgtcggcggaggggaagcggctgttcgcggaggcgctgcagggcggcaccatggagggcttcttcaacctcatctcctacttccagacgcagtcggagccggccttctgcggcctcgcctccctctccgtcgtgctcaacgcgctggccatcgaccccggccggccgtggaaggggccctggcgctggttcgacgagtccatgctcgactgctgcgagcccctccacaaggtcaaggccgagggcatcaccttcggcaaggtcgtctgcctcgcgcactgcgccggcgcccgggtccagtccttccgcgccgaccagaccaccatccacgacttccgcgcccacctcacgcgctgcgcctcctcccaggactgccacctcatctcctcctaccacaggagccccttcaagcagactgggactggccatttctcaccgatcggcgggtatcacgccgaaaaggacatggcgctcatcttggatgtcgcgcgcttcaaataccctcctcattgggttccattgacgcttctctgggatgccatgaacacgactgatgaagcaacagggcttctcaggggagttgcggccatggaagttggaaaagcatggcaaagtattgtgtggaagatgtacccaatctactgaaggatgagaatctagacaatgttacaacacttctgt

SEQ ID NO: 76893 - DNA, 283 bp, Triticum aestivum
  Clone ID: PAT_TA_76893
ggcacgaggagctcgtctcgcgcacggtgcagcaggactgacctcgtccccgccccacggtgctgcaggaccgatctcgtctcacgctccgggctgcaggatgggtcgatggatgccagtgttggccgacctgttgggtctcgatgctgggggtgggccaggggtgcaaaggcggatccttttttgctcgtctctttggttggggtagcggcgggtctcgggtgcggtggtgtcaaggtcttggatgcctgggcggcggccctggtggcggtgcacggtgctc

SEQ ID NO: 76894 - DNA, 688 bp, Triticum aestivum
  Clone ID: PAT_TA_76894
tcggcacgaggctcaatttccccaagctgcagcttccggtgatctaactatccatggtggttataaagatggtattaataaagattcgtatgtgaaagagaattttcaagatgcatatgcatctgcttttatggctacaatagatacagtagatacatggcgtggttggattaaagatgagacaagatggcaagcattacaaaattataatattacatcaccagattggggaggaagattgatagaaggattattagcaacatttcaagtatccaattatattgagataccatttggaggggaagatggacattggaaaggtcccggtagtggtcgtaagatagcatctgtcgatgttgtatccgattttttacgtgatgattggcaaacagcatcaccgtttcaacgtacattttatgatactgatatctcatcacgtctcactgttggtttagggaaacaagttcccaataccccatctgattcattagttttgattccagatgttgatcctcaagtcattgctaattttgatgccgaaaaatttgggattgttcaaaatgatcctgatgattataaagcagttgtagtacgtacatggggagctggtaaatggaaaactacaccatcacatgaagatgatcaagagattgatgggttatatgctattattagtattgatggacaa

SEQ ID NO: 76895 - DNA, 491 bp, Triticum aestivum
  Clone ID: PAT_TA_76895
ggcacgaggcaccgaccagtcatccggacagcgacactccctcccactcccagcgccaccgtcgccgccctccgccgccagccgccgccatgggctcctcccaccgccacctgatgcgcctgctcgacgaccccttcttccccttcccaccaccaccgcccacctcctccctctcctcctcctgccccttcctccctcccccacccccatcccccttcgccttcccccaccaccccgacctcctcgacctctacctccccgccgaccccttcttcgccccaccccccatcccctccccgcacgccttcctcctccacgacctcacggaccgcgtcgccgcgctcgagctcgctgcccgcgccgcccgcgcggccgccccgcagcccgcgcgccgcaagtacacctacgccgccacggagcccggcggccgcaaggtgaagtggacggcggaggacaagccgcgcggcgggggccgggcgctcaagtgggag

SEQ ID NO: 76896 - DNA, 702 bp, Triticum aestivum
  Clone ID: PAT_TA_76896
tgaggagatcctgtctactatgaagtagaatgtggggtacgtgaagtgcctggttccgatttcaaagtcaggaagaagaaggccaggctatcttcaaatcagaaggagcagttgaaggatggttactttatcagccacaagaccaaactaacttcaactcagaaggaaatggtgaagcagatggtccaatccatatactcagagatccccatcttcgttgctgtgatgagcaagtgcaacgttgttgtagaattctatctgacttttcctagacactacgctaagaaatatctcacagaggagccacacatgtgtcttcagcggcagggccggaagtgggaggcacggtattgtgaatacaatggcgggaaaaagctcactattggatggaaacagtttgtaaaagacaacaagctgaagatgggtgatatctgcctctttaaactgttgagcaatgagagaaccatgaaggtctatatcatcagtgaaaacgttgccaattatcgggcaggtctccagaatgacgctgaccgggaagcggtgttccggagaggggctcatgatgtggatggagcgcgtgatcccgactcaaggttccttcgcacaactaaaactgaagctatggaagatgatgttgttttcaaaactgaagacggtgcctgatcgcccaaggaaaaaagcctggtgtctgaaccaagcgta

SEQ ID NO: 76897 - DNA, 656 bp, Triticum aestivum
  Clone ID: PAT_TA_76897
gatggggtcctcgatagttagggctccttcatagaggagcacaggcggcggctggcaaaaatgcatgacacagcgctccactggccttcctcctctcgctgggaggctgtcagcctgttgttgactcattttgtgtgtgttggaagagaactcactcgtcccagctgctaaatttcttgcatctgagtgcaccacaaaaagtggcaaaaagaaatggataaaaaaggagttctcacatcacgtgacgtgccaaaaagagtccaagcctcacaactcaatgcggggtcagaccagatgaccaacatctctcctgctcagtatgacaaggatgtcaatgataatgaaaacctccctcacagtagagcggcggagtgcatccttgccatctacatttcagagccccatcagttcagcgtgatctctccggtcagctgctcaacaacagaagcatgtaccgcccagtacatgtattactattgcgaaggttcaaaaatctggactcaacaagttcaacgttgatggtactgtgcacatgcgctaagccgttctacaacatagcgctaagccgttctatgctgcagctcgggaggtgaaggagctccccttgggttcatcttgcaagtttcgttcaaacttggccacctaggctgttcaac

SEQ ID NO: 76898 - DNA, 650 bp, Triticum aestivum
  Clone ID: PAT_TA_76898
tcggcacgaggggttatgttggtttggagaatttaactccttggacagttatttatggctgggttgtcgacttactagcttacccacgttcatgatgatccataaccaagccctacaaaggtgaagaatctctatgcctggaattctagtagttgatgagcgagaacaagaatgttgggtaagatttagcgagtgtgagttgaagttagctagcttctttcatttacaacttcatatcgtgaacacttgttttcaagttattaatatagtaagcgacgcgttcaagctagattttcgccactgcagccaagctaggttgtttggctggtgtggtcaaccaacggggatggaggtaaaggggattgaaatttcaaaatgtgcatatctagaatagaacaaacaagtatgacatgctctcgacataaatgcttattaatcccttaattcttgctgatgctgtgatgcaaataagccataagtgagcgcttattttgttttcatgtcctataagaatatgatgtataactgaaaatcagattattaaaagagataaggaacctatcgattattcaaattgattaatcctaggaaagaggtgcaaatattgagattatcctgctagaagatcaggatttctattgccctattgg

SEQ ID NO: 76899 - DNA, 752 bp, Triticum aestivum
  unsure (1)..(752): unsure at all n locations
  Clone ID: PAT_TA_76899
ggcacgaggatggaaacgattagctttgttggaattcgcttatctccaatgcaacccaagagttagctatgcctttatgaaaaaaacatgggatatgtttggatttacctggtgggtcaatgctgacattctctttgaagatttgaacattgcttggatcaagatggaagataagattttctcaagaattgaattcacacctcttgctcctcgcattgaattaagatggcgcatgcaacatgtttattttgaaactttcgacgacgaagaaacaacgacatttcttagaaatgctaccaaatgtgatatcttggagaagtcgcacttccgaagcgctattgatgacgaaaaaatggcaacaaagcaaatgaaaaaattcttcgagctctctaatggtcgattgtttcacttggagactcgaactgcaacgctcgaaggctacttcgctcctgcagttatcaacacgtttatgccattgatccgtagtaacaccatctactgcaaatgcttgccttcagctgttgaagaaagatatcgctatgagcagcttgtctatgcaaataaagataaaacgtgtcttcactttggaacagaaatagctcaaaaattctatgctaaagaagactttgatttgcttcgaaaagtgatctttgccaatcaaacaattgaaatcctctctttcacatngcttgttcgaagagttcaactttaatgcattgtttgaattgttaagtgatccaactttctcaatc

SEQ ID NO: 76900 - DNA, 675 bp, Triticum aestivum
  Clone ID: PAT_TA_76900
ggcacgagggcgccggctgccgccccgccggtcgagtgtcagggcagcccatctctttttcgagcagaagaggcacacaaataagcagctctttttcgagctgcaattcggaaccgaagcagctccttttcgagctgcaatccgcaatcaagcagctcctatccgagctgcaattcgacatcgacgcggctccccaccgagctctaatccgatttcgaccccctttctgtgtagatcacggaaggggatcgagtccgtctcgtgttcagtctgcgaggtgcagtcggaggcgcaaacgaagccaatataaattggccagtcggcccgaccggaagccagcagatctcagacgagaccagccattcccgagccaggttcacggacgcctaccttctccggcgaccggcggccgccaattcttatcggatcttggcagatctacccggagccatggggaaaggaaatcgagatgatatgctcagcaacttgcctgacgacattttggttaatattcttgatagactcgatgtcacatatgctgtcagaaccagcatcctctccagacggtggagtcggctttctacgaagctttctcgactgacaataagtattttggacttcctgcctcgcaatgggcccatatttgaaattgatgaagtggttcggagcaatgca

SEQ ID NO: 76901 - DNA, 668 bp, Triticum aestivum
  Clone ID: PAT_TA_76901
tttttttttttttttttttgttgtaagatagtggaaatattcgtggaacaatgatacaccatttttgtgcacactcgttttcctaatctctttggtatctgttttacatgattgtactataaaaaaaatcttgaattcaagtcaaaagaaaaaaccttgagttagatggcatcagccgcattgctacttcatcaaccgcatcagccatcttttccaggttagttccacactgaatgtaccaattttatactactccagtcctggctttccaaaaataaaacaaaataaaaaaaatctaggacagggcctcttaccctataaatggttacgaaacagagcagtcatgttgtgcccatggcaaccccaggataaatagaaaaaataattgaaaagaacagggataagaaacaaagtagggtgctgaccatcaaccccatgcattcctttcataagaaaccggtgggaacaacaaagtagggtgggcggtgaagaagcaaaccgtcacttgttgtgaagcttgtcaagtattgtgcaccgtcctttgggacgccttcgattcctatacgcagtaatgggatgctcatcgggtgattgacgcagatgacggtcacctgtgacctgttgtggagcctgctccagtgtagtgcaccgtttcaaatgacgccgtc

SEQ ID NO: 76902 - DNA, 629 bp, Triticum aestivum
  unsure (1)..(629): unsure at all n locations
  Clone ID: PAT_TA_76902
tttttttttttttttttttttatgactttatttgtctgtatataatacttgnggagggattcagagacagtacaagatacaatcacagaacatgtatttacatctagctagctatatcatcttctgtgatgtatcaggcactaacaaaatttccagtcggactgcaaccgacgtggataggatgggatttcccccatccactgtctaccgatcccctcatatcatcatctactacgtctacacattaacttctgacataccacatctgagttgaagcactaatcataccacaacaacgcactttttacacaagaaaaaggtttcataactggttttacctcgtcagactaccatcagtgagcattgtgaagacaagaacagctgaaagagaaagaatagtcacttggctagcgttagtgcctcctccagcatcgggccggctgctaggagcgcgccgccgcagagtatgcacaggaacaatggcggcaccgcgtcgctgtccgcaaggccgacacaccgcgtgtggtgccatacatcgcaagcgtcgcacgccaccatgcgctcgccgtcatcatcccgcgcaccgcacacacacctcacttcccacatgtcgagcccgccctcgcacc

SEQ ID NO: 76903 - DNA, 665 bp, Triticum aestivum
  unsure (1)..(665): unsure at all n locations
  Clone ID: PAT_TA_76903
cgagggtaagaatggctcgtaccaagcaaaccgctcgtaaatctaccggaggaaaggctccccgtaagcaacttgccaccaaagcagctcgtaagagtgccccatccaccggtggagtcaagaaaccccatcgttaccgtccaggtaccgttgctttgcgtgaaatccgtcgttaccaaaaatctaccgaacttctcatccgtaaacttcccttccaacgtttagtaagagaaattgctcaagatttcaagactgatcttcgtttccaatctgctgctatcggtgctcttcaagaagccgctgaagcttacctcgttggtcttttcgaagataccaatctttgcgccattcacgccaagagagtcacaatcatgcctaaagacatccaattagctcgccgtattcgtggtgaacgcgcataattgatgatctcattttcatccatctttaacactcatttacttttttcccttaaacttttatacaatttatatatataaccaaacgttcccttctctttattatctatcaacaatgttaagctttcttcttcttctctatctatgnattttttgatttgtgtttataacaacacttattaactacctttgattattacaataaactttctttatttaaaaaaaaaaaaaaaaaaaaaaaaaaaa

SEQ ID NO: 76904 - DNA, 671 bp, Triticum aestivum
  Clone ID: PAT_TA_76904
tcccggcggcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaagttcgacgttggtaacgtggtcatggtgactggcgggcgcaacactggggcgtgttggt

SEQ ID NO: 76905 - DNA, 760 bp, Triticum aestivum
  Clone ID: PAT_TA_76905
tgacaacactcaaaacacacccgatcaacataaatcaataattaaacacaatgggaaaggaaaagactcacgttaacttggtcgtcatcggtcacgtcgactccggaaagtcgaccactaccggtcacttgatctacaagtgcggtggtatcgacaagcgtaccattgagaagttcgagaaggaggctgctgaactcggcaagggttcgttcaagtacgcctgggttttggacaagctcaaggccgagcgtgagcgtggtatcaccattgatatcgctctctggaagttcgagactcccaagtactatgtcaccgttattgatgctcccggtcaccgtgatttcatcaagaacatgattactggtacttcccaggctgactgtgccattctcatcatcgccgccggtactggtgagttcgaggctggtatctccaaggacggtcagacccgtgagcacgctcttcttgcctacacccttggtgtcaagcagctcatcgtcgctatcaacaagatggacactactcagtggtctgaggctcgttaccacgagattgttaaggagacctccaacttcatcaagaaggttggattcaaccccaagagcgttcctttcgttcccatctctggcttcaacggtgacaacatgattgatgcctcttccaactgcccctggtacaaggggatgggagaaggagaccaaggccggcaagtccactgggcagaccctccttgatgctatcgatgctattgagcctcctt

SEQ ID NO: 76906 - DNA, 762 bp, Triticum aestivum
  Clone ID: PAT_TA_76906
ggcacgaggagattcggtagtaggctatcagtacttcgaagtggctacacaaaagaaaaacaagaaagggaaaagaggggcccggcgttctttgaacaacaacctgatcgttatcaagggtttacctaaacttacaggatatattgagtgcttgccagcaaaagcatttactggtgatttacaactcctcacgctgaatctgagaaaccaatcagaacatgctgtgaagaatataaaaatgaaaattagccatccaaggtttgtaattcccggtgattcatcagaccttgaccttgaattcccacagtgcttaagaaagcatgttcaatcagacagcaacactgtacccgaaggtactaaggaaaacgtcaagggttcactatttgcatttcctcaggatattaaaattcaaggtgatgccacattctcttggcctatttggtttcatgccgcaactcctggaaacttctctctttatttgtctctctattatgaaatggagagtaccactgacattccgtatcgcacattgcgcatgcattacaatgtggaggtcttgccgtcacttgatgtgtcctttgctataagtatgtgctcatcaagattccaagagtatattgtgcgaatggacgtaatcaacaagactccatcagactcattcgcacttcatcaattgtcatgtgtccgcactaaatgggcagtttcaacattaccctcgcgtgattccatcagctttgtggaaacagtaccagcaaaccaggc

SEQ ID NO: 76907 - DNA, 723 bp, Triticum aestivum
  Clone ID: PAT_TA_76907
ggcacgagggttattcatttgattttccatttcttcatttttaatgacaaagcatgcttttttttcttttcaattagcttaaaatcacaatcaaagagttaagtttttacttaattttcataaacaactatatatggcttaagaaaggtgaagagcaaggccaatcaggatttatgtatggttggtttcttgatccaggattgttaacaaggtttaataaaggcaagttggttttaccaagcgagacagataaatttattaatacttgcaatatacgtctcacagattatttgcatcaggttcgtgtaaagtgccacctgtgaagttgattgacaaggcagttgaatgaagccacttattagcaccttgcttgctcttctttctttttggagccaaaagatccatcagcgctccactgctgggcaaggctatctcggtcatcttccgtctgatacataggtcaaaccatggctcacacactctctcgccgatatttcacttcgctcccgtgaatacattgtcttctacgcacggcggtgctgccttggatcggccctccatcgcgccgcttcagtcgtcaccatgcatctcagctccaataaccaggtcacgatggctgatgatgaggtccaggctccgctggctccaccaacagctgtctgcgagcacttgcacaggtcagctgagatgcgtcacgtcccctctggtttatctagacggctg

SEQ ID NO: 76908 - DNA, 665 bp, Triticum aestivum
  Clone ID: PAT_TA_76908
acgaggcttcttcttctctcgtgttctctcctctctcctttcttcccattcccattcccattcccattccatgtcggatcgtgtgactcaattattctctgcagctcgtcatggtcaattagacaaagtgaaagctttggtcgaagatcaagtcaatattgctggatgtccccggaacaggaactggataaacatcaacaacatcaacatcaacatcaacatcaacatcatcaacacgaataggacacaataacagaaacaacaacaccagtggaggataaagcaataggcttcaacaaggcagattgtgtttcttgtgtgtgtgtgtgtgtgtgtgtgtgtgtgtgtgtgtgtgtgctttgtgtgtgtgtgatacatgactcattcgttcaatcagtgtactgtacttgtgcatgtcgaagatgatatgagataaatcgtttcatattaatatattctcctaggtgatggtgtttctatcaattctactgatgaatatggacgtaatgttttattatatgctgcacgggctggacatgtagatgtagtggaatatgcattatcacaacattgtgcattaaatcaaaccactgaaactggtcgtacagcacttatctatgcatgtcatgaaggacatgataccattatacaagcattattagatg

SEQ ID NO: 76909 - DNA, 689 bp, Triticum aestivum
  Clone ID: PAT_TA_76909
cgaggagaagctgaagaagcagtcaaaagtgtaaacaattacaacagagaagcctttgttgaagtgccagcgttccaagctgggatacaaacgtttgtaccccaaaacagaagttcaagtcgtaaggccagtatgcttttggagcaacgaaacttcacggagaaaggatacaaagactctggaagtcaactgccaatgtttcgaaccggatctggaaagtcagtcttgattagtgaaagctcagtgcagaaagcaaaggctgttctggaggaagaggtcaaaataaacagagataatcataatctccttaacatggacaaaaatattcctgtctttgcttcacctctcaagacaagctgtgcaagaacagttaatatatcttcagctggtgtatctcgagctgctactttgttgggcttggaggagaataccctttcaacacaattttttggacatgtgggcgataagcttggcacgaaaataaaatttgaacggaaaaatccagaacagaggcttgcatctggtccaacagaaaaccaagtgcgtaaggaaccacaccggccatttgaactttctaataacacagtttctgattctggtgaacattctatcagattcagtaccgcgggaggcagatcaatggctatttctagtgatgcacttcaacgtgcgagaagccttctgggtga

SEQ ID NO: 76910 - DNA, 630 bp, Triticum aestivum
  unsure (1)..(630): unsure at all n locations
  Clone ID: PAT_TA_76910
ggcacgaggactagatcctcaaacgctacaagtaacacggacacgcgcgcgcacgggccgaggaaccgtaaaagctacgacttgttcttcgtccaccttcgtctccctcccttccccgcaggccggtcacctcaagtaaccccatcccctccttgctgcctcaccccgttggatcatcagagctgctgcccggcgcccgaggtaaacaaatcgattagcgcttccaccgcagcggcgcggcgacgatgtggtggctgccgccttgcttccacggcggcaacgcggccaagggggaaggccgagaccacttcgaccccaaccccgtgtcgccggccgcggnctcggcgcggtccatgagcacggccacgtcgtccaccatcaccgccccgtccggctcggacctcaccggctccatcaacgcctccgacatgagcgccgactccatccagcgcccgcagcagtacccgagcttcgccgaccggcccgccaacctccgggtcttcacctacgccgagctgcgggccgccacccgcaacctcagccgctcgctcatgctcggcgaggggggcttcggctgcgtctaccggggcgccatcaaggtcaacgccggcgccggagacgagacgcctc

SEQ ID NO: 76911 - DNA, 698 bp, Triticum aestivum
  Clone ID: PAT_TA_76911
tcggcacgaggcgtggtggtcagttagaggaggcatggaagctagtggagaatgtggatactcaacccaactcgtcaatattgggcgctatgcttggagcttgtaaaacgcatggaaacatgcctctcggagaaactgcagccaagaatcttatcagtaaaggtgctgagagttctgtacactataccgtgcttgcaaatttgtatgcggaatctaatttatgggaggatgctcaaagtacaaggaaattaatggctgaaacatctggaggcaaggaagctggttgcagcgttctctgaagattactaataaagttatgctttccaagatattcagataatggtcatttgccctgattgatgcaccaaatgcatctggattacacctcagacctttgtccacaatgaacctgaccgatccaacatgtagagccttcagatctttgtaaactctaaccgacttcagaatcttgcccgtttgattaagcagtgagaatctaatgacttatcagcagccatcatgttcgttcaggggttgcgatggttctattctgcttgatagcataccaggattaccatccgaaaaggaatcggaaccgaacctcagcctgcgaggcttcggcacaatcgaccttgtcaaggctaaactggagcaagcctgcccctggagtggtctcatgcgctgatatcctagctctc

SEQ ID NO: 76912 - DNA, 622 bp, Triticum aestivum
  Clone ID: PAT_TA_76912
ggacgaggaccatactctccacagacaatttgattaatcaccacctgagccataatgaacgcagccgccaaagttgcacagcaggtgctgggcaccgagcccaccaacctatcccataactacaaggagcatcccacggagaagatgaaggcctgccgctggcaagctgctgcaaaggtgtctttggatgaggtccccgctccaatgatcaccgaccccaaagatgtcattctccacgtcaccggtaccaccgtctgcggaagtgacttgcacatctatcacaaggacctccttcagcagaagtctggcatgatccttggccacgagttctgtggcattgttgcggatgttgggcctggggttacgaagttcaagaagggggaccgtgtcgtttccagtttccagattgcctgcggagactgtgacatgtgcaggagaggtctgacgagcatgtgcgacaagaccaacgactcgaccgtgcaggctcgcttgtatggcggaaagtttggaggtatctttggatacactgacttcacgggtggatatgctggaggacaggctgagcaagtccgtgtcccttttgctgattctaacctgcttaaaatcccggacaacattcctg

SEQ ID NO: 76913 - DNA, 636 bp, Triticum aestivum
  Clone ID: PAT_TA_76913
ggcacgaggggcacttcaagccagccttgccctagctggcaaagccgtcatcaccaaccgctgcgactacgacgtctgggtctggtcaatctctactggccatgcctcctcatccttcatggtccctgcaggaagctcccacagcgaggcctacactggaagtagcacttccctcaaagtcagcaagtccgacgctttggtcgccggcaagcacacacagtttgagtactccatcgcggctggccagctctggtacgacatctcctttgtcgactgtgccaatggcgagtctgcgtcaaactgccctggacacgacgaaggcctggccatgaacgccagcaacgacagctgcggcaagatcgattgccccgctggagactactgccctacgcaggcctactacgtcgacacgcctctgcaaaagctgggtatcgccgagccagttttcatgtgccccttgtctctgggcaccagcgttgatctgtccatgacagtctgctccggaaaccccaagatcaagaggagcatcgctggccgtatccagatcgatggcgaggcttagagagtctcgatggtgcgcatttgcgattacttctccagctctcttaccattacttctttcgttctttatacata

SEQ ID NO: 76914 - DNA, 667 bp, Triticum aestivum
  Clone ID: PAT_TA_76914
cggcacgaggggcggtgctcaccgaccgcgtcctcctcgtcgaccccagcaacgagatgggcgagctgttctgcgagccattccccggcacgacgtggttgctgccgccggacttcccgctgacgagctacaccaacttcagcatccagacggccgagagccacgcgaacatggtgaagaacaaggtgatcagcaccgtcgacgtcgcgcaggggctaccggcgttcgcgtacattcacctcgaccacgacgccactggggaagacaagcaattctactgcgacgaggaccagagggttctccgggacatccagtggttggtgatgaggacggacagctacatcgtgccggggctgttcctggtcatggccttccaggaggagctcgacatgctcttcccggagccggacaccgtgttccaccacctcggccgctacctgttccaccccagcaaccacgtctggggcctcgtcacgcgctaccacgacgcctacctcgcggcggcgcaccagcgggtcggcatccaggtgcgcgtcttcggcagtgccccgaactcgccggagctcctggagcagatcaccacgtgcgcgcagaaggagggtctgcttccggagctgctcaccgcgggagcgcccgccgccaccacgtcgccgccttttccggagga

SEQ ID NO: 76915 - DNA, 582 bp, Triticum aestivum
  Clone ID: PAT_TA_76915
tttttttttttttttttttattgcaacacaagtttattatgtgtaggaagaaacagccaagtcgaaagaaaagttcctatgctgaactttactttatataggctgaactatagtttgccttcattacaaatacacatttgctagtgaattggaagataattcaccacatagcacatttttaattaagaaaaataaaataaagccttgtgtagagaaaactagtcataggtcaatatagatactgatggttaaaactgcttctttgattacggtgacttcaatgtaaacgccctgcatcactggacgatctttaggcgactctctgtacttgtgcgttggaaatttttgtgcatgtgggcgaagttcccacttcggtccaagcctaggtagaaagttctctgtgtgcttgcttcagtaaaaatccttattttttatgtgagccagcttcatcttgctttcctcggattcgctccacttcttcaaataatggcatccgccaatctgaagtatttggagcttggtgagttgttgtatgccctccggcaaagacctgatgccttcacagccactgatacgaaggtg

SEQ ID NO: 76916 - DNA, 655 bp, Triticum aestivum
  Clone ID: PAT_TA_76916
ggcacgaggcggaattgaagtcgttgcggagggatggaggcacgcatgcatcgtgacctaggcagacgagccaccaggaggggatccgtgccggatggctgcggacgcgcctctcccttgatcccctttcatctcgatggcgggacaggtcagtggcctctcaagctctctcttcctccccctcctccacctcgcaccgccaggacgatgctgcctcaccttccatatgtccccttgacgtcggctagacgagatgggcaggtcacccgccgccccctcccaccgtgaggaagatgacgccagagccaggcggcggtgctgggctgtacgccgaccctccctcagccgcctccgtcctccgtttcgatcggctctgccccaactttgactgacaactggtgctccgcatcaacctcctctgccccggtctagacatcgggtagcagcaagctgaggtcggggtcgcagtccagcaacgaaaggagggtggccctgccaagaataggaggctctctggtcggggtagcagctggaggaggagacgacgagggcctccatggcagtttctgatgacaggccatattttaagtgttttcagtttcaggcacactcccagcaggcctcccctctcaaaatagatctctgaacatgctct

SEQ ID NO: 76917 - DNA, 257 bp, Triticum aestivum
  Clone ID: PAT_TA_76917
tcgccccgtcctggcacgccggcgtcgcggggcacctcctgcggttcctcagcgacaccggctcgccgctcttcctcaagcgggcccgcgcacgggaggccgccgccgccgacgacgcgtacgccgcgatgcgggcgctcggcttctcgggcgtcccgctgatcgccgcggagcccgaggggctcggcggcgcggtggtgtaccgcggccacttgcgtcatgctgccggtgggggcggcgggaggcggtcgctggcg

SEQ ID NO: 76918 - DNA, 631 bp, Triticum aestivum
  Clone ID: PAT_TA_76918
ccagtgatcaatagattgtattctctttttttctccactcactcacatcatgtcatctgctggttccaattggcttatcttgggaggatgtggttttattggacggaatcttgttacatatcttgttaataataaattggctacaaaaattcgtgttgctgataaatctatgcctgccacatctgccatgaatgccacacataaagccatttttgaacaaaaagatatagttgaatttaaacaagctgatctttcaaaagatgatcatgtgaatcgtgtatttgcagattttaatgtggattatgttgtcaatttatgtggagaaacaaaatttggattaaatgaaaatgaatataaaactaaaattctagatacagcaaccaaaacaggtgctgctgcagctaaggcaaatgtaaaaaaatttgttgaaatttcaactgcacagatctacaatcctgataaatctccctcgaatgaagatcaaaaacaaaaaccctggacagtacaagcaaaatttcgtttacaagcagaagaagcattaagtaaattacaaaaagaacaagatcttcgtcttgtcatccttcgtccagcacttgtctatggtattggtgatttgactagtatcacccct

SEQ ID NO: 76919 - DNA, 607 bp, Triticum aestivum
  Clone ID: PAT_TA_76919
gctgctcggcgagctcgaccgcctcttctacctcgacatatcgaacaactcgctgcagggggaggtcccggccagcctgacgcggatgccggcgctgctggctggcggcggcaatggccgcggcgacgacgatcagaaggtgcaggacttcccgttctttatgcgccggaacgtgtcggcgaaaggacggcagtataaccaggtgagcagcttcccggcgtcgctcgtgctggggcggaacaacctcaccggcggcgtgccggcgggtctgggagcgctggccagattgcacatcgtcgacctgagctggaacggcctctcggggcccatcccgccggagctgtcggggatgacgagcctcgagtccctcgacgtgtcgcacaacgcgctctccggcgccatcccggagtcgctgacgcggctcagcttcctctcccacttcgccgtcgcgtacaacaacctctccggcgagatccccatcggcggccagttcttcaccttctcgagcgctgacttcgccgggaacccgttcctgtgcggtttccacgtgggacggaagtgcgaccggaagatagatgatcaggccacggacggcagcacgaccggg

SEQ ID NO: 76920 - DNA, 728 bp, Triticum aestivum
  Clone ID: PAT_TA_76920
tcggcacgagggatctgttccatccttgatgcatttgacttggttgtcattccccatcttccttggtagtccctttcgcttccctcatgtttaaactctgaaagaggcccgacccattgcttcactcgcagctcgctttgtggtctctttgtcaccttgtacttctatatgttgtctgcactcctatccaggtgtaggggaacattctttcttctccttaatagccttctggcatcattgttccaccacttggtaaccttcgcttcgcttgtacttgacctcaaactcctcttaagccacctttcgaactcaagttgccatcttcatccacctattgtttgcataacctccttcctcccaagaaccctccttaataaccccctccttgaaagcctgagttgcctccccttgagcttccaccacttcgttctagcgactttgacgcacttattccgccagacagatatctgaaagtggaagtaagccagcaccaagcttatgtcgtgggacaacactctctttaggtatcaccaatctaggcaaaaacccgtctgtcttctcttctcgagagaatgaaatcaatctggctagagcgttaaccaccactacaagtcactagatgggattctctctttctaaagaggttgctagctatgatcatttcgtaggctaaagcgaagcttacatttggtttcttggatgcataggatatcagcaccttctcaccg

SEQ ID NO: 76921 - DNA, 612 bp, Triticum aestivum
  Clone ID: PAT_TA_76921
ggcacgaggccggcctctttctctctctctctctctctctctctctctctctctctctgcctagtgctgatactgttgtgtcctcggcaatggcgagaagccgacagtccatgctcctggccttcgccgtcggggcaatggcggcggtgctgctggcatccccggcggcggccaagagctacaacatcaccaagatcctggcggcgcacccggagttctccaagttcaacgcgatgctgagcaagacgcggctcgcgtccgacatcaaccggcgccagaccatcaccgtgctggccctggacaactcggccatggcggcgctggaccactacacgctgcccaccgtccgccacattctgtccctgcacgtcctcgtcgactactacggcaacaagaagctcaagcagctctcgcgcggcgccaccgcctccgcatccatgttccagtctaccgggacggcgtcgggcatgtcgggctacgtgaacatcacgtcccacaagggtggcaaggtggagttcgtcagccaggacgccgacgacaccgtcaagccgtcccggtacgtcaagtccatcaaggagatcccctacgacatctcggtgctcgagatcaact

SEQ ID NO: 76922 - DNA, 407 bp, Triticum aestivum
  Clone ID: PAT_TA_76922
ccaccctccgcccgtccaatccacctcacaatcccgccgccggccggcgccatgtcgcccccttccaccccattcccctccacggcctcgctgctcctcgccggcagcaggctcccgcggctccagatccagtcgccccgcgcccccaccaagcccccgtaccgctccgcctccccctccccctaccgtccgtggctccgcggcgtcgccaggcgccccctgctcgtccccgcctccgcttccgtccttcccctccgggtgacggtcgctcctccgctgggggtggaggctgcggatgaatcgggccggccggcggctgctcctcccctgggggcggaggctgaggatgaaccgggcagccggctggcggctgcgaggagggtcgcagtggcgcttatctgcagcgc

SEQ ID NO: 76923 - DNA, 655 bp, Triticum aestivum
  Clone ID: PAT_TA_76923
aggaaataattcaccagatctcagaaacggtttatccaatgtacaaggctttcattgagccggatttgaagacagcgcacataagaattatcaacaagttcaaccctttctcagggttccagaatcctatgtacattctgaagtcaccacggtctctaacacctgatcaaatcaaagctgctcttggcgaagatcaaacagaaagcaatgaagaaacttatgatatctatttacttccaccgggtgaagatccagaagcatgccaatcttatctgagaatgcggaatagggaagggaaatataatctgatgtttgaggagtgggtgactgataatccttttatcatatcaccgaggattacttttgaagtcagtgtacgtcttcttggtggtttgatggcgttgggatatactatagcagctatactgaagagaagcagccgtgtgttttctgatggcaaggctactgttaaaattgactggctggagcaacttaaccgaaggtatatacaggtgcaaggtagagacagactttatgtcaaatttgtagcagagcagttagggtttggatggttcttatatcccacgcacgtatattgaacaaattcaactggagaaactgatgaatgatgttatggcattaccagatgatttga

SEQ ID NO: 76924 - DNA, 627 bp, Triticum aestivum
  Clone ID: PAT_TA_76924
cggcacgaggaaagcaatccctcactccatattcataagcggtggcggcgccttcccctccgaggctccgaatctccacctagctctgcatctctgcttccatattttcttgcgccgcctctttccagatctatttggtgtcaatcatccttctcagttctcaccataccaatccatctggttgcccctcgtcggattggaatttggatcttgtgtcaatagtgcaggggagggattagtggatcctcgatggacagccgacgagatccacatgaacatcctctgcacctgccccttccacacggagatcatcttcaggcatggaaggtacatacacatcggaggattcagaagtacaaacatgtgctacctgctaataacttcggttccttaattactattgatttcattggaagtctttcccatcccacatgtgtttccaaggatcttctaaggccatgaggcctatgggtaagttcctcaggttctgctgccgatgagtacgtgaaggcagccgggtacaacgatgaaggtaagagatttaacgaacacacatactctgtcaatttgggctgtggtgcgtgcagggtggtgaagagcttgccggagtatacagaggggttcgtg

SEQ ID NO: 76925 - DNA, 236 bp, Triticum aestivum
  Clone ID: PAT_TA_76925
ggccacacgtcccacttgaaaaggtctctttcagcggaacacctaatcttgaaagcattgtgctcttatatgcggacatatggcggctatgtcccgacatctttgtaaaagatgcccttcctcctaaggtccggaaggttgctctcacacttccaatgctgcactcgcccaactttgagattacgcctaagatgtcagtatccatcattacaacactgatcctcaacaagaaataa

SEQ ID NO: 76926 - DNA, 538 bp, Triticum aestivum
  Clone ID: PAT_TA_76926
ggcacgaggctctcctccatcaaatcgggggaggaaacgacggcgaccaccgcagctagcatctctgtcgcagcagttgcgttgcgtcgcccgtcgcgtgcttcatcggagcacccgggtcgccgtcgcagcgcagacggcgccaccgcgtgcgcgtggcggtgctgcagtggagcgcttgtcgccggctcccggtgctgtggcgcggcgctcgcacggtggactggagctcggtgctgcaaggaagcttcactggcggcgcccgaagcaccccgtcgccatcgcagctgcatacgccgcggtgttgcaatggagcggtcggcggcggctcccggtggtgcgatgcagcgcttgcgcggcggcccggagctccgtgctgcaacggtgcgtcgccggcggctgcaatggagcttcacctgcgaagcccagagctgtgaagcagcgcccggcgctccaatggagcttcaccggcgagcccggagctgctctgcagcgggtcgtgcggcgttggagctccgccggggctgcaatggagctc

SEQ ID NO: 76927 - DNA, 209 bp, Triticum aestivum
  Clone ID: PAT_TA_76927
agaaaaatttctatcaactgaagcggctgatatcattttttctagtggagttaatgcaaaaaagaagttttataatgattagttctgcttcttcaaatgaaagagttaagcgcttccaagggactccaaccattattcaggacgattctcctatcactcatgtggatgtgaccgaagacataccagcctctgacgtgtgatacaagagt

SEQ ID NO: 76928 - DNA, 594 bp, Triticum aestivum
  Clone ID: PAT_TA_76928
ggcacgaggcaagaaggggaggggggtgaccaaaaaattgagcttgatgaatcttccatggaggcaatggaagagcagaaacagcctccagaggacactcctgagaccaaaccagcatctcaaggcactactccagccaactccgatttgaacggcgaggaagggatgacgaccacgacagcgccggaccagaagaaaggaatgcaggaggatctggttcagcaccatacaccaagtgcacacctccacccaactcgacggtctgcgacctctccaactcgcgcttcgacatatgtgagttgtgcggcgatgctcgcaccattggtcagtcatccactgtcatgtacgtcctacacacacaaacttccgacggtgaagagtggagtattcgagcccagtctcgaaagaaccttccctggatcaagaaggtgactgtcaaatctctgaatacctcgcaaccagcagcaaagtgcacctccaagcatgccatgccagccattgtatttgcccttggtgggctcacagcaaatgtctggcacgacttcagtgacgtccttgttccactgttcctcactgcccgccagttcgacaggg

SEQ ID NO: 76929 - DNA, 683 bp, Triticum aestivum
  Clone ID: PAT_TA_76929
cggcacgaggaggaggatagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccgaaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggcgaagcgcgccaagagcaaggctagcagggagaggaagcatgccaggagggaggagagattggctcagggccccagagatcatgcaccagcaccagcggctgcagctccagctccggcagcagcggcaccaaagaaggccaaggccaagaagtgaaggtctgacatgaagc

SEQ ID NO: 76930 - DNA, 657 bp, Triticum aestivum
  Clone ID: PAT_TA_76930
cgaggcaagccttgatttcttgatggaaccagtggccgctgccgctgccgctgcatgcgccgccggcgctggttgttccagacccctctcttgactcctctctgctgccaccgctcactagaacctccaccgccacctccccgttgtctcatctccccctaccccatctcctcctatgccgaccagcaagtacgccgccggcgtggcccgtccctcaagtccacgacgcttcttctctgataactctcttgccttcttttctgatgcagcagccccaccgcccaccacctgctcctcctccccggcatttcctcgccgccggagccgcccttcccccaagtctgcgacgcctctcctgcatcctcctctgatgcagaagccccagcaccttcgcctctctccgctgtctccaccgacgccgaccttcgcgtatgccggctatgcgctacacatcatcggcggcggcggctccttccacgcctacgtgctccaggttcttccaattagagtacgagctactccccgaggactgctttgttgtgtgcaattggagcgccacccacgagctccacactcgcgttctcctccaattgactccatctggaagatggctggtctggtgtgatgttggcgtggaggaactatgctctgctattg

SEQ ID NO: 76931 - DNA, 374 bp, Triticum aestivum
  Clone ID: PAT_TA_76931
tcggcacgaggacgccatggactacttcgcctccgtcggcttcgcgccgggcttccacgtcaacccggccgacttcatgctcgacctcgctaatggctttgcgcaagcggagtacagcgatcgcgcggcggagggagtcagcgtcaagcagtcgctgatcgcgtcctacgccagggagctcgcccccaaggtaaaggccgccatcggcgccggcgcgcacgtcgagaatggtcacgccggcggcggcgcgggcgagcagccgctggagagctgcagcgggtctgggtgcaccaggtggaccaaccagttcaccatcctgctccggcgcagcctcaaggagcgccgtcacgagaccttcacgtcgttccgcctct

SEQ ID NO: 76932 - DNA, 557 bp, Triticum aestivum
  Clone ID: PAT_TA_76932
cggcacgaggggcatgtcggtgtctgaacttgcaccctcttttgcagcctcgacgtcaatagtctgcctctctgggttccaggaggtcaaccctgaataccttccagcaatctacccagtctgtggtaatctcacctcccttaacgttagcttcgcaagcctaactgctgaggatctgacaccagtcattcgccaatgccacaaacttcagacattctgggttcttgatactgtgggtgatgaaggcctcagggctgtggctgagacatgctctgatcttcgtgagctgcgagtatttccgctggatgccaccgaagactctgatgggtctgtgtcagatgttgggcttcaggctatatccgaaggttgccgaaagcttgaatccatactttacttttgccagcggatgacaaatgctgcggtcgtagctatgtccaataactgccctgaccttgtggtattccgtctttgcatcatgggtcgccaccgccctgaccgtattactggggagcccatggatgacggctttggcgcgatagtgaagaactgcaagaaac

SEQ ID NO: 76933 - DNA, 626 bp, Triticum aestivum
  Clone ID: PAT_TA_76933
cggacgagggccgtctcccagatgtcaaacacttatggtattccatctcagcagcagcaacagtccactcagccttcccaatcacagcagcagcaacaacaacagcaacagcgtcgaacgtttggatttactgaaacttcttcagtttcattaattccagatggcaacaagccatcagtaaactcgacgccagttgctcctgttacaactacttctactctttcaaactatactaagcctgcagtgacatcgcagtcttcttacagtcattcacaaccaactcaacaggtacagcagcctcttcatcaacagcatacatcccaacaacaaatgtataatcctatgtatggagctcattacccctatgtgaatttgtatagcccagtagcaggtagagctgaagacactccttatgctactccatatcatatgccatatgccgcttatgggtatggatgtttcatcattggcacaaatgatgccacatatgccgatgcaagctgcgattcccagtcatcatcaacaacagcaggcttcccatcgaggagaccatcatcaaactttcaatgatatgaagcagaattatggccaaaatgcgtcatcgaatcaaaactcttcaactggaa

SEQ ID NO: 76934 - DNA, 633 bp, Triticum aestivum
  Clone ID: PAT_TA_76934
ggctacaacaccacttgatcgaagaaggtagctcttcaccagctccatcgccgtggcaatggcgcggcgcggcggcatgggtcagctgctggtggcaggatgctgcctcctggtggcgctcgcgctggcgtgcagcgtggcctcggggcaaacgtcgcagactggtcagcccatcaagctcccgcccaaggccacgttccagaccatcaccatccccaaaaacagcaccaagcgcctgtacgcggtcacctgccacgagaggcgaggaaagccctgcgtcgtgtcctgcccaagccgatgccccaacaagtgcctcgcctactgcaaatactgcatggcattctgcgtgtgtgatctcgtcccgggtagctcgtgcggagaccctcgcttcaccggcggggacggcaacaccttctacttccacggcaagaaggaccaggacttctgcatcgtctccgacgaggccctccacatcaacgcccacttcatcggcaaccacaaccctgccataaggcgcaacttcacgtggatccaggccatcggcgtcagcttcggccagcaccgcctctacgtcggcgctcgcaaggccgacgtctgggacgaggaggaggaccacatccacgtcatgctgga

SEQ ID NO: 76935 - DNA, 753 bp, Triticum aestivum
  Clone ID: PAT_TA_76935
ggcacgaggagcagagtttaactgtctcatcaagtcctgcatatgttgaaaaaaacatacattacgtgcatttctagatatgtgtggtgctaactgactggtgacacaatcttatcttcagaaacagaaatacccagcaccttgtcttgtccttttttcatggaattgtattacctgtaaactgtgcaattactcacaaaagtgtcatttcactttactatgcggtatgcgccttggggtttggcaagacatactcaatgtctaggctatcaaacaccatctcaatggttaaaaagaaggtgatgagctaattactgtatagtgcaggattaattcataattagtagtgccaattttgctagtatctgctctcctttgatccctttccatgtgcctaaccacgatattttgagaggactgggcgcataatttgtttacttttgcatatgcggctgaactacgaagctgatatatcttatgttatgtttgctgaacctgatgatgttttatttatttcttgtatgcgccagcactgtattaatgccattgtattgaagtgatacctcttgttcatgctgcaggaggagttccgaaatctctgcgatgaaatagaagtaatttcttgagcaacactgatagattttgagcacacttttgggctcaacataatcagcttcaagtttattaacacccgcgacaaatgttgtgatttgtagcagcatttttaaatgtttaatgacatgactatcaatt

SEQ ID NO: 76936 - DNA, 721 bp, Triticum aestivum
  unsure (1)..(721): unsure at all n locations
  Clone ID: PAT_TA_76936
cgaggcacgtgcctcttgatctgcagtgctttcataatcaaggcacaagatactgcggttccagctacagtcacaatgagattatcagcgagaccaatcgaggatgatggcacaatcaacggagacgcaagcatcgagttggataagtgcagagagatcgttgataactgccactattataccacctccatgccagaaggttcagtgcaaagagataacgcaactagaatgtgcaataatttccagaactctcaagccaactgtgtccgtttatactactcgaatccaaaatgcttcagctactgctggggacaatgtatggccttaccatggaatgcttactggtcatgcttgaagttctgcggttattgttacgatattgcagagacttgtcaaagtggtcaagatgcttgtaagaatgccgctgataactataatgttggtgctgactgtcactgccctaatgctcaagtcgatgattgccaactcaaaatgcaacgtcaagacattccatgctatcaaacttgcattgacaactgcaatactttcaagacttggcaaacctggaaacgttgctttgacgggtgtgaaggatgctacgactacngaagaagctattaagtttgtattccatgataatctatatatatcactctataaacaaatgaagagtatttgagaattatacactccgcaggtactagaacctcacacaaaacta

SEQ ID NO: 76937 - DNA, 670 bp, Triticum aestivum
  Clone ID: PAT_TA_76937
ggcacgagggcttactcagcttgcagcaagcaagtcttcctccccctcttcttctaccctctagctagctagctttctggatcctccatatatacaccacacactcgctgaggcctcagctagtgcacaccaacaaaaagaaggagcggccaaaatctcatactagatcgatccatcgatggggatctagctaattctccaccctatctggtttgattagctgcaatttcatggcgcacaagatccagggcatcatggcgaagaagacaagtaattaatcaagaaagcttgctagccaccaagaaagaagagcatatcaagaaaggaagcaagctaggtagcacagatcagttaggttaggtggagatggccaacaggtggtgggacgaaggccggctgacggaggcgccgcctgcatcaggcctcgccagcaaccacaaccagcagcagcagctggaggacgccatggcggcgcccaaggtggacggggagagcagccacagcggcggagggagcgggcaggagcaggacgacgagcccaaggaggggcgcggtgggtggtgccggccaaccggcgcccgcgcggccgccccccgggctccaagaacaagcccaagccgcccatcttcgtcacgcgcgacagccccaacgcgctgcgcagccacgtcat

SEQ ID NO: 76938 - DNA, 491 bp, Triticum aestivum
  Clone ID: PAT_TA_76938
gagggcgaatctttatcgctcgtcaacgtcgtccgagccaccgcttcccagcgctgccggccatggacgcctccaccacatcctcctcatcccctctctgcttcgcccagaagcctcccagcccgaggcccctcctcaaccccacccctcgagccacccacgccggcgccggccgccagagagccacccgcctccgcggcatctcgccgtcgccgtcgccgtccccaccgaccccgcagcagcagcagcagcagccaatggaggcgttcggcttcgacgcgctcaaggagaccttctcggtggacgtggcggcggccgaggcccgcccgctcaacgtgccgctcgccgcgcccttcaccatcgcctcctcgcgcctcgacgccgtctccaacgtcgccgtgcgggtcgagctctccagcggcgccgtcggctggggcgaggcccccgtgctcccctccgtcaccgccgaggaccagcccgccgcgctcgcc

SEQ ID NO: 76939 - DNA, 693 bp, Triticum aestivum
  Clone ID: PAT_TA_76939
aatgggacggaaaatgccaagagcaatcataacagaccaggatgaagctatagcaaaagcaatttcggaggtcatgccacaagtaaagcacaggttctgtaagttccacgtaatgaggaaagcacgggaaatgcttggaggcttcatagcggcaagaggtaacataagttcagagttgcgtgccctagttaacaactctctgacagaagcagaatttgaggaaggatgggctgcgctgattgagatgtacagtgcaagtgaaaatgagtacctgcaactcctatgggaaacaaggaaagagtgggtgcctgtttatttcagagaagatttctatccatttgtggaaacgactggatgttgcgagggggcaaactcattattcaaggactatgtgcttcctaaggacagaatagagaagttccttgaaagatatgaagacgtacaagagaggataatggaaacggatgatgaagataggctgcaatcaagaactgaaccttcatgtttctcaatgcagccaatagaaaagcatgcggcacgcatttacaccaggcagatatttctgaaagtgcagagggagctactccattctacagcattcaacgtgcaggagatacagacggggacagtgtacagactggaaaaggtgtccgcctaccagaacccagagtttgacagaaattccttcgagct

SEQ ID NO: 76940 - DNA, 732 bp, Triticum aestivum
  Clone ID: PAT_TA_76940
tttttttttttttttttttttcagagaatcactttgacacagtttttttttagggaagccacttgatggacttcggtcgatcaggtagcagtacacgtttatcattcgatcaaacatagctaaggggttcatcgtcccaatacataggagaattagaattaaacatgatcacttaaataccttgaccaaacaaaccattgcatgcttgaatcgcttccaggcagtcagactcaacgatgatggtaaacatgatcacttaaataccttgaccatacaaaccattgcacgcttgaatcacttccaggcagtcagactcgacgatgatggtgtttacatcccaagttttcaaccagttctgggcccttctggatagtggtcgcctccaccgtggccgagtccaacatgtgatcaagaacccagcaaccggttcaccatgatcattgcggaggaccgcagccactgcccctgttccattttcaaagtatgatgatgcatcccattcagtttataagaattccaaggaggcttccctcatcgtatcaggactggttgtgaactgctcagagcttttgcataggtcgcgctaatagcctgaattgcaaacacagttgactgagcaggttccacctttccgtcgctgccacaagatataccatgcccctacagcggtcgtctcctgtacaccgtaccgacccataaccgctgaatgtttgacagtactcctcaaaattt

SEQ ID NO: 76941 - DNA, 637 bp, Triticum aestivum
  unsure (1)..(637): unsure at all n locations
  Clone ID: PAT_TA_76941
ccccggacagccggagagcgaggttaaccggcgacgcctaccgcaaccatgctcagggtcgcaggtcgacgcatatcctcccatctcgcatggcgccccgccgcggccgcctccgccggcagcagccccctcgccggcggcctccctggcgacgacttcccccgggaccagaatccgcgcttcgccatcgaatcacccttccacgtcgctgccagaggcttttcggctgaatctcttgttccgagggaccaggatgtagagttggctgagctcacaccaactacggcagctctgaagaatccctgtgccaaaattgtctacgatgagtataaccacgagaggtacccacctggtgaccccagcaagcgtgcctttgcctactttgtgttgagtggtgggagatttgtgtacgcatccttgttgcgtttgctcgtcttaaagtttgtcctgagtatgtcagcaagtaaggatgtgcttgcccttgcttcccttgaggttgacctgtcaagtattgagcccggtaccactgtgactgtaaagtggcggggcaagccagttttcatcangcgcaggaccgaagatgatgtgaagctggccaacagtgttgatgttacatctctccgtgatccacaggagg

SEQ ID NO: 76942 - DNA, 686 bp, Triticum aestivum
  Clone ID: PAT_TA_76942
cagagccaagtaaaacagcaccaccagctctgcaccgccgtggggccgtctccctccgccgccggagctgtagcaccgccgaactcgactcgagcctagcgagaaagccattttgtttgccgagagcagcaacggcaattgggtctaccagaggcagaggggatatgatcaaggtacaggccccggagctgtacagagacagcggcgcgttcgaggcgaggaagaggcagtcgctcagggcgcggtacgtctacgggctcatcttcttcgccaccaacctgctggcctggttcatcagggactacggggccaagctgctcggcggactgcaccatatcccggtctgtggagcaggggactcgaaatgcttccgttctggaggggtgctccgggttagcctgggttgctttatatttttctgggtgatgtttgccacaacatttggaacacgcaagctccagggagttcgtaattcgtggcattctggatgctgggctctcaagtttcttgtgtatgccgtgtcaatcgtcaccccgtttatcatccctaacatcttcatccagctctatggtgaaattgctcgaatgggtgccgggatatttctcattctgcagcttataagcatgctccacctcatatcatggtgcaataaacgttggatgccagatgctggatcaaatcaatgc

SEQ ID NO: 76943 - DNA, 765 bp, Triticum aestivum
  Clone ID: PAT_TA_76943
cgagggcaaaccgtgcgacagcgagacagagaaaactagggatccgccgccgccgccgccgcctcgcccgccacccgtccgtgcgtcgccgctctacccccggtccacccgttcgaccgtcgccgcccactccgcccgccgtcggtgccctccgagctcctcccctcccggtcatcgcccgccggccggccgtgcccaaaagcgcctcacagaatcactggtcagcgcgtggtcttcctccacctccacctcacagcccgccgtcttccgccccaaggacgacgagatctccctcctcaccgtcaacatcaccacaggcttcagccccacgataatggagtgtgcagcgaaggggatagtggaggatccatgcgccagcggcgccaaccggcggtgcggcagctgcggggccgtagcctactgctcgaaagaccaccagttcatacattggaaagttcataaagaagaatgtgcaaggcttgcaacacaaatgagtcgcattgatatgctcagccaatttccgttcacattctccgtcgaacctcatgctctgaatcatacaaaacgaagtatgaggtgcttatttttggagtcaatgaaagttcacctgaaaggactctggaaatcaggatgcatgtgtggcccagatattgcttctgtcaaggacctgagcataacaactgaatggaacatggaaagctcactttgcccatgtacagagcctgaaaatcctgtgcccgcacccctggcaagctgggaagacta

SEQ ID NO: 76944 - DNA, 553 bp, Triticum aestivum
  Clone ID: PAT_TA_76944
cacgatcatagaccagggacccctcccagcccccgcgtcgctccaggggcgactcgggaggcgaaaccctagccgccgcccaggctcccctccttcccctccctctcctcgccgtcgccggaggatgccggcgggcaaagccctcaccggtggacggcggcggcggggccctcgttcgtgtgctcgcgcgctgctgctgggcgcgctggagcggcgggagcgcgcggtggcgcggcgggcggccgtttgctcgcggggaggtcgagatggggtggactgcgtgcgcggtggcgctgccatggcggccgccggccgctgatgcgtgcggcagagttgagggcgcccagatctgggccgcacgagcccgcccaggctctgcccccactaacccttctccctcctcccacccctcccggccgccgccggcggttgccgctgggttagtaagcacgcgtacggccaccctgacggttgctgctccgctgtgccccggcggatcctggcggcggaggctgcgggccagcgtggcggcggcgcggtgcaggtggctgct

SEQ ID NO: 76945 - DNA, 735 bp, Triticum aestivum
  Clone ID: PAT_TA_76945
cccaaccggcagtaagcaatcacttgttttctaccccaatattgtgtttgtctgtctaaatgattggctctatgagaagttgcattggatgaattcgtgctccatgattatggtggcgatttctgtatgcaatttctctgattcatgctcgagtgttgtgggcctatgaactgggggttcgggtcaatttacatggcctacccatttcttcaaaacttttcactgctcgaactgtatagagtgaattgtagcacatatgtgagcaaaatcatgaggccatgatggtacatatttgatacaatacgtatgttttgccttcgtcaaagttctcggacacaaaaagctggtttcttagttgcctgtttgtatctcaaatgatttttgagttttatgttctgataaaaatgcattgctgtcggtaattattccttctaagtaacctccttcatcttcaagctaacaaaggagaaaatgtctcactataatgagaaattgcgacaagagctggtaagtgctttcacaactgcggcagttttgaaccaaagttgtattctagggtattattcttaaaacaaattccatcatttctttatttcttaaccattaatctcaatgagttgtttatagctgtcactgatgtaatgttaaaccgattataaaaatggccttttcttttactttctgataatgacatgctaattcatcttatatttctgttttaagtaactatctcta

SEQ ID NO: 76946 - DNA, 637 bp, Triticum aestivum
  Clone ID: PAT_TA_76946
agcctttggctccccacaccacacgttgcctctctccctccgctctccatcaggtaacatccatgcaaacagcaatgcgcgttcatatgtcagatgtgcaagctagacactggattaccagatgtgtgtgactagtacgccctgtgaatttagcaactgacgtaatccttttatttgtggtttgctaattcccactcaactccgtacaagattccgcaattttatgagcttctgtattattcttttgaatgatacgtaatcaccactattaataaaaaaccgagaaagaatatatatgcaagagttttggagattttagaattgccggtaagtttgttgcttcgagttgaagatttacaccgacaaaagacgagatgtgcacacaaagctttaagcactaattaagccttagtgaatatctacactagtaagtttttcttcatgtttgaaatgcttagcattgtagatactccctaaggcttgggtggtattgcgttgtgtggccactcgatcaactttggcctcccgtcggcagtgtagagcaaagggatgtgtatactacttgattcaccttttttctcgacaggtacatgaaggaatatatatggttgctagcttcatgcatatgctactattt

SEQ ID NO: 76947 - DNA, 751 bp, Triticum aestivum
  Clone ID: PAT_TA_76947
ttttctgaatgttgtctacaaaattgcatcactacagtatgcgaattcactatgcatcagttttcagaaagacaacttatgaatatgacgcgtctccatttcagtacgagtttgaatttggaggcactaaatatttctatatgacttgtatcacatcagtggttagcttacaagttatttagtgattacttccagactggtccatacaagttcaccgtttcttcatgtttttggttaagatatttgactactaagctccctttaaataaactggttgtgcagcgtcattgactatccaaatttaaacatgcacatcttcaaatgcatttgtaaacctttgatgattctcctcgatgcaaccaattcatgggcactttcctgccctcgacgtctgcagttgtgctgacgaagtttgaatactaatctgaagtatttgtgttgtcgtgagaagaaatgtagagaagtgatcaatgagcggctcaaggtgctgcagaaccttatccataacggaaccaatgtgagatgtttttaaatcttaaattcttaatagttcgaactgctactggaacaaattttatactcgatcgtacatctggcgaatggtgatgtggttctaaatttctaatgtgtttaagactctggattccaggtggaaatcagcatgatgaagttcactacatcaagttcatgcaactctagatcatatcgggttcttgcaaaattacaatcacatattacctttatttaatta

SEQ ID NO: 76948 - DNA, 635 bp, Triticum aestivum
  Clone ID: PAT_TA_76948
ggcacgaggcctataccaaatcaggcgagcgctcgttgccggatcactgaaccatcgtcctggtggccaccgcgtcagttccacaccactacagcgacaccaactaccgccactccattggcttagatttggctatggcgtgggctaggaaccgtatggtattgtctgatgcgtgttctgcactgggtggtttggtcagctgacgctaggtgtaggcagtttctgagcctggttgctggatgtgggcacgcatgcatgtatataatgggtatcatggtcatgttgcttggacggggacgatgatgaagattgtggctgaaagctgtggtggtgcctactaagagcaacagaagtaaatggtccagaactgataaacatatatgttggagaatcggagaagaatatcagggacctctttcagaaggcttgatcagcattcccatgagtaattttcttcgatgagcttgattcccttgctcctgcatgagggtcgtctgcagccgctggagatgtatggatatagtggtttctcatgtataattaacctcataaatgaggacaagtgcctgacggagatgcatatgtttggcattctatcagtaacatacacttgtgctagcttgcagtactacatt

SEQ ID NO: 76949 - DNA, 550 bp, Triticum aestivum
  Clone ID: PAT_TA_76949
tggagggggaggaaaggctgacggaaaggataccttgaggctaagattggacttgaacttggatgtagaagtcgagctcaaggcgagaatacacggtgatttgacattggcactcttgtcttgaattatatctcccttttttcgttttttcgggatacacaaggggttcaccatacccgcctggttatcttttctatcgttggttcagatttacgggcatccgtactggtacccgcaaagatggccatcttttagaagcatattagtttcttattttttttagtccggcttttatctcatggcttttgtcaagttgttttccctttgtaatgtttcgagtttgggcacattgtgttaccacttcacaaacccccattggttttttttgtttatgggttatgggattagtctttcactttgatttcatttactatgtcctttttacatttttttttttatgtttgtatacatgtgctccgaggcatatctagccatcacatctatggcttcagctagagagtgaacgatggatttatcaatctttaatacg

SEQ ID NO: 76950 - DNA, 628 bp, Triticum aestivum
  Clone ID: PAT_TA_76950
taggctcctccccgctggggcagggccgtgcaccctcccgcccgtgcgcgcctccgccgccgacgtctccgcgtgctacgcaccatcccgcctccgccgcgactcggctccgtctccccacgtccacgcctcagcgctccaggtatcgagcctctgaaacccgtctaaacccctttttttgggtttgactgacagcggagcaaccgctggcacggcgtagcatccacgcagccgcggtggcatagcatcgacgcgcggcgagttcgctcccctcccctcccctccccctggccgcctacaaaactcgctcgaatcttgagcccgccgaccctctctctcccccacctccgtcttctcccaggctccagaacctcgttttgccgtctaagtcgcaggactcgccagcgaagatggccggtgagagcagcaccaggcggcccctcttcggcggcgccatctccaccgccttccccgtccggttccaggatgtgagcaacattcgcgaggtccccgaccaccaggaagttctcgttgatcccgcccgtgacgagagcctcatcttcgagctgctcgacctcaagggcgaggtggaggacggcggcagcgcgctctggttcctgcgcgacgt

SEQ ID NO: 76951 - DNA, 638 bp, Triticum aestivum
  Clone ID: PAT_TA_76951
ttttttttttttttttttttttgaaagttttcaagacactcaacatctgatagttaccgacacaacattgggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttcccagagcacgccgttctccagctccctgtacgggaacgaatccgacagaagctcgtcgccggaaagcttgtcctgg

SEQ ID NO: 76952 - DNA, 747 bp, Triticum aestivum
  Clone ID: PAT_TA_76952
cttgggagctcacttctcactcttccttcctcacatacattgatcttcaaacaacagtctccatggtgcactgcccgctagtatctgctccctgtcagcactttcgatacttgaccttacctacaaccagctcacaggaaaaaatccctatgagattggaacctgcaaagtctcagctatcttggtctctcatttaatagactcacaggacatatccctgtgtctctgggcaacctaacaatgttaaatgtacttgtcattcaccaaaccatggtatcaggtagcattcctgaggaggttggaaggcttgtcaacctacaaattctacagctaagcaacaacaccttaagtggttttataccaaaaacctttggaaatctaacccaactaagtgttttgctcctgtttggtaatcgactttcagggcctataccccaagaactaggcaagctagtccatttgcaaggtctttatcttaatgcaaatgatttttcaggtccaattccaatctccataaccaatgtcactaagctgaacacaccttttctctttgcaaatcaaatcacaggttcaatacccccagaactaggcgacctcaacatgctaaacaaacttgatctcgatagaaatgaaataacaggttcaataccaccagattagggaacctcactatgctcagtgaactttatctcaatacaaatcaaatcacaggcccaataccttcagaattgggcatcttgctgaatc

SEQ ID NO: 76953 - DNA, 670 bp, Triticum aestivum
  Clone ID: PAT_TA_76953
ttgctaagaacccgactgacaatgttatcacaacagttattggcacaacattcgactcggtttgtgaggtgtatgacttctacaatttgtactcgtgggagaagggctttggcattcgttacgggaagagcaggctaaatgtggagatgaccaaagcatgcaggaaatagtttgtggttgctcggtggatgttttttttgttacttatttttatgctgggacatacaattcatattcgtgccctgtgtgtggtgtcgacaaaattactgaactcactggcttttgttggaaatcattttgcagggcaaagctggtgtggagaacaccaggtcttgtcgttgtgagtgcccctctctaataaggctgctacgagcagaggacaacggatggtacattgcagagcagagagacagtcacaaccacttgctgttgcctaatttcggggaggccactcatgagggaaaaccttgcagtggaaaggcatgctagcaagatatatacaagagccatgtttgaacagtttgggcatatattgtatgaatgtggcacttatcaagttgaagagattgagagacacaagacatatgtcgcaatccacagcgaggcagagaagagagataaatggtgcagagtggcatacaaggttaggatgctagatggcggtgatgaa

SEQ ID NO: 76954 - DNA, 630 bp, Triticum aestivum
  Clone ID: PAT_TA_76954
gaggagagaaaaatgtttccactgtcagctttgccaagatgcatcgctctccgctcaaagcatgacaacagctacctgcgctccgtgcacgacgagagccagggcggcagtttcatcgagctaagcgctggcgacggaggcgtcatgaacccgcgctccaggttctacctggagccgtccaaggagcacgacgggctcgtgcacgtcagatgctgctacaacaacaagtactgggtgccacagcagcgcgtgcttcacggcagcactcggtggactattggcaccgcaaatgagctggaggaggacctctccaagccgtcatgcaccctgtttaagcacatccccgtcgccgacgaggaggactccacctgcaggttcctccattcccagctaggaaaatatgcttgcgtgaaatcaagttctgatatgtccaaacgtccctacttgcatatagcacacgaagaagctgatcaagataatctccttcgtgccttcactatccttgatgtgtcggaacagaagcagttgcctacttatcttgctttcaaaggtgacaatgggcagttccttggcgcgaagatcgtcgagggttataattatcttgaatattcccaaacagatattggagat

SEQ ID NO: 76955 - DNA, 370 bp, Triticum aestivum
  Clone ID: PAT_TA_76955
taagactggtgctaaaccattatttattaaatatggtttgaatcatgttactgatttgattgaatctaagaaggctaaattagtcgtaattgcccatgatgttgatcctatcgaacttgtcgtttggctcccagccctttgtcgtaagatgaatgtcccttattgtattgttaagggtaaagcacgtttaggacatttggtgcataaaaagactgcaactgttgttgctgtcactgatttaaagaaagaagatactgcgaaattagatcaatttgttgctaacatccgtggaacatacaacgatgatgtctctcatcgtcataaatggggtggtggtacagttggtattaaagcacaacatgttattcgt

SEQ ID NO: 76956 - DNA, 661 bp, Triticum aestivum
  Clone ID: PAT_TA_76956
cttgtcacccagaaaagggatgttttgccgagggagagaaccttatcgaaaaatagatacccaaagctgcatattccagatcacatttcggagttccccatgtcgcgtattgagaaagcgaccaataacttccactcaaaaaatctcataggagaaggaggctatggtccagtctacaaaggaaaactaggtggtatcatagtggctatcaagatgttgggaccccatggtaaaccccatggtaaacaaggtttcccagagtttcagcaggaggttgtggtactgagcagaaccgagcacccacacatcgtgaggctgattggcgtgtgccaggaatcatgcatcctcatttacgagcacctccccaatggcacgctcatggatgggctctccaaggggcttccatggaaggaccgcgtcaggatcctcgccgagcagcgctccgcgctggcgcacctccactccagcttcccccacgccatcatccacgcggacctgaagctgacgaacatcctcctcgacgccgggaatgtgagccggctaggggactttggaacggcgcgcattgtgcagatgaagcccctgaaggaggacacaatctgccggtggaccaacccgatgggcacaatggggtacatggaccccatcttcttcatgactg

SEQ ID NO: 76957 - DNA, 729 bp, Triticum aestivum
  Clone ID: PAT_TA_76957
gatgtagtgaacaactgatgaacactgctctctaaaaatactacgctaggtcgccgctaaaatctaaactccaacttcgaaaactttgcataaagcttctgaaatgattgttgaaaatacttctcctttgaaaatgactctactttaatattgttcgtgtcctctcagctcttcaatcttgaatgtgtccttgatttttcggaatttttctataaactccagtgcttgatttgattttcaataaaatgcccctcccttctcaaatctgatgactccccccgtaaatttctttatggttttcctatggtcctaaataaaagatccatctcccacctcatccctcaaaatcatctgtaatctataatctcacttccgaattttcctatgaacaaaacaaacatcccttgtgcaacattactgaacattactgaacgctgaacgcaatgatggaccggaaagaagaagagcagaaaacgagttccactccctggaaggaagccggcaaaagctcggccgagctgtatatcagaaacggatgaacgcgtgcttagggaccggttgccgggctgaaaggaatagataatacagccgccaatgtcaaggaagataccagcatccgtgcacaagaaatatgacgtcagacgcgtaacactacaacggccaaagatccaccatggtctttgactatttatcgccaggccagctgaacgcgctgttagggaccggacg

SEQ ID NO: 76958 - DNA, 599 bp, Triticum aestivum
  Clone ID: PAT_TA_76958
ggaatataaagcttttaaactgtcatgtgtaagagtgaagcatactggctggaacacttgtcctgacgtgtaaatgggcattccctcgctggcaggcaagataatatgcacactgacacaaacccttcagtttgatcagtacgtaagctagtagtaaaaaagatctgacctaatctgtaatagtgtttatgttagcaatgaaaaactgaaataagaagtacctgtgaagcacttccatcaagaagtagacctctccagacagtttcaaacccactttgaatgtctgtctttggtggagtgtgagcctgaaaagtggtagtagttgaaattagtagaaaatgtggcatcaagatatcttagacaaaaaatatatatttgtctactcaatgattggcaatagcttactcagttcctctgtccttttggagcgatcaaattaattacacttcatggcctatgaattgacaagtggagcaattaggggaaagcttcatggtcaggaagtagtgaagtgccaagtgatcatattaaaaattgtgcactttggctaaataacatatcccggttataaaaaaggaagacaaatgatgtcgcttgag

SEQ ID NO: 76959 - DNA, 650 bp, Triticum aestivum
  Clone ID: PAT_TA_76959
cacgagggcccctcgttgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatct

SEQ ID NO: 76960 - DNA, 649 bp, Triticum aestivum
  Clone ID: PAT_TA_76960
gctccggcaggcgcccggggctgctcgtcgtgcgcgccgccaggggcaagttcgagcggaacaagccccacgtcaacatcggcaccatcggccacgtcgaccacggcaagaccaccctcaccgccgcgctcaccatggtgctcgcctccgtcgggggcagcgcgcccaagaagtacgacgagatcgacgccgcccctgaggagcgcgcccgtggtatcaccatcaacaccgccaccgtcgagtacgagacggagacgcgccactacgcgcacgtcgactgccccggtcacgccgactacgtcaagaacatgattaccggggccgcccagatggacggcgccatcctcgtcgtctccggcgccgacggccccatgccgcagaccaaggagcacatcctgctcgccaagcaggtcggtgtccccagcattgttgttttcctcaacaagaaggaccaggtcgacgacgaggagctgctcgagctcgtcgatctcgaggtccgcgagctgctcacggcctatgaatacgatggtgacaatgtgccaatcgtctccggctctgcactcagagcgctcgaggccctcatggccacccctggcctcaagcgtggggataacgagtgggtggatggcatcttctccttgattgattc

SEQ ID NO: 76961 - DNA, 722 bp, Triticum aestivum
  Clone ID: PAT_TA_76961
ccgtttggagctgatgaagtgttccttctgtatcttggtgtctgctccatttcttgccggtgatggttttctttatctactcttgcatgggtgtgagactggtcttcttcattgatcttgcctctcggttggtgtttcttttttcaacctcccctttggacgcctgcaatgtggttatgggattgacgactctgcggtatggtcgatggctgcttggcctcctggttggggaccttctaccattcttgtggtgcagctttgttgcctggcgcatgcggctccccagattcaagggcgtcagtaacttcctcaacctctggttcctctgcggttccgagagaggcccttggtctggctgcttttctgtgaagctggtggcgattgaagctctggttttgcctatggtgaaccctgttccagtcagggtgaagctctggtttttcctatggtgaaccctattccagtcagcggtgaagctctggtttgcgtggcattctggatggttcgtaaggacccgtatgtgcacgtatccttgtagggcagccctttaacctttgtttcttttgtgtttgtcttaggtttccaggttctcctcttctttgtggcttgtttagccccatgcatcgagctcttaacataatgcaggaatcttttgccaacaaaataaacagatcgtgggtgcaggggagaaatatgatcatgggattagtgattttagtaca

SEQ ID NO: 76962 - DNA, 638 bp, Triticum aestivum
  Clone ID: PAT_TA_76962
ctggctccgggttctcttgctgccggagtcggcgcgcctcgcgccgccggccactccggccccgtccctgccccccgaccctgacgcgcctcccacgctcgtccaccccgaccacgacgcacgtcctgccgccggccactccggcctcgtcgtcgcccccgcccccccgaccccagcgcgcttcccgccgccggccctggatccccacgcgccaccggccctggatcccagcatgccgtcgtcggccctggatcccagcctgccgccccggccgctagccctggatcccaccaccgcgccgccgggcagtggacctctgtgcgctgcgcttccacgatggcggacggtaaccaccaacccatcatcatcgcctgcagtccgagcctatacgcctgcaccgttcaactcctacctcgagtacgtctgcgatggatgcatgccaccccctgctatggataaggtgtgatccgccgtcatctcctctcacggggtgcgcgactcccggaggccggaccacctcggcgcaccctgctggggagccgttcaacagggccaccttcagcaccctctcgggccgtcgttcaactacaccaactgggggtcgttcaacaaactcgcccgatgccgtacgaggcgga

SEQ ID NO: 76963 - DNA, 781 bp, Triticum aestivum
  Clone ID: PAT_TA_76963
agggcatgcgacatcgacacatatgagattggtgggacgggcccgtacaagaccgggacgactctcgtggaccccaaaggcgtgcaggcgtggcttccagcggaatatgacgatagtcggtatgggtggaagagggatccgggttggaagctgggagagtgtatatgggcccagcatggtgtctgggatccctcaacagacaccttgatcaacaacagttacttttctaaagcaccagatggcacacaagtgggcatgcatgaatggatcaacatctactataagaatcactgggcaaagttcaggaaagcggtacgatcggtacatgagacggctatcgtttttatgcaaagcccggtatttgagataccaccagtgctcaagggtactccggaggaggataacagaatggtgtttacgccgcatttctatgacgggattacgctcatgaccaagaactggaaccggtactggaatgtcgatgtccttggtgtaatcagaggccgctatttatctccggtctttgccatcaagatcggagaaactgccattagaaactgtttcaaggaccagctagccactatgcgtgatgaaggtcttcaaaacataggagagactccatgtctgttcagtgaaattggtataccttatgatatgaacgataagagtgcttacaaaaccggcgactactcctcccaaatccgtgcactggacgcaaatcattacgcactggaagggtcaaatctcaactataccatctggacatattgtgctactaacg

SEQ ID NO: 76964 - DNA, 676 bp, Triticum aestivum
  Clone ID: PAT_TA_76964
ccaggacaaggagggcattcccccggaccagcagcgtcttatcttcgccggcaagcagcttgaggatggccgcacccttgcggattacaacatccagaaggaatccaccctccacctggtactcaggcttcgtggtggcatgcaaatctttgtcaagaccctcactggcaagaccattaccctggaggttgagtcctcggacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaggctccgtggtggcatgcagatatttgtgaagaccctcacgggcaagaccatcaccctggaggtggagtcatctgacaccattgacaacgtgaaggcgaagatccaggacaaggagggcatccccccggaccagcagcgcctgatctttgctggtaagcagcttgaggatggccgcaccctggcggactacaacatccagaaggagtccacccttcacttggtgctccgtctccgtggtggccagtaaagctcctggccatggagctctgctttggtctctggggtcgcaagtctggtctttggtgtccttcattgagtctcg

SEQ ID NO: 76965 - DNA, 710 bp, Triticum aestivum
  Clone ID: PAT_TA_76965
gcacgaggcagaggtttaaagactccgaggatgatgcaaagtctgtcctggtgcaaatattgaatgttgtcgctttttgccacattcaaggagtggttcatagggatctcaaaccagagaattttctttttacttcgaaagatgagaactctcaacttaagacaattgactttggattatcagattttgtaaaaccagatgagagactaaatgatatcgttggaagtgcttattatgttgctccagaagttctgcatagatgctatagcacagaagcggatgtctggagtataggtgtcattgcatatatcctcctttgtggcagccgccctttttgggcacgcactgaatctggcatattccgttctgttctcaaagctgaccccagttataacgaggcaccttggccttctctgactccagaagcaatggacttcgttaagcgcttgctgtgcaaggatccacgtagaaggatgactgcagcacaagctttaggtcatccatggattagaaattacaatgacattaagatgccattggacgtccttatattccgtcttatcaaagcttatattcgttcttcatcattacgtaaagccgctctgaaggctttatcgaagactttgactgttgatgagcttttttatctcaaagggcagttttccttattggaacctgatagaaatggatgcatcaccctagataatatc

SEQ ID NO: 76966 - DNA, 760 bp, Triticum aestivum
  Clone ID: PAT_TA_76966
cgccgcaccgccccatcgcccctgaatcccgccaccaccccaccttcatctcctccccggaagctcccgctgcgcacacccacctgcgttcccccggagcggacgccacattagtcgcctacttgccccggctcactctgcctgcctcctattccagaaaaattgggggccatcggcggggatccaagcttttctcggctccacccagtgcctccccactctggcacgatcccccccaggtggagctcccgcacctaccttcttcctcatcccggttcccacacctccgcctcctcccgattgccctgacggggacacaatgccatcccagtcgagccccgcatcgtcagggaggttggggccatcgcgagtagcagtccagagcagtcaagccgcgagaccctgtgcctccacgggcctcatctcccgctatcggcaacagcactcccttcctccagcgcgtcgccgacgaggccaaccgcctacacggctacaccgtctttggctgcaacgatgtcgtctcaacgaggccaaccgcctacaccggcttcggctgcaacgacgtcgtctctctccgtcagccttctcgcctcctctcagctagcaagggaaacagtggagtagcttgttgcttgcaaagggataagtggaaggtgaagaaccgaagaaactgcagggacaaaagttggaggtctgctcaacatttttgttacggatgcctctttagtctttacagtttcagtcatccaccggcctcctc

SEQ ID NO: 76967 - DNA, 793 bp, Triticum aestivum
  Clone ID: PAT_TA_76967
gcacgaggacaaaatatacttgggccctcttgatgataatttacttttctcttaggaattcatcaaaagtttctctctcttctctgtatcttgagctcgaggcccaagaccaaaaccagaaatcatcaatcgagccgtgtgtggcacattaactcccgcacacccacacacccacacgcagacatcccacacccacctcactctcaaaccgcccgatcaccactcctgtttggtttctgcaaccttcaacaagcagtgtcttcataaagatcactagccccaccccactttttccgctccccttcctctttcgtggttcactagccagagaaacgcaccagcactgctgtaactgctgtccctaaccttcctcggaaattcttgtatcctcgactcacatcgaaggatcagcttcatccgagtgtccccatagcagctacccaaccagccaacttactcagcggtctgcagttacacactctctcaccacctacatcctagcaaccttaccagaaaaactttactttacaccttcatcaacatcaacctttatccttccgtcctccttcgacataatggcatctgttcttcctactcgacgacccaagctgacccttcagatcaatactgcggcagtctcccctgtggtcccgtctatcaagttggcatcccctgtggtgtcgaaaaagttcaagccagcccccgtgcaccgattctcttacggctccggttccgattccgacgacaacggcaagttctggtccggcgaagacgcttcttcagctacatcatc

SEQ ID NO: 76968 - DNA, 638 bp, Triticum aestivum
  Clone ID: PAT_TA_76968
acaaaaatggcgagtggcatgttgtttctgttgacgatcgccttccatgtggtcatagtggcaagctatttttcgccacttgtcgcgatccctctgagttctgggtaccgatagtcgagaaagcgtacgcgaaattacacggttcatacgacgctattgcttacggaaatattgcggatggactgaaggatttaaccggcgaagccgtggaggtcatattacttgacgacaaatcatacaatttgcaaccagaccaattgtggaaaaccctcgtgtacaacataaaagagagctatttgatgggatgtgcgctggagaattcttccgcgaatactgagcatgagcttccgacgggcctgttagtcaaccacgcatattcggttatagattgtgaggaagtcaagggagtaaaacttatgcgtattcgaaatccgtggggacgaggagagtggaatggcgcttggggcgacggatcaaaggagtggactccacagcttatgaagcacttcaagtacactttcgacaacgatggcacgttctttatgcggtttgaagatttcctgaagaatttcaatcggatttacgtgttacgcttgatgaccgactccgaaggagaggtttggcataagtttaatttc

SEQ ID NO: 76969 - DNA, 618 bp, Triticum aestivum
  Clone ID: PAT_TA_76969
cgcgcgctatgcccgatccagccgggctcctcccctttgctcaacctcccacgcctcccctagcttcttcccggcgccgtcccgaaccccggccgaagcagccgtcgccgctctccccaaatcgcgccgccactgccgtcaccgggtcgcgccgtcgccgccaccctccccagatcgccccacaaccactgccacactccaccgccgccctagccagtgccgccgcccgcaccccgcccaaaatcgccgcccccaacggcggccccgcacgcgcctccgccgggaccttccacctccacctcctccctgtgcttctcctccattgccggcgtgcttggatctggcgacgccagcgaccatcggagctcgccccccggctgtcttagctgccagatccgtcggccgcatacagcgccgctccatcttccccctccaccgggccttgcaacatctgatggcgaccaccactgcactcgctgtcgtgtgtggaccgcagcgatggttgggtccgaccttccgcctggatgagccggcgcaggaagcgtccacccccgcaccctgggatcttcgctccgaccgagatcctctagccgccgccatggagctcctcccccgcca

SEQ ID NO: 76970 - DNA, 739 bp, Triticum aestivum
  Clone ID: PAT_TA_76970
gagggtttgagtttattatttaatatattaaatgatgtcgtttcaatctaccaggatcggtgtatgtcgcaatgttaacaacactttacgaatccaaaatatttcaaatatggctcgaactgttcaaccaccaataattttcgtggacaacaacgctcaacgtcgtacaaacaacttgcttggacccaacaagaactttccatttcctggtgatgtcgcaatcgcgaacagttttggcgcacaacaactctcttttgataacaatcaaattgaagtaaatactattaaaccagagccgcaacctgattctccattcaaatccctttcaattgaacaaattcttagtctttcaccaaatgtcaagaaggctgctgattatgaacctgaaccattcgttgacaagctcaagtcaaattgcaatattgaattgaaagctgtaaattgtcctcgcttgctcaagaaagacttaaaatatctttttgttgacatggatttaactgataaacaaattactgtcctcaatctctctcaaaaatccgacgcagatatgggaacatggtctcctgatatggaagtggaacgtatgaagttgactgcatctttcattgattctgccaatgcaatatgtcaagcgctcaaagaatttggatattgggctgattttattgatccttcaagcggccgaccttaccttgggaaatttacgaatgcatccttatttgaaactgatgatcgatac

SEQ ID NO: 76971 - DNA, 650 bp, Triticum aestivum
  Clone ID: PAT_TA_76971
atgtaataagactgaggagagtactacgagacatttaccactttcaagccagaaacccttggatagagatggacaagctgctgaaggtgttgtcaagaaaagtggcgccgctgtagtcagaaatttgtttgatctgaatgatgatgtaccacatgaagataactcagagtcatcagtagtgtcacatgaatgtgatgtggtggccttacagaacaaccatgctaagcgcacatttttgtttgacttagaagaagtgccagcttgtgaagatggtgctgcctggacttctcaacaggaatgcacaccttctggcaagcttggtgcatccaaggaagctgatatgtgttttccatccgctacagatgcagcgcagattattcttgcgttgtcaacggatgtgccgaccaccacaggcacacccgatggtatgttgcagtggtttgcagagctcgcgatatcaagcatggatgaccatgccgagcaagcaaaagtccagggttgcatcgataattccagtgatgatggttcagactcatttgaagccttgacactgaagctggaagagtgcaagaccgatgagcgctggaccaggacaccagaaccaccactgacagacgatgaccaagctgtttcagcggtgaacctgctgt

SEQ ID NO: 76972 - DNA, 644 bp, Triticum aestivum
  Clone ID: PAT_TA_76972
tcctcccaccttctcccccaaatcctctggcaacgtcggcgcgcaacggcgctgccctcctgcgcccactctgcccacctccaggggacctcgccttgtgatggatccggccctgccgcgcccctcctccctcgtgctggatccgccgccacccgatggatcccgtcggccctcgaccatcccgccgccggagcatcaccatgccgcggggggtgcgcggcggcacgaccactgtctaccggtggtgacccgtccctgaacccctcttgcccccctgcagtcaccactgtctaccatcttcttcccggaaccaccgcgctgtggcaccaccacctccccgcgccgccgcaccagctccctccctgcgccgccgcaccctctccaaccacctctccctcctcgggtcacctacccccgcgtcggcaagccgtctgacctgccccatcaccatcctcttgtggctacccgatgtcagatccggtcgtagcccacgacgagcccccctctcccaccccaaggcatcaaccggctccatcccactcaccctcccctcttctcctctgcctcggtcacacatggaaggggtgagggggcggctcggcaggctccctggctgattctgcccatgggcatgcagctctgcc

SEQ ID NO: 76973 - DNA, 687 bp, Triticum aestivum
  Clone ID: PAT_TA_76973
cctcatattatatgcatacatcatgttgtagtttagcagcctagttaggtgtagaacacattgctaattgtctataggttcggtataatactgctcgatctgctctaactgaactgcacccacattattaagacaatctcttgacagaccacacaacaagtgtaaacaaacatgagtagcccaatgactccatgtgtgctccatgtagcatcatacactgcacatggacacatggtcaactgcttaggccaagacatcttacactgtttgcctagttaggtgtagaacacattgcctagttaggtgtagaactgaattgctaattgtgtgcgagttcagtaaaatattgtttgatctgctggactgaactgcatccacgtacataatcaagacaaacccttgaccgaccacacaagaagtgcaaacaaattacacgaacagcccagatccagtgacgcattgcatgacgccagtctcgacgtgcaatcatataatatactccaagcatcacacgtacactgcaaaatggtctatactcttttctgaactcggggaatctgaccgaagtgggttaactgaaaccgatttccgttgccatcatacagtgcacgtggtctatactcttttctgaactcagggattctgactgaagtggtgctaactgaaactgatttccactactgcgtt

SEQ ID NO: 76974 - DNA, 528 bp, Triticum aestivum
  Clone ID: PAT_TA_76974
gagaggggagcaagaaggagatggaattcgtcctcacacaggccatgagggccggcaacagtgtgaaggctcagcgcgaccgcctcctgcagctccagcgccggctgcagcgcctccaggccggccccgccgctcaagaccacgacgccaggctcggggtgctcgccacggatctcttcaaggtctacttcatcggcctggagtacggcgcccgcacgctcaccacctgcatccgcttcgcccgccagcagggcgttctcctctcccggcccaccatggatttcgccgtcatgaacgacgagcagctccacgacgcgctgctcgcgctcgcgcagcagttcccgccccgccccaccacccggacccaggccatcgaccgcgccatggccgccctcctggccatcaagctgctggaggagcacctcctgccgcgctgcgtcgagtgcctcgtcggcggcaaggcccccgtccccggcaagccccgcgacccctgtcccggctcggtcgccgccgccaccgagggcctcg

SEQ ID NO: 76975 - DNA, 552 bp, Triticum aestivum
  Clone ID: PAT_TA_76975
agggctgagtgtgcgcgacgcagagtcatcggaggtcgatggccggaggcggaggagacgaggaggtgacgctgctgggccactgggggagcgcgtacgtgacacgagtccggctagcgctgcacctcaagggcgtgcggtacgagtacgtggaggaggacctgcgcaacaagagcgacctcctcctccgctgcaaccccgtccaccgcgccgtgccggtgctcatccacaacggccgccccgtctgcgagtcccagatcatcctccagtacatcgaccaggccttcggacctcccactctcctccccgccgacccgcacgagcgcgcggtcgcccggttctgggcagcctacgccgacgacgtgctgggggcgccgtgggagaaggcgtacagggcccgcaccgaggaggagcgggccgggtggatgaggcgggtggtggcggccacggacgcgctggagcgggggctgagcgagtgcaccgacgggggcaagaagggctgcttcttcggcggcgagcgggtcgggttcgtcgacgtcgtgctgggcggcg

SEQ ID NO: 76976 - DNA, 654 bp, Triticum aestivum
  Clone ID: PAT_TA_76976
cctgttctacgctattttcgagaatgcggtactcgcaatccacgctggaatcgatcggatttcgaacgcatgcaccctgctttaaacttcgaggccgagatccagaaactcgccgaaaccgacaaaaccctcccgaaaaacatcaagcgacatgcggtttactactacgacaagatccaagcacaccgagcccgactcgaagcccaggcccaccgcgaacaactccgtcgcaccaacgccgccgccggtgcggcgcaggtcagttattgtttatatacttgatctcccacaacatttcattgcttgatacccctcccttgtttcctgatcatgtcgtcgtgaaacactgtccttggcctacggcggctcaaccctccgtatgtacagcatgagctcacggcggttgaaccccccgctgtgtgcaagtgtttgtctcggcgcgttctcaaagcctacggggatccaactctccgtatgacagcccaagctcccccccgtggttctgccaccggcggcggggcgaggcgtatgtctcggcgtgtgttagcctacggagccacaaccctccgtatgacagcaggagcttgcgggcgcggcgaagcatttgctccccaccgcccgtctgtgactgtatgtctcggcgtgtctttttct

SEQ ID NO: 76977 - DNA, 745 bp, Triticum aestivum
  Clone ID: PAT_TA_76977
tattcatattttagagcatttgagcattaaagtttttttaaaattctcgcaacatttcaagtaacttctatataagtttgtcaattatatatttgcttttgtaaaaaatattgctaatggtgtttatgattcatccaaagctaactatttagttacatacagtatcaaagtttggaacatatgaggtacccaaaatatcttctacaagaaaatggtgaaataaaattagtatgatctgttaaaactctacaataaaagatctacaatgctgggtttcctggttgttacttggtgacgctactatttgcagttttctttaacaaatcagtggacttacccgattaagaatgcttgcaggatatggctggattgataagtaagataaataggtccgcgatgggtcccttgcctacctgctactcctcttctatgaaatctcttatcaaaattatgttgcggaagaatcctgagcatcgacctactgtaagctactatgaagctggaaaccttctgactatagccttgtctcttccactctttctttcgaaaggccgtagctgatctttattaagaaagaacaagagtttacaagtacagcatgatctctgaataaaatgtaatgtcctgtgaacaggcatcggagattctgaagaacccatatctgcagccttatgttgatcaatgtcgtgctctttatgatgcttcaaataccatgcggacaccaccgaaatcattgtccacttca

SEQ ID NO: 76978 - DNA, 666 bp, Triticum aestivum
  Clone ID: PAT_TA_76978
aataggaccaccttgagtaggcctggacgttgtaggcatggatgatttgtgcaattgtgctggtggcgggttactcgttcccggcagtactggtgccaactacctcgagccaccatttttgttcacaaccatgttcgccactctgtaagtattgtgtttctctgtcagacccgaagaagcagagatgtgtgatccatgcagctgtgtgtttggaaccatggcctctcctaaacatgtttagaaatgaattggttgtggatctgcgaagtaccttattaactacgaagtaatttagacttggggaaattattgagatccatcccctcgggttgttaccagattttctatttaatattcattttttttcattgtgatctgtgtcagatttttgtacttgcaagattttgtgcaaggaaaatggagcggcatgatcaagcattgtcgaatgtcatcttataagtgggtgagttctcaagctctactcactgagaagaaagtgcacgtgtactaatctaggatcaaaacataggagagaggggacggttcgaggtgaaggcaccaaacgtcagaaaacaggggaggcgggaggagggagactggtggaatttctcactaactatttgatagtcaagtacaatccaacaacatcacccctctaaatgaatt

SEQ ID NO: 76979 - DNA, 753 bp, Triticum aestivum
  Clone ID: PAT_TA_76979
gggcagtttgaccatacagcctttgtttccatatcccaaaaacctaacatgacagggcttctctatcgtatacaactaaaacttgggatgaattggtcttgtgtttgtgaggtggaagacatcactgacgatcttagaaattatctcacacacaagaggtaccttattatagtcgatgacttgtgggaccagtcagcatggaatactataagccgcgcctttccaagtatatgggtctgaagatgatcgtcaatttgaagaaattacagctgaaattctgaagaagtgtgggggacttccacttgcaatcattactatagctagcctattagctagtcgtcctaaaaagttaagggatgagtgggagcgcatcaggaactctcttggaacccaattttcggtaaatcctacattggaaggagtgaagaatatattaaaccttagctacatccatcttccccttcatctccgggcatgctttctgcaccttggtatatatcctgaagaccgtgcgattgagagggatgatttggttcgacaatggtcggctgaaggacttgtcagaaaattgcatgggcaagactccgaggttgttgctaagagctattttaatgagcttatcaacaggagcttgattcagcctggacgtattgagtatggtgagttgctatcgtgcagagtacatgatatgatgctcgatttgatcctaaccaagtgcgaagagcataattttctgagttgagtgccattctg

SEQ ID NO: 76980 - DNA, 771 bp, Triticum aestivum
  Clone ID: PAT_TA_76980
cagcgtactcatgcctctggcgcttcgcctcgctttgcagcggcggcgacccaccccgtcgtccgcctcgccttgcctcacgccggaggcggccggtggtagcacaacgtgctccgtcggcggcaacggcgactccttcttgccgaatagaggagccgtttgatgttcagcaggaactcctcatctggtgagatccccccctccccaattgcaagcacctatttgatgttcttctgcccatctaaattccacatgttatgtcagtggtacagccgcatggattggaagtatgtatttcagcttgggtttaaaggggcagtctggtgatatgaaaatttgtacaaactatctaggacctcaagttcacatgggtgtgcttatttacctactaactacagatgacacccaatagatcaattagtgccatctccagatttctatcatcatgttgcttcatttatcttcatataagtttcactgggagatgcatgcattaaacatagtgttttttagtgggcatcagacttggttagatggcttttgctgtgaaagaaaatttatctctctaaagatctgtactctgaatcctagatctcatacttgatcttttggtataagaatagatatctatagatcgttgctgtatggatacagtatagatgagatacttgatttcactactccaagatcacttacaggtaattgaacttgctccggaagcatggagcatcctgagatccctgatgtggtagttagcttcttgcatgttgc

SEQ ID NO: 76981 - DNA, 585 bp, Triticum aestivum
  Clone ID: PAT_TA_76981
tttttttttttttttttttttttttgaaattacacttccattttatttatacatttattcgctgaatggcacgcaccggccatgcacgcacgcacatatgtgacattatatacggagtatataatatgggcacacgcagaatgatggatgatcataataagtaagaggaagactactaggagtaatacatcctctacttactgatccatgtgcaaatcatttcgggcggggcacaggacgatctggtagttggttccggctgggcacgtgaaggtgctggtctggtcgtccttggcgtagctgtaggcgtcggggcacttgcccttgaagaacctcgagtagttggtcggcgggcagttgtgctcgaactggccccggcagcagtaggtgtcgccgccgaacttgccgcacgcgctcgcgcaccctccgggcacctgcagctccggcaggcactctctggtgatgtccacggcgcaggtcgccgcacggcacggcgcgccgccgacgggctggaagctcataggcgtattgaagccgtcgatgaccgacaggtcgaagaagtcctggctcccgccctgccccagc

SEQ ID NO: 76982 - DNA, 726 bp, Triticum aestivum
  Clone ID: PAT_TA_76982
gcacgagattggctcgctgtcattccaccagcttccttgtattcctttgaagtgatatgtgtgacactttgggttcttcttatgaacaaagtcattgtaccagcgaccaggacattcttcacaagtggagcggagctaacacagttgcagaggatcgggattggccgtttcctaatgatctttgccatggcaatggctgctcttttagaagcaaagaggctagagagcgtccagcatggcaatccattaagcatcgtgtggcagctgccgcagtacttcgtcatcgctggggcagaatgcttcgtcatcattgctcagctggagttcttccatggccaggcacctgactccatgaagagcatgttgacggcgtttgcgttgctcaccactgctctcggcaactacttgagctcagctatcatcacccttattgcgaggctgactagggaatggcagagccctggatggatacctgatgacctgaacgaagggcaccttgactacttctactggtgccttacagccatctcatttgtgaattttattgtctatgtctattttgctagtaaatacagattaaagaaaattgttattgatggctaaaatccattgtaaccacaccacaccaattgagagtgtatatataggccacagaactagaaaaacattttctgtatccagaaatcggcttagggtatctgagaatgatgtgttgtgttgataata

SEQ ID NO: 76983 - DNA, 729 bp, Triticum aestivum
  Clone ID: PAT_TA_76983
ttttttttttttttttttggattcataatctgttgattcttcataaaaaattaacagagagaaagttaattcagacaggagaaatagaaatttatggagagtacatcgccgcctagctcctggccgtggcctcactttcgtgcacctgtaatcaaaggagaaaaaatagtacaatgccctgcaatcaaaaggaagggattatgcatgtacggtttatctagtttttctcaggctagaaatggaagccggtgcgctgccactggagcatgctttgctccaggggatcccgtcagtgtcggcgccgaggaaccccatctcatccgcgcgccgccccggaggtcttctccgacatgccggcttccctgcccagactccgcgccgtctccgccagccgcggcatgtccgccgccacatcgccgcccaccacctgcaccaccacgcacacgcaccacctcgcccccgctccggcgctcctccatggggtcggacggggccaacggcggatgcgcgtacggcagcgccgtctcgctgggactaatggcccgggactccattgacgatgatcttcgagaaaaataatatgaaccgattccggcggatcgaccgacgggtggacagaatggataggcatggctcgatcccccggcgagcgcgatttacagttggagactcacctggatcctgtgctgccgctctccatgctattgtgtagccgccgcctccgccggc

SEQ ID NO: 76984 - DNA, 716 bp, Triticum aestivum
  Clone ID: PAT_TA_76984
gaaaaatcactcagacaccggtgtgaagatactcaagtttgtaatccgtgatcattacaatgtcgacacttgtcatctaaatagttggctccagaaagctgtcacaccagggattgaagaagtcacacttttgctgcctacgaaacataggaaaatgtatgaattcccgtgttcagctctacttgatgggcgtggaaactcaatctggtatctttacctcaccaattgtgccttccgccccccggttggatttgattgcttgagaagcctggcaaagctgcatctgtatggagtttgtatcacgggggatgagttggggcatcttatttccaattgttttgctttggaggagttagaagtcagctgttgcatgaagctaatctgcctggagataccattctggctggagcggcttagttgcttgactgtgtctcagtgcgacaagctgagagtgataaagagcacagctccgcacctctccatttttgacttctttggtgaaccagtacaactcgtgcttggagaatcatcaaaggtaaaagacttaagggtggggtattcatttgcgcccaatgctgtgagttatgctatcactaagctacctttcatcgcaccacatcttgagactcttactgtatactcgttttgtgagagggttagtaccccaatggtagctgacaaattcatccacataaagcacttgaatatctactttg

SEQ ID NO: 76985 - DNA, 756 bp, Triticum aestivum
  unsure (1)..(756): unsure at all n locations
  Clone ID: PAT_TA_76985
cggcacgagcgccaatcagattctgaaggcggccattggcgatcaacagcgacgtgcttgctgagatggagatcccggaggcgtacctggagtccttgccaaagagtggccgatcttgcttgggtgagataatttaccggtacataacggctgaacaattctcacctgaatgcctcctggactgcttggacctgtcatcggagcaccatacacttgaagtagcaaacagaatagaggctgccatccatgtctggagactaaagggccaaaagaaaacggcgcctcaggcaaagtcaaagaaatcttggggtggaaaagtgaagggtcttgttggagatacgaagagccaagtgctgtcccagagagccgacggtctgctacagagcttaagattgcgacaccctggcttgccacagacttcccttgacatgaacaagatccagtataacaaggatgtcggccagtccatacttgaaagttactcgagggttctggagagcttggcgttcaacacaattgcgagnattgacgacgtgatctacgtggacgacgccacgaagaagtctgccgcggcggagaccgtttcgatcttcaaccgcggcacgggcgcaccagtccagaagaagatctccccaagcccattctctatccagcacacgccatacgcctcccccttcgccacacccaccttctgctcctccaccccagtcaatggcaacagccccggaagagcaccgcagcctccaccgagcaaaa

SEQ ID NO: 76986 - DNA, 625 bp, Triticum aestivum
  Clone ID: PAT_TA_76986
tcggcccagcagcggcggagcggggcgagcaccaggaagcggtggagatcctcgacaaccgtcagcgggcgctggagcagtcggaggcggcaggggacggcgaccccatgatcgtggcgctgggggcggagctgcaggagatgcgcgggcgcgtgtcgaaccggcagagctacatgcggtcggggcgggcgtacatgctggccggcatgagcgcgcaccagcagcaacgcgccacctccaggcagatgctggagccggaggagcagcagacgtcgatgatggcgaggaatagtggagtgaggaggatgatcagaagaggagtggggtcgagcggcgggggatatatggcggcagcggcgcccgtggccgaggcgtcgaacgaggcgacgatgtcgtacgcgacgccggccatgcgcgccatgctgctgcgctcgcgggaggcgcgtggggcgtcggccgagcaagggcagcaggaggagcagcagcccatggccggaaaagacgatgccgggagctcgggcccgaaggacgtgaaccaatagccattatgcatacgaaatggagtacgaactgtaatttagaacgtgtttggacttggaatactttcattgcttattttagtggg

SEQ ID NO: 76987 - DNA, 507 bp, Triticum aestivum
  Clone ID: PAT_TA_76987
ggcacgaggtcctccactatgccgaaggcggcgggtggcggacggccaccggagacagccccttcctcggcagcgactcgccatctgcctctcggcactactatgtccgcctcgccggcagcgccgacgactctggccgcctccagttcgccccctcttctcttgccagccgcaacgcgctcctgtgatggaatgaatggatcatcatcttctctcgtttgctggtttttcttttctcctcttcaattaattttaggcgtgggtgtcgtatagtactccttcattctcaagatataaaagcgcgcttgactttgaacggtttttgatgcatcactctggttactaatatatatcaaagtacatggactgaacatgtataaatggcatattggcatagtcatatttgtcttacaaaacaattttatttcctatgtatgtatacttcatagacagacaatacactgaagatcatagtcaaaattgtgcaacaaaaaaaaaaaaaaaaaa

SEQ ID NO: 76988 - DNA, 771 bp, Triticum aestivum
  Clone ID: PAT_TA_76988
ggccgaggtcggccgaggtggcgaagagggccctgacccgcgggctcgacccgtcccaaatccgcgtgtacgggctgccgatcagaccatccttctgccgcgccgtgctcgacaaggatgagctgaggaaagaacttggcctgcaccctgaactacccgctgttctgctgatgggaggcggcgaggggatgggcccggtggaggagacagccaaggccctcggccacgagctctacgatcaccggagacgccggccggccgggcaggtcgtggtcgtatgcggcaggaatcaggcgctgcggtccaccttgcagtctctgacatggaaggtccctgtcaaggttatggggttcgagaagcagatggagaagtggatgggctcttgcgactgcatcatcactaaggctggccctggtacaattgcagaagccttgataagaggacttccaattattctcaacgacttcatccccggacaggaagtagggaatgtgccttacgtggtcgataacggcgccggtgtgttctgcaaggacccaagggaggctgcgagacaagttgcccggtggtttaccacagaaactgacgagctcaggaggtactcccgcaatgcgctgaagctagcgcagcccgaagcggtgttcgacatcgtgagggacatccacaagctccagccgcaacctgctgctctaacccggatcccctactccttgacctcacaattctcatatcatatatgaactcgcggaaccttttgcagaaatactctgc

SEQ ID NO: 76989 - DNA, 149 bp, Triticum aestivum
  Clone ID: PAT_TA_76989
ggcaccagccgcgatcactacgggcaagatgccgctcaccaccgtgcagctcctgtgggtgaacctcatcatggacaccatgggcgcgctggcgctcgccacggacacgcccaccaaggcgctcatggaccggccgcccatcggccgca

SEQ ID NO: 76990 - DNA, 699 bp, Triticum aestivum
  Clone ID: PAT_TA_76990
gcaccagccaagatcgtgcaaggaggccgccgagaagactgtcaacgcggcgatgttccaaattggactcgggagcaacgactacatcaacaacttcctgcagccgttcatggcggacggcaccacgtacacgcacgaccagttcatccgcctcctcgttgccactctagaccggcagctcaagaggctgtacgggctcggcgcgcggaagttggcgttcaacgggctgcccccgctgggctgcatcccgtcgcagcgcgtcaagtcggcaaccggggagtgcatcgcccaggtgaacagctacgccgtgcagttcaacgcagccgccaagaagctgctcgacggcatgaacgccaagctgcccggcgcgcagatggcgctcgccgactgctactccgtcgtcaaggagctcatcgatcacccagagagaaacgggttcacgacgtccgacacgtcgtgctgcggcgtggacacgaaggtcgggggcctctgcctgccagactcgacgccctgccgcgaccgcaaggcgtacgtgttctgggacgcgtaccacacctccgacgccgccaaccgggtcatcgccgaccgcctctgggccggcatgacgaccgcgagcgctccagctccggctcctcgcgccggcgcgcccgggccagccgcggtgccggcgccttccccttctcgggcttaaagacttga

SEQ ID NO: 76991 - DNA, 641 bp, Triticum aestivum
  Clone ID: PAT_TA_76991
ggcacgagcttcgtctccggtaggccaggtactcctccccgccggccgtttccgcgccggtggttacctctgctcgttcgtacgccgtcgcatctgtaggtcgttcgcgcgccagtaggtggtatacgggtcgcatctgtaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgagaaggaagccgctgagatgaacaagaggtctttcaagtatgcctgggtgcttgacaagctcaaggctgagcgtgagaggggtatcaccattgatattgctctgtggaaattcgagaccaccaagtactcctgcactgtcattgatgctcctggtcaccgtgatttcatcaagaacatgatcaccgggacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccact

SEQ ID NO: 76992 - DNA, 667 bp, Triticum aestivum
  Clone ID: PAT_TA_76992
ttttttttttttttttttgtcaatagggtagtacctaaaaatgatataaaatgactataaatgattgtaaaacgtccaagatttataatataacagcattgaacaatcaaaattatagatacgttggagacgtatcacaccatagtgcgcaaggcagtcctctaacatcttcattgcatctttgacttcaagtcggagctgagctgaagcaagcctttccgctttaagttgagagtgaagaagtcaaactggttgaggcagctactgcacagaggttgtctcacacctgctggtgagtagcttcaactcaccatcttcatcaagacaataactcggggtcatctcgctctcctaaagatggtttggctcactatcttcgctaaagttctgcctagcataagacatgcgactttgaaagagaaacaaggagacacataacaggtttcacaattatataaggaaataaatggatctgttctgcataaggaacatgtttttacaactacaatttaaaactggtagttgttgcgaacatccaatcagatgtaaacggcaaagtaaacagcagtggaggaaattatgcctatccaaatctatactagaacaaagtttgaaggctctagaaggatgaacctcgccttcggggagatgcgaagcaaatgggcat

SEQ ID NO: 76993 - DNA, 724 bp, Triticum aestivum
  Clone ID: PAT_TA_76993
gcacgagcgtcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcttgggttcacagtgtacccatcaccccaggtctccacctctgttgttgagccatacaacagtgtcctgtccacccactccctccttgagcacactgatgtgtctatccttcttgacaatg

SEQ ID NO: 76994 - DNA, 632 bp, Triticum aestivum
  Clone ID: PAT_TA_76994
agttctctctctggcttgctcttggacaagagtagcaaaacagattgtaaagtttttttttcctttcgttgtgccaacccaaccctcaccgtccgtctgtccgtctgtcgtaaccgaaactacctggtgacttttttctctttaaattttattggattgattccgctgcttggcgagattagtctccaaggagccagagatggccgtctgtctgtctgcgttggtcggtgtcggtccgttctgtgcctagtttactagcgagagaccctttcctttttcagcatgaaagaggagagggggaagatgatgatggtccggttcaagtgtcaccatgtcttgtttttgctcaacattggcagccatgcaaccatggaagaaggatttagaggaaaaatcaatcaatcgagcatgagtcaagagtcatgtgtggcccgggtggagtcagtggggtgtacaattgcaaacctcattttatgttgaactgccgtttgatttctctctggctgtagaaacttcttcacccattgtatattctctccagtggcgcagctggtatccatccatccatcctcttgatttatctgccttccctggctggcctcatggaaaacataccaacagtcagtttgctg

SEQ ID NO: 76995 - DNA, 600 bp, Triticum aestivum
  Clone ID: PAT_TA_76995
acgaccggtggcagcgccggatgatcaagaaccgggagtcggcggcgcggtcgcgagcgcggaaacaggcctgcaccaacgagatggagctggagctggtgcagctgcgccgggagaacaggatgctcatccagcgcgagcaggacttcatcaacgaccgtttggcgaaggcggcgcaggcacccgtcccagactgcagcagcgggaccactagtagtaccctccagcagaagcagcagcggcagaagcagaggtgccgctccgcccctgcgccatgaatccatgatcgccggccgtcgacggtcgactgtagcagcagcttcattccacttacaatggattgattgtccaagctatctagctagctagctagatgacttattcagcactggactactcgttaacaaagtactactactactatgtactctatgtatgtatcgaatcatagcctacttgcttgcaaaagtacgtaagcaaggatgtagctcgacgatggatggaagggaagctagttaactagagtagtatagtataatacagtagattaatagatgagtctctctccttaatatatattgaggccagagatgaatggat

SEQ ID NO: 76996 - DNA, 350 bp, Triticum aestivum
  Clone ID: PAT_TA_76996
gagccgcctccctcccccgcaccactggacgccgcctccctcctgcgcgccgccgaacgccgcctccctcctgcgtgccgccgaaagccgcctccctcccccgcgcctctggacgctgccttccgccgcccgcgccaccggacgccgcctccctcccccacgccactggacgccgcctctctccatagcaccgcaggatgccggcgccaccacgaccccccccccccccccgatgcactgtcgccacgccccctccccgacgtgccgccgccatgcccctccccagctgcgcgctcacgggcttctgcatccagcaccgctgacagcacgaggggggttggaccaactgc

SEQ ID NO: 76997 - DNA, 293 bp, Triticum aestivum
  Clone ID: PAT_TA_76997
ccgtcgcggccggggtgctccgcgttgtcggctccgcccccgggcccggctccggcgacaaggcggccctcacggaccgcctcgtcgacaagctcttctccgactccggggagcgcctcgcgtcctctgtcgccgggagcttcgcgcgccacctcgtaatggccttctactccgccccgtctcctgccgggcagacctcctcatcgcccgattgggtcaacgtggttgcaacgggaaagggccacaaggcgattagcagctgggttgaggtcctcggcggcaccgccgtgggg

SEQ ID NO: 76998 - DNA, 533 bp, Triticum aestivum
  Clone ID: PAT_TA_76998
gagcgcgaagccgacggttagagagagcgtcagcgtgaccaagaacaggcctgacagcgcgaccaaggcgcggagggaggagcagcagcagcagcagacggcgaacggctgcgcggactccgggagtaaggtggcgaggtcggaggccagggtgaggaaaaactggtccgatgtggagaacgagctggccaacggcgagcccaccttccatctcagccggaagtcggcgaagaagctcccgccgccggcgattaggcagtcccagagcatcgatctcagggcgtcggtccgggaggtggaggccgtgacggaagggaaggttcgccggaacaggccgccgtacgcagagaggaccaacgtccccttgccggagacgcgccgcagcatgtccctgccgcgcaggaagctcgcgcccgtgtgaagcctacctagcttggctggtttgtttagccattctttgattgtcgtgacgacgtcggcgtgatgccacagtgtcctgcggtccggtctgcaggcttctacggctgggtaga

SEQ ID NO: 76999 - DNA, 243 bp, Triticum aestivum
  Clone ID: PAT_TA_76999
ctccacctgctcccgcgggtgctcttctggctcgacctcctcgggtccaccaccttgctgatgaaatggctggccaagacgtggctgctcaagtactccgtcgacctgctcctgcggaacctcgccgcgctccgccgcctcggcatcccggacggccgcctcacggccgccgtccggctgcggccgacgctcatcatgcagtcgccggacaagctccgggcgctggacggccgcgtggaggag

SEQ ID NO: 77000 - DNA, 582 bp, Triticum aestivum
  Clone ID: PAT_TA_77000
tgtcccgcaaacccccgagagatcacaccatgttcggcttcggtcaccacggccaccatggccagaaccccccggcccacgctccggccgccgccggcggcaaccagcccaccttcaagatcttctgcaaggctgacgagggctactgcctctccgtccgcgacggcaacgtcgtcctcgccccctccaacccccgcgacgagcaccagcactggttcaaggacatgcgcttcagcagccagatcaaggacgaggagggcaaccccgcctttgccatcgtcaacaaggccactggcctcgccgtcaagcactcgctcggccagtcccacccggtgaagctcgtgccattcaacccggagtacctcgacgagtccgtgatgtggacggagagcagcgacgtcggcaagggcttccgctgcattcgcatggtgaacaacatccgcctcaacttcgacgccctcaacggcgacaaggaccacggcggcgtgcacgacggcaccaccgtcgtcctctgggagtgggccaagggcgacaaccagagctggaagatcctcccctggggcgaagaggcctacaccggag

SEQ ID NO: 77001 - DNA, 649 bp, Triticum aestivum
  Clone ID: PAT_TA_77001
ttttttttttttttttttggttttaatttttttcgatggatgataataaagtaaccacgccgtgatggtgggattaagattctccatccatgtcaataatgccatgcatgttcaccagggaagtcaaacacacttgcattatttgatttccagcgacacaaacttctgctacatgctaaacagatggagtagttgcatcagccatattttaacacgaaacgaacattgtaatgtgtttcattctgctttgagggaaagcatttcaagggtagacctcgatgatggatcgaaaccccaacacgggcgagatcttatagtcactgaacccagcttcagagaagatcttggcccactcatcctcctctcgctcaaccccgtccatgtacatcttgtaaacatctgacagaacctgcgtctccattgaaacattttccgctgacgcagcaccagcatagccgacgaccatatcgatgattatcaccttcccgcctgcatcccttgacgggatggcttccttgcaccgtcgcagtatgttgatgcagtgctcatcttgccaacaatgcagaatccacttgagtagaacgacgtctgctgatggaatgtgttcgaacatatcaccagcgacaaactggatgctttcattggcggg

SEQ ID NO: 77002 - DNA, 404 bp, Triticum aestivum
  Clone ID: PAT_TA_77002
cgctctccggtcgatcgctctctcgtcaggccgagccacaccgccacttgccacgatatttcctcgctcgcttgcttgctcgcccgctccttcgaccgatcgcctgcaccacaagctggccggccggcagcgcgctcggtctcccatgcgctgcctttgactaccgcagctccacgagtccgcaccccgcacatggcgtgagagcgtgggctagctgctgcgtagctgattagtccaagaagtccaagctcgtgcacgttgaagcttgcgtgcgtgcgtgcagagttcgtgaagggagaggaaggaagaaacctactatggccgcgcaggagggcgccgcggggacggcgaaccaggtggcgagggtgcggtacggcgacgtctacaacagcaacttcatgctg

SEQ ID NO: 77003 - DNA, 558 bp, Triticum aestivum
  Clone ID: PAT_TA_77003
cacgacagccccagcgcggacacctggggcctggccaaggtggcagccctcacgggcgtcgtcgacgccgacaacgcggtctacgacatcaaggagctgctggccaaggacggcgcggacgccaggacgcaggcggcgctggcgcggtgccaggagctgtacgacagcatggggttcgccttcgccgaagcgcaggacgacatcaacaaccgcgactacgccgccgggaaggagaaggccggggaagccgcgtctctggcgcaccagtgcgacgacgcctttgcccaggccggtgtcccgtcgccggtcacgcggcacagctcctactcggtgcagatagcggttgtctgtacggctattaccaacctcatccagtgaagaacgtctaaaacttggggatactacgtgtgtaaaagtagtacgtgctactaaaagagtgtggtttacctttaagaaaagagtgtggttcactttaatatcgacgtcttattagggtactcgcatgttttgagtctcatctttttttccttttttgtttgcatcctgagcaatatctat

SEQ ID NO: 77004 - DNA, 576 bp, Triticum aestivum
  Clone ID: PAT_TA_77004
tgttgagactggtgtcatcaagcctggtatggttgttacctttggtcccactggtctgacaactgaggttaagtctgttgagatgcaccatgagtctctcctggaggcgcttcctggtgacaacgttggcttcaacgtcaagaacgttgctgtgaaggatctgaagcgtgggtttgttgcatccaactccaaggatgaccctgccaaggaggcggccaacttcacctcccaggtcatcatcatgaaccaccctggtcagatcggcaatggctacgccccagtgctggactgccacacctcccacattgctgtcaagtttgctgagctggtgaccaagatcgacaggcgatctggtaaggagctggaggcgctgcccaagttcctgaagaacggtgacgctggtatcgtcaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggcgccaaggttaccaaggctgccatcaagaa

SEQ ID NO: 77005 - DNA, 758 bp, Triticum aestivum
  Clone ID: PAT_TA_77005
tgtgcgtcattaaggaagatgtctgcttcctttacagatatctctaaagttgaagactgctttgagaatttgcaccagatgaaggataataacatatttaaggatttgactgaaataagcaaagagggcactacttatgcaacagttcgatcaatcagagattcatttctcaagagaattggtaacaaacaccaaatttacagcttctgcaaagaactgtctacaaaactctcgaattcactatttaattgggagatgatttgtgccattttggaggttcttttctcctgcagaaatgaattaacccattatgcagagtctgcatgtgatcttttactgctagttgcaatggcgtttccatcattattcagaggctcagaggagtacttgctaaagttgttcaccgaagactcagtcctgataaatgagaagagtctcaaaatgttggcatatttggcaaaatcaccgtgtaatttatctattaatttcagtagtgatgtctacctcttactggagcaaaagtgtattgaaggaacacgtgctgaatcaaaatatgccatttctgcaattgcttcactgatccagtctccagatgacaagaaatttgccaaattatgtaagagagttgttggtggtctacatgatagtcataatatcccaactctattacagtcgttgggcttaatattggaggattctccttccatgtatacatcatatgacgaccaatttatcaattttgttcaacgtgtttttgt

SEQ ID NO: 77006 - DNA, 433 bp, Triticum aestivum
  Clone ID: PAT_TA_77006
gaggaggcggtggccatggagtcttagacgatccgccacatgatcgaggacgactgcgccgacaacggcatcccgctccccaacgtcaactccaagatcctctccaaggtcatcgagtactgcaacaagcacgtccaggccaagcccgccgacggggccgcggccgccgccggagcctcggacgccgccgcccccaccgcccccgcggaggacctcaagaactgggacgccgagttcgtcaaggtcgaccaggccaccctcttcgacctcatcctggctgccaactacctgaacatcaaggggctgctggacctaacctgtcagactgttgccgacatgatcaagggcaagaccccggaggagatccgcaagaccttcaacatcaagaacgactttacgcccgaggaggaggaggagatccgcagggagaacc

SEQ ID NO: 77007 - DNA, 423 bp, Triticum aestivum
  Clone ID: PAT_TA_77007
gtgcctgtccgcggagagggagaacgttggcaagctggtgggcgcgggcgccgcggaggcggcactgtcggcgatcagcgaggaggagaccgcggcggcggtgctggcgtcgctggccaagcgcggcggggcggaggcgatcgtgaacatcgacggcgccgtggcgaagctggtggccgagatgcggcgcggcacggagtggtcgcgggagtgcgcggcggcggcgctggtgctgctgtgccggcgcgcgggggccgcggcggcggcgcaggtgctggcgatcagtggcgtggagtgggcgatctgggagctcatgggcagcggctcggagcgggcgcgccggaaggccgcgtcgctcggcaggacgtgccgacgctgggcggccgccaacgcggcgcagaacgcggactgccccgcctcaac

SEQ ID NO: 77008 - DNA, 682 bp, Triticum aestivum
  Clone ID: PAT_TA_77008
gtcatgatttaactgtatgcgagcaaattgaccagacaacaatatgtcatgcttcggtaagtgagaaagccattcaagctgaatcacgcaatcatgattctccttcaaattcaattgctgatcgcaagcagattgatgctcaggacaagattaaggccattgagttatatgcagttgatcatcatccaggagcagtatgctcaagatctgaaccatcatctgggacaagcttactcaaaggaagtccgtccggtccaactccaatatttttggaattagagaataagcaacttgagaaaatccaggtaaagctggaaacagagcatgatatgtctgtcagtaatgcaaagccagagagctctcgtgataatccagaagcaactcaatgtggtacggaagtctctgcactcagtcaagaccatattcagtcttcacagacacaagatctgtcagtcggcgcaaaaccttccagctcagaaatggcagcaacacaaattaccacgtgctctcagttttctcccgacaatgcattgactgctcaagctccccttcagcaccacatggataattctcaaacgtaccaatccattaacctttttctagctggacaaaacatgcagcagatgcagcagcaagggcctgcttatgcaatttctcagaatgttcatacatccccacactc

SEQ ID NO: 77009 - DNA, 451 bp, Triticum aestivum
  Clone ID: PAT_TA_77009
agctagccgaaaaagatcagctgaagtgggagctgaggaaggggcgggcgttcgaggggtggagcgagggggtgctggagttcgcgccgacgtacaagtacgaggtcgggacgggcaagtacatcggcgacgaccagaagggcgggaggaggacgccggcgtggtgcgaccgggtgctgtcgttcgggaagggggtgaggctgctggggtacggcaggtcggagctgacgctgtcggaccacaagccggtgacggcgacgtacgcggcggaggtcgaggtgttctgcggcaggaagctgcagcgggctctcacgctcacggacgccgaggtggatagcggggacgtggtcgtgccggacctcgagttttgagctggccgaggggcatctcgccggcggtgccgaacacttgacatgcaccggctgaagcatttggatacagcagatagctt

SEQ ID NO: 77010 - DNA, 600 bp, Triticum aestivum
  Clone ID: PAT_TA_77010
ggcacgaggagcgaaacacctctccctcactctcacctccgagaagctccagcggcagccatggccccaaaggcagacaagaagccggcggccgagaacaaggtggagaaggcggcggagaagacccccgcggggaagaagcccaaggccgagaagcggctgccggcaggcaagacggcgtccaaggaggccggcggcgaggggaagacccggggcaggaagaagggcagcaaggcgaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcgaggtacaacaagaagcccaccatcacctctagggagatccagacctccgtccgcctcgtcctccccggcgagctcgccaagcacgccgtctccgagggcaccaaggccgtcaccaagttcacatcctcctagactgacgacgcgccgcttgttgtgacagatgtagttggctgctgttagtcgctgactctgcttatgtatctgcaagta

SEQ ID NO: 77011 - DNA, 650 bp, Triticum aestivum
  Clone ID: PAT_TA_77011
ctgcctcctccatcaaggagtacgcggccaagccaaatctattctctccgtgaccacaacgccgccgccgccgccaccagtgattctgcctagctccggcgcttgctgcgccgctgctcacaggagcagctacccctcactacccttccccgatccctggccatggcgacttcctccgcgcccacatgcggcccgccgcaaccctagttaaccacaggtcaccaacgccccgcgcctcctctgtcttgtcgatctactgccccgcgcctcctctggtttgtcgacctactgccccgcgccacgtctccgcacgcgccgctcccggctcggccttggtggtgctgctccgcctcagcaatctcgactccgacgccgctcacggttcagcaagccactcctcctctgacccgctcttctcttacactatttggttctttctgtggcaggccagggcggattctttgccggccatcgtgatgacaatccactctaccttgactgctcatcccgatccaccgccgcgggcgctggcttgcaccggcatcaatgtcactacactccgtaaatcagaggatgcctaacatcacacggtaatgatctgcccacggtgttttcaagtggagaggcggatgatttaaagtgctagtatc

SEQ ID NO: 77012 - DNA, 429 bp, Triticum aestivum
  Clone ID: PAT_TA_77012
ggcacgagacgagccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccgcatgctgaatgaggatgagctgcgtgatgctgtgctgctg

SEQ ID NO: 77013 - DNA, 675 bp, Triticum aestivum
  Clone ID: PAT_TA_77013
cgaggcgttacgaagaaattgtgaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaatgagcccaagaggccctcagacaagcccctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagatagaggccgcgcccaagttcctcaagaatggtgatgctggca

SEQ ID NO: 77014 - DNA, 708 bp, Triticum aestivum
  Clone ID: PAT_TA_77014
ggcacgaggcgttacgaagaaattgtgaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaatgagcccaagaggccctcagacaagcccctccgtcttcccctccaggacgtttacaagattggtggcattggaactgtgcctgttggccgtgttgagactggtgtcatcaagccttggtatggttgttacctttggtcccactggtctgacaactgaggtcaagtctgttgagatgcaccacgagtctctcctggaggcgcttcctggtgacaacgtcggcttcaacgtcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagatagaggccgcgcccaagttcctcaagaatggtgatgctggcatagtgaagatgattcccaccaagcccat

SEQ ID NO: 77015 - DNA, 670 bp, Triticum aestivum
  Clone ID: PAT_TA_77015
gggtacttcactcctgttctggaacctcaactactgggacaaggcgagcacgctcgccggcgaggtcgacgagccgaggaagacgttccccaaggcggtgttcggcgccgtggcgctcgtcgtcggcgcgtacctcatcccgctcctggccggcaccggcgcgctgccatcggagaccgcggccgagtggacggacgggttcttctccgaggtcgggcagaggatcggcgggccctggctgcgcgtgtggatccaggccgcggcggccatgtccaacatggggctcttcgaggccgagatgagcagcgactccttccagctcctcggcatggccgagatgggcatgatccccgccatcttcgcccgcagatcgcgacatggaacgccgacttacagcatcctctgctcggcgagcggggggtggtggtcctctccttcatgagcttccaggagatcatcgagctcctcaacttcctctacgggctcggcatgctcgtcgtgttcgcggcgttcctcaagctgcgtttcaaggacccggacctgccccggccgtaccggatcccgctcggctccgtgggggccgccgtcatgtgcgtcccgcccgtcttgctaatcggcaccgtcatgtgcctcgcatcggccacgaccatcgtcgtcaacatcatcgtgc

SEQ ID NO: 77016 - DNA, 673 bp, Triticum aestivum
  Clone ID: PAT_TA_77016
tcggcaccagtcccgccgccgccgccgccgccgccgagaattcctaggcggcgatggccatgtcccggcgttccgcctcccacctcctctcctccttccgccctttctccctcctcctccagcccctcgccgacgccccctcgcccgcggccgcggccgcagcggcgtcggctcgccgggcgatgtcctcggcgtcggctctgcgggcgcggggagacgacaaggagttggcgcggtggcgcgagtccatggatcggatgcggaacattggtatctccgcgcacatcgactccgggaagacgacgctgacggagcgggtcctgtactacaccggccggatccacgagatccacgaggtgcgtggccgcgacggcgtcggcgcaaagatggactccatggacctcgagcgcgagaagggcatcaccatccagtcggcagctacctactgtacctggaacggataccagattaatatcattgataccccaggtcacgtggatttcactgttgaggttgaaagggccctccgtgttcttgatggtgctatacttgtgctatgtagtggttggtggtgtacaaagtcaatcgattactgttgatcgacaaatgaaaagatatgaaattccaagggttgcatttattaacaagttggaccgcatgggagctgatccat

SEQ ID NO: 77017 - DNA, 668 bp, Triticum aestivum
  Clone ID: PAT_TA_77017
tcggcaccagcccgacgccgtgctcgccttcctcgccggcctcggcctctccgccgccgacgtcgcctccgtcgtcgccaaggacccgctgctactctgcgctaaagtggagaagaccctggcacccgtcgtcgacgggctcaccggcctcggcctctcgcgtcctgagatcgcgcacctcgtctcggtcgccggcgaaaagttccgctgtagagccatcatctacaggctgcactactacctggccctcttcggctcctccgggaaactcctccgggtgctcgaccgcagcccctacattctctcgtccaacctcgagagggtggtgaagcccaacgccgcgttcctgagggagtgcaggataggtgcttgtgatattgccaagctgtgtgtcgctcagccgaggatgctcacctccaatgtggagcgcgtccgggcgatggcggcgcgcgctgaaggcctaggtgtgccccgtggctccaggatgttctggcgcatgctgaatgcccttgcgtttctccgcgagaaggatatcaccgccaaagtggagtacttgaaggacactttcagatggtccgatgctgaggtgggcattgctctttgtaaggccccgatggtgctggcgttgtccaaggacctgctgcagaggaagtcggagttcctgatct

SEQ ID NO: 77018 - DNA, 689 bp, Triticum aestivum
  Clone ID: PAT_TA_77018
cggcaccagccgcaaccgcggcccgggtgcctaatctaaggcgacctcctgttttgacatcgtccttggtagctgcaagcgtggaaacaaccttggcagtgcagcggcagccacaagctacacaatccaactactcaaaggaacatacagttctagaagtgagaactgttgagctattatagcgcagccttgggatgatggatgttcaggccagctatgcagaccttaaggtaaatgtttttccagctaattaacatgaaatgtcttgtaacttgaactaataatgaacaactgaggaatgctgcctgaatgaatccaaaatgtgttggaaacaccaacgtccagttggagagggagctatctggatctccatccaactaggacatgtctgcttacaactttttgttgaacatgatattacatgattctatcaaagacaactctcctttcttcagtgtacatgcatgatattacatgattaaacataccatttttaacttcatttagttgtctatattatgctctatgtgctatcaccaacaaaaatagtgttacctccgtaccaggcctaccaaatatcttatattttggtacacatgtagtatttttagcctgcaaagcgactcctatgcccagtgtgccaataatgtgtttgcaccagtgaagagataacttattttttacattgt

SEQ ID NO: 77019 - DNA, 690 bp, Triticum aestivum
  Clone ID: PAT_TA_77019
attcggcaccaggcggccgcggccgcggcggctcggccgctcgggacaaggcgaacaggcgggactcagagcaagcgacttgcgcgcgcacgggggtgccaagaaggacctggagctcgcgccaacctgggtggtatgccggcgtcgagctcctcgtcgtctccttgtcggcaagctctggcctgtgggtgcgctcctcctccagccgaagataagaccaaagcctgtacttgtagaagccctgaagtttgtccaggtctcaagtaaagactataattttaaaacagatcaactgaaatcaattcgtcaagatatgactatccagaacatagaggatgaactttctgtgcaggtttatgagtatcatgcaagacttgcgttgtgcaatcgagatatggctgaacttaacttgtgcctcacgaagctgcactgcctctatgggaataagcggaatggtggccatcatggtgaatttgcagcttatgttatattgttatctgcgattcaagacaaaaatactgaactgatgtcgaaacttggaaggctgtcaagcgacctgaaacagcaagaagctgtgaagcatgcgaaagaagtggctcacagtatacagacaggaaactatgcatcatttttcagactctacaaggtggctccaaacctcaatggctacctgatgtgtctctgctttga

SEQ ID NO: 77020 - DNA, 497 bp, Triticum aestivum
  Clone ID: PAT_TA_77020
tcggcacgaggtttagcaaatcgtcaaggttttattcggcgactatcaatccagcacattgatcatgagcttgcacatttactcgcacaagaagatctaagccatgtacgatctctgacagtaacatcttcagcttgcaccaaacatttgcctagtcttgctaaatttgaagctctacgtgtagtagattttgcaggttgtgagggtttggaagagtatgatatgaaaagtattggcaaattgttccaactaaaatacctaaactttccagccacgagaatttcaaagctaccgtcagagatcgtgttgctacgtgacctagagacactacattttggagctacaccagtggaagagttgccaactggattcgctcagctgaccaaactacaacacctaatttggtggaggttggacaattataccaaagaagattggaaatatgaggaacttacgggagatatcaggctttagtattaccaagagtccggcagatg

SEQ ID NO: 77021 - DNA, 424 bp, Triticum aestivum
  Clone ID: PAT_TA_77021
gcatgttccggcggcctcgtccgccagaagatgaagtacctccgcttcctccgcaagtaggatgaacaccaagccctcccacggccccatccacttccgcgccccggccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagaggaaggagaaggccaagatctcctacgacaggagaaagcaactggcgaagctccgcgtcaaggccgag

SEQ ID NO: 77022 - DNA, 902 bp, Triticum aestivum
  unsure (1)..(902): unsure at all n locations
  Clone ID: PAT_TA_77022
ttcggcacgaggctccgatccccaccgaanaatctccgacagnatcgaagccaaggctttctcgtcctcctccccaagatgcagatctttgtgaagaccctcaccggcaagaccatcacccttgaggtcgagtcatcggacaccatcgacaacgtcaaggcgaagatccaggacaaggagggcatccccccggaccagcagcgcctcatctttgctggcaagcagctcgaggatggtcgtacccttgctgactacaacatccagaaggagtccaccctccacctggtgctccgccttcgcggtggtatgcagatcttcgtgaagaccctgacgggcaagaccatcacgcttgaggtggagtcctcggacaccatcgacaacgtcaaggccaagatccaggacaaggagggcatccccccggaccagcagcgcctcatcttcgccggcaagcagcttgaggatggccgcactctggcagactacaacatccagaaggagtcaccccctccacctggtgctccgccttcgcggtggtatgcagatcttcgtgaagaccctgacgggcaagaccatcacgttggaggtggagtcctcgggacaccatcgacaacgtcaaggccaagatccaggacaaggagggcatccccccggaccagcagcgcctcatcttcgccggcaagcagctcgaggatggccgtacccttgctgactacaacatncagaaggagtcccccccttccacctggtgctccgncttcgcggggggtatgcagattnttcgtgaagacccctgacnggcaagancattacgctggaggggggaggtccttggacaccattggacaacgtnaagggccaaaatncaggacanggagggcattcccccgggaccagnagngcct

SEQ ID NO: 77023 - DNA, 621 bp, Triticum aestivum
  Clone ID: PAT_TA_77023
attcggcacgaggccaacccaaaccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgcgggcaccttcatggccaaccacttcgaccgccactactgcggcaagtgcggcctcacctacgtctacaaccagaaggcttagaggttgcttgcgattgctctgctcttttactctacctatcgagagtcgaactcacttagatgtgtccc

SEQ ID NO: 77024 - DNA, 647 bp, Triticum aestivum
  unsure (1)..(647): unsure at all n locations
  Clone ID: PAT_TA_77024
ttcggcacgaggccgctactcccctgcctcccccagnanctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgcggtcgtcagtatttttgctctgctc

SEQ ID NO: 77025 - DNA, 646 bp, Triticum aestivum
  Clone ID: PAT_TA_77025
gccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatct

SEQ ID NO: 77026 - DNA, 566 bp, Triticum aestivum
  unsure (1)..(566): unsure at all n locations
  Clone ID: PAT_TA_77026
aagaccctcaccggcaagaccatnaccttggaggnggagtnctnggacaccatcgacaatgtgaaggcnaagatccangacaaggagggcattcccccggaccagnagcgnctgatttttgccggcaagcagctcgaggatggccgnacactggctgactacaacatncagaaggagtccaccctccacctggngctcaggctccgtggaggcatgcaggatcttcgtcaagaccctgacngncaagaccatcaccttggaggtggagtcctnggacaccatctgacaatgngaaggcaaagatccaggataaggagggtatccccccggaccagcagcgccttatnttcnncggcaagcagcttgaggatggccgnaccctggctgactacaacattcagaaggagtccaccctncacctggtgctcaggcttcgnggaggcatgcagatttttgtcaagacgctcaccggnnagaccatcaccctggaggtggagtcctcggacaccatcgacaatgtgaaggccaagatccangacangggagggtatccccccggaccagca

SEQ ID NO: 77027 - DNA, 935 bp, Triticum aestivum
  unsure (1)..(935): unsure at all n locations
  Clone ID: PAT_TA_77027
ggnctgcaggnaattcggcacgaggctccgatnccccaccgaanaatctccgacagcatcgaagccaaggactttctcgtcctcctccccaagatgcagatctttgtgaagaccctcaccggcaagaccatcacccttgaggtcgagtcatcggacaccatcgacaacgtcaaggcgaagatccaggacaaggagggcatccccccggaccagcagcgcctcatctttgctggcaagcagctcgaggatggtcgtacccttgctgactacaacatccagaaggagtccaccctccacctggtgctccgccttcgcggtggtatgcagatcttcgtgaagaccctgacgggcaagaccatcacgcttgaggtggagtcctcggacaccatcgacaacgtcaaggccaagatccaggacaaggagggcatccccccggaccagcagcgcctcatcttcgccggcaagcagcttgaggatggccgcactctggcagactacaacatccagaaggagtccaccctccacctggtgctccgccttcgcggtggtatgcagatcttcgtgaagaccctgacgggcaagaccatcacgttggaggtggagtcctcggacaccatcgacaacgtcaaggccaagatccaggacaaggagggcatncccccggaccagcagcgcctcatcttcgccggcaagcagctcgaggatgggcgtacccttgctgactacaacatncagnaaggagtncncccttcacctggngctccgccttcccggngggtatgcanattttcgngaaaaccctgacnggcaagaccattacgctgggangnggaggtcttgggaaccantcgacaacgtcaagggcaannntcanggccaggggggcatnccccccgggncagnaagggctnattttttccggcagcagcttgngg

SEQ ID NO: 77028 - DNA, 608 bp, Triticum aestivum
  Clone ID: PAT_TA_77028
gcccctgcctctctccagcaaactcacgccccccaccaccgaagctcccaaccccacccgaagcggcagccatggcccccaaggcagacaagaagccggcggccgagagcaaggtggagaaggcggccgagaagacccccgcgggcaagaagcccaaggccgagaagcggctgccggcgggcaagacggcgtccaaggaggccggcggcgagggcaagacccggggccgcaagaagggcagcaaggcgaagaagggcgtggagacgtacaagatctacatcttcaaggtgctgaagcaggtgcaccccgacatcggcatctcctccaaggccatgtccatcatgaactccttcatcaacgacatcttcgagaagctcgccggggagtcggccaagctcgcccgctacaacaagaagcccaccatcacgtcccgggagatccagacctccgtccgcctcgtcctccccggggagctcgccaagcacgccgtctccgagggcaccaaggccgtcaccaagttcacctcctcctagactgacgacgcgccgcttgttgtgacagatgtggccgtctgctgtatctgtagtcgctgttgactctgcttatct

SEQ ID NO: 77029 - DNA, 474 bp, Triticum aestivum
  Clone ID: PAT_TA_77029
ttcggcacgagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgcggtggtgtcataaggagcctatccatctcca

SEQ ID NO: 77030 - DNA, 420 bp, Triticum aestivum
  Clone ID: PAT_TA_77030
ttcggcacgaggggcaagggaggcaaggggctgggcaagggcggcgccaagcgccaccggaaggtgctgcgtgacaacatccagggcatcaccaagccggcgatccggcgtctggcgcggcgcggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggccgcaccctctacggattcggcggctgatctgatcccgcgtgttcctccgttgttaggggttgccgatgtgatgtaatgtgatgcgcattgtttcagattaatcaatggattcgctgttgctgttcaaaaaaaaaa

SEQ ID NO: 77031 - DNA, 589 bp, Triticum aestivum
  unsure (1)..(589): unsure at all n locations
  Clone ID: PAT_TA_77031
gctgcaggnaattcggcacgaggagtntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattcc

SEQ ID NO: 77032 - DNA, 983 bp, Triticum aestivum
  unsure (1)..(983): unsure at all n locations
  Clone ID: PAT_TA_77032
cggcacgaggccccctccgcgatctcaccgagnaaaatcctcgaccgaccgaacgacaaggccctctcatcctcctcctccaagatgcagatcttcgtgaagactctcaccggcaagaccatcacccttgaggtcgagtcgtctgacacgatcaacaatgtcaaggccaagatccaggacaaggagggaatccctccggaccagcagcgcctcatctttgctggcaagcagctagaggatggccgcaccctggctgactacaacatccagaaggagtccaccctccacctggtgctccgcctccgcggaggcatgcagatctttgtcaagaccctcaccggcaagaccatcaccttggaggtggagtcctcggacaccatcgacaatgtgaaggcgaagatccaggacaaggagggcattcccccggaccagcagcgtctgatttttgccggcaagcagctcgaggatggccgcacactggctgactacaacatccagaaggagtccaccctccacctggtgctcaggctccgtggaggcatgcagatcttcgtcaagaccctgacgggcaagaccatcaccttgggaggtggagtcctcggacaccatcgacaatgtgaaggcaaagatccaggataaggagggtatccccccggaccagcagcgcctcatcttcgccggcaagcagcttgaggatggccgcaccctggctgactacaacatncagaaggagtccacccttcacctggtgctcaggcttcgcggaggcatgcagattttngtcaagaccctcaccggcaagacataccttttggnngggggagtccttgggcaccatcgacaacgngaaggcnaagatncaggacaaggggggcatnccttcggaccagcagngccttattttnnntggnagcagnttgnggatggccgnaccctggctgattttacattcaaaaggngnccnccttccnctgggggtcagg

SEQ ID NO: 77033 - DNA, 598 bp, Triticum aestivum
  Clone ID: PAT_TA_77033
ggcccccgccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacgcaggtgctcaacgaggtggaggaggtcaagaaggagtaccctgatgcctatgtccgtgtcatcggcttcgacaacctgcgccaggtgcagtgcgtcagcttcatcgccttcaggccaccaggttgcgaggagtccggcaaggcctaaactacaagttgaaacaatggcctatgtatgatggtcatttgtgaacttcacttttgtccacgactctgctttccg

SEQ ID NO: 77034 - DNA, 614 bp, Triticum aestivum
  Clone ID: PAT_TA_77034
attcggcacgaggccggcgtcttcgtactcgcctctctctcgcgcttccgagctttggcctccgtcctcccctcctcccccgatctctccaccagcgcagcgtagcgccggcttccgccgctccgacccgccgccatgagggagtgcatctcgatccacatcggccaggccggtatccaggtcgggaacgcgtgctgggagctctactgcctcgagcatggcattcagcctgatggacagatgcccggtgacaagaccgttgggggaggtgatgatgctttcaacaccttcttcagtgagactggtgctgggaagcatgtcccccgcgcggtctttgttgatcttgagcccactgtgattgatgaggtgaggactggcacttaccgccagctcttccaccctgagcagcttatcagtggcaaggaggatgcagccaacaactttgcccgtggtcactacaccattggcaaggagattgttgacctatgccttgaccgtatcaggaagcttgcagacaactgcactggtctccaggggttccttgtcttcaacgctgttggaggtggaactggctctggcccttggttctcttctccttgagcgtctctctgagg

SEQ ID NO: 77035 - DNA, 710 bp, Triticum aestivum
  Clone ID: PAT_TA_77035
gcactaggtctcggacattcctctttctctcccttgcttggggaagaagaagaagaagaagagagggctccctatcaacttcgctggactcgccaaggctgtgaagcccggagccacaatattcgttgggcaatatttgttcacgggcagtgagactacatcagtttggctggaggtttctgaagttcaaggggatgacgtggtttgcgtgatcaagaactcagctaccctggctgggtcactcttcacattgcactgctcccagatccatatcgacatgcccacgctgtctgatgaggataaagatgttatgaaaaaatggggtgctccaaacaagattgacttcctctctctttcttatacaaggcacgcagaagatgtgcggcaagcacgggagttcctctctaagttaggtgatcttagccaaactctgatttttgccaaaattgagaatgtggagggcttgaaccattttgatgagatcctggaggaagcggatggtatcattctgtcaagagggaaccttggaattgatcttccacctgaaaaggtgttcttatttcagaagtctgctctgcacaagtgcaacatggctggaaagcctgctgttgttacctcgtgttgtggacagtatgacggacaacctaaggcctactcgtgcggaggcaacctgatgtggcaaatgcggtgctggatggtagtgatgccat

SEQ ID NO: 77036 - DNA, 623 bp, Triticum aestivum
  Clone ID: PAT_TA_77036
gcccttctctctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaaca

SEQ ID NO: 77037 - DNA, 519 bp, Triticum aestivum
  Clone ID: PAT_TA_77037
gcaggaattcggcacgaggcaccacagcacctctccccgccgaacgtccgcatccgcatccatggccccgaaggcagccgagaagaagccggtggagaagaccccggcgggcaagaagcccaaggcggagaagaaggtgccggcgtccaaggagggcggggacaagaagggcaagaagaaggccaagaagagcgtggagacctacaagatctacatcttcaaggtgctgaagcaggtgcacccggacatcggcatctcctccaaggccatgtccatcatgaactccttcatcaacgacatcttcgagaagctggccggcgagtccgccaagctggcgcgctacaacaagaagcccaccatcacgtcccgggagatccagacctccgtccgcctcgtcctccccggcgagctcgccaagcacgccgtctccgagggcaccaaggccgtcaccaagttcacctccgcctgattccgccgtccacgtgtcttctttgatgtatccatcgatcgatgttgttg

SEQ ID NO: 77038 - DNA, 574 bp, Triticum aestivum
  Clone ID: PAT_TA_77038
attcggcacgaggaagcaatccaattccccaccagccccctcgcaccttccggcgaatcaccgcacctctccccggcgaagcagcagcgtccgatggcccccaaggcggagaagaagccggctgccgcggagaagactccggcggccgagaagaccaccgcgggcaagaagcccaaggccgagaagcggccgcccaagtccaaggagggcggcgccgacaagaagaagaagaaggccaagaagagcgtggagacgtacaagatctacatcttcaaggtgctgaagcaggtgcacccggacatcggtatctcctccaaggccatgtccatcatgaactccttcatcaacgacatcttcgagaagctcgccggcgagtccgccaagctcgcccgctacaacaagaagcccaccatcacctccagggagatccagacctccgtccgcctcgtcctcccgggcgagctcgccaagcacgccgtctctgagggcaccaaggccgtcaccaagttcacatcctcttagataggctgttctctgtcttcgtggttgatcgatggttctctgtaatgctcgt

SEQ ID NO: 77039 - DNA, 539 bp, Triticum aestivum
  unsure (1)..(539): unsure at all n locations
  Clone ID: PAT_TA_77039
gcggcggtgcccgannggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttga

SEQ ID NO: 77040 - DNA, 454 bp, Triticum aestivum
  Clone ID: PAT_TA_77040
ctccgaagctccaacccaacctgcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcatatcgatctactactaccataccatgtaaccgcaactctgatcgagggcctttatgtacgcacctgacctgcatcagcagtcaggtgccatgccatgattgtaaacaggcccccctaaataaaacctcccttgattaact

SEQ ID NO: 77041 - DNA, 507 bp, Triticum aestivum
  Clone ID: PAT_TA_77041
gcctcgtgccgaattcggcacgaggcagccatggtgcacgtcaacttctaccgcaactatggtaagacattcaagaaaccaaggcgtccttatgagaaggagcgtcttgatgcagaactgaagctggttggtgagtatggattgaggtgcaagcgtgagctctggagggttcagtatgcattgagcaggatccgtaatgctgcaagacacttgctcacactggatgagaagaatccccgccgtatctttgagggtgcggctcttctccgtcgcatgaaccgctatggtctccttgctgagggccaggataagcttgattacgtccttgccctgactgctgagaacttccttgcaaggcgccttcagactcttgtcttcaaggctggcatggcaaaatccatccaccatgcccgtgtcttgatcaggcaacgccacatcagggttggcaggcagatcgtcaatgtcccgtcgttcatggtgagggttgaatctgagaagcacatcgac

SEQ ID NO: 77042 - DNA, 548 bp, Triticum aestivum
  unsure (1)..(548): unsure at all n locations
  Clone ID: PAT_TA_77042
ggnctgcaggnaattcggcacgaggncgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgtt

SEQ ID NO: 77043 - DNA, 644 bp, Triticum aestivum
  unsure (1)..(644): unsure at all n locations
  Clone ID: PAT_TA_77043
tcggcacgaggctccctccctccccacccagggnaaacccaccagccatgaagggggccaaatccaagggcgccgccaaggccgacaccaagttggcggtgaagagcaagggggcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccatcgccgcctacaacaagggcgagagtgctgctgctgccgccccaaagaaggcggccgccaaggaggtggaggaggaagatgaggaggaatccgacaagtccaagtcggagatcaatgacgacgatgacgatgagggtagcgatgaggacgaggacgacgacgagtgaagaagacgcatcttgtcaaggctgctggctccggcggacaaaggcgggagcggctgctgcgcgagaaccgacgtgagctgtgtgcggtggtgtcataaggagcctgtccat

SEQ ID NO: 77044 - DNA, 394 bp, Triticum aestivum
  unsure (1)..(394): unsure at all n locations
  Clone ID: PAT_TA_77044
gaggaattcggacgagggcaatgtcgggccgcggcaagggaggcaaggggctgggcaagggcggcgccaagcgccaccggaaggtgctgcgtgacaacatccagggcatcaccaagccggcgatccggcgtctggcgcggcgcggcggcgtgaagcgcatctccgggctcatctacgaggagacccgcggcgtgctcaagatcttcctcgagaacgtnatncgngacgccgtcacctacaccgagcacgcccgccgcaagaccgtcaccgccatggacgtcgtctacgcgctcaagcgacagggccgnaccctctacggattcggcggttgatctgatcccgcgtgttccttcgttgntaggggttgccgatgtgatgtaatgtgatgcgcatt

SEQ ID NO: 77045 - DNA, 628 bp, Triticum aestivum
  unsure (1)..(628): unsure at all n locations
  Clone ID: PAT_TA_77045
ggnctgcaggnaattcggnacgaggccgatcccgaaccgggnaggaacccggcgcgaggagggcaaaggaagagaagaggagaccaccgagcccagcgcgcgcacacgacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaatgctgctgaaatcactgacaagcttggcctgcattccctgcgccagcgacactggtacatccagagcacatgtgctacctct

SEQ ID NO: 77046 - DNA, 175 bp, Triticum aestivum
  Clone ID: PAT_TA_77046
aagaggaagtaggaagcggatcgagtcggcgagagcgagggcgaggacgatggcggcgctccggctagcgttgaggaggttttgcgaccgtgcgctcgggagatcagcgggcatttacgagctcaaggctgccaaggaattccccgacattgatcctgggcatctcaaggctgcc

SEQ ID NO: 77047 - DNA, 516 bp, Triticum aestivum
  unsure (1)..(516): unsure at all n locations
  Clone ID: PAT_TA_77047
gaaggcaaggnaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtacgacgtcgtcaacgatctcaagggt

SEQ ID NO: 77048 - DNA, 611 bp, Triticum aestivum
  Clone ID: PAT_TA_77048
ccacccactcccaaaccctctcgccggagccccagcaacccgccagcaagcaagatggacggcagcaaggcgaagaaggtggcggcgaagaagttcggcgggccgaggaagaagtcggtgaccaagtccatcaaggccgggctccagttccccgtcggccgcatcgggcgctacctcaagaagggccgctacgcccagcgcgtcggctccggcgcccccgtctacctcgccgccgtcctcgagtacctcgcagcagaggtgctggagctggccgggaacgccgccaaggacaacaagaagagccgcatcgtgcccaggcacctgctgctggccatccgcaacgaccaggagctcgggaggctgctgtccggcgtcaccatcgcccacggcggcgtcatccccaacatcaacccggtgctgctccccaagaaggccgccgagaaggctgagaaggccgagaagaccgccaccaagtcgcccaagaaggccaccaagtcccccaagaaggccaccaaggcgtagatctggctccgagcgcccgtgccggtgaactggactgatggtgctccgtcagccctcgtgtgcctagtgtctctgtgttaagttagctg

SEQ ID NO: 77049 - DNA, 399 bp, Triticum aestivum
  unsure (1)..(399): unsure at all n locations
  Clone ID: PAT_TA_77049
gnaaccccctcccccaaacccaccacncggcggcggcgcggcgcagctcgaggnaaggaggcgaagatggtgaagttcctgaagcccggcaaggcggtgatcctgctgcagggcaggtactgccgggaagaaggcggtgatcgtgcgcgtgttcgaggagggcacccgcgaccgcccctacgggcactgcctcgtcgccggcctggccaagtacccgaagaaggtgatccgcaaggactcggccaagaagacggccaagaagtcccgcgtcaaggtgttcctcaagctcgtcaacttcacccacctcatgcccacccgctacaccctcgacgtcgacctcaaggaggtggcctccggcgcgcccgactccctcacctccaaggacaagaaggtgggcgc

SEQ ID NO: 77050 - DNA, 404 bp, Triticum aestivum
  Clone ID: PAT_TA_77050
agcaaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggatgtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctg

SEQ ID NO: 77051 - DNA, 151 bp, Triticum aestivum
  unsure (1)..(151): unsure at all n locations
  Clone ID: PAT_TA_77051
ctgcccaaattgtgtacgctaccattgctggtgatatcgtgatggctgctgcctattcccatgagcttnctcggtatggncttgaagttggcctnaccaactatgctgcagngnactgcactgnnntgcttttntcccgccgtgtgctcaa

SEQ ID NO: 77052 - DNA, 523 bp, Triticum aestivum
  unsure (1)..(523): unsure at all n locations
  Clone ID: PAT_TA_77052
agggctacgagnaagcgccttgagnatcaccttctctgaggcatcaatctttgctgaccctcatggtcgtggcctgcgcgccctctccagggcccagattgactctgttcttgatcttgcacggtgcaccattgtgtccgagctctccaacaaggactttgactcgtacgtgctatccgagtcgagcttgtttatctactctcagaagattgtgatcaagacctgtgggactaccatgctcctgctcaccattccaaggattctcgagctggctgaagagctgtgcatgccgcttgctgctgtgaagtactcccgtgggatgttcatcttccccggtgcacagcctgctccccacaggagcttctctgaggaggttgatgtcctgaaccgctactttggccacctgaagtctggtggcaatgcctatgtgattggagacccagcgaagcctggccagaagtggcacatctactatgccaccgagcaacctgcggctactccatgaacgccatcaacggatctg

SEQ ID NO: 77053 - DNA, 561 bp, Triticum aestivum
  Clone ID: PAT_TA_77053
tgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagt

SEQ ID NO: 77054 - DNA, 670 bp, Triticum aestivum
  Clone ID: PAT_TA_77054
gcaagaaccctagcctccggatccatccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaaga

SEQ ID NO: 77055 - DNA, 526 bp, Triticum aestivum
  Clone ID: PAT_TA_77055
gctctactgcaccgccgcagcctggtgaagtactcgacggatcccgccaatcccaccaagtccgccaaggccatgggccgggacctgcgtgttcatttcaagaacactagggaaacagcgtttgccctgaggaagatgtcgctcaacaaggccaagaggtaccttgaggatgtgttggcacacaagcaagccatccccttccggaggtactgccgtggtgttggacgcacagcccaggtgaagaaccgtcagcccaatggtcagggacgctggcctgccaagtctgctaagttcgttctggatcttctaaagaatgctgagagcaatgctgaggtgaaaggtcttgatgttgatgctctctacatttcacacatccaagtgaaccaggcccagaagcagcggcgccggacctaccgtgcccatggacgcatcaacccctacatgtccaacccatgccacattgagctgatcttgtcggagaaggaagagccggtgaagaaggaggctgagtcccagattgccagga

SEQ ID NO: 77056 - DNA, 587 bp, Triticum aestivum
  unsure (1)..(587): unsure at all n locations
  Clone ID: PAT_TA_77056
tatgcttgtctcaaagnattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagtt

SEQ ID NO: 77057 - DNA, 487 bp, Triticum aestivum
  Clone ID: PAT_TA_77057
ggcaaacctcccatctccgtctagcgtcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcagacg

SEQ ID NO: 77058 - DNA, 589 bp, Triticum aestivum
  Clone ID: PAT_TA_77058
gcgcaaccgccgccaacaccactcctagcgagtcctcgccgccggagaagcagcaagcaagatggccggaaggaagggaggcgacaggaagaaggcggtgaccaggtccgtcaaggccgggctccagttccccgtcggccgcatcgggcgctacctcaagaagggccgctacgcgcagcgcgtcggctccggcgcccccgtctacctcgccgccgtcctcgagtacctcgccgctgaggttctggagcttgccggcaacgcggccaaggacaacaagaagacccggatcatcccgcgacacctgctgctcgccgtccgcaacgaccaggagctcggaaggctgctcgccggcgtcaccatcgcccacggcggcgtgatccccaacatcaactccgtgctgctcccaaagaagtcccccgccgccgccgagaaggaggccaagtcgcccaagaagaagaccaccgccaagtcccccaagaagaaggtcgccgccaccaaggagtagccgcccccatagcctagccagtgttgcttagatccattcctcatggactaagatgagatcctgtatgtaatgctctgtagtgcc

SEQ ID NO: 77059 - DNA, 555 bp, Triticum aestivum
  Clone ID: PAT_TA_77059
ttcggcacgaggattgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgcc

SEQ ID NO: 77060 - DNA, 586 bp, Triticum aestivum
  Clone ID: PAT_TA_77060
tatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagtt

SEQ ID NO: 77061 - DNA, 538 bp, Triticum aestivum
  Clone ID: PAT_TA_77061
ggcacgaggtctcgatctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccactaactg

SEQ ID NO: 77062 - DNA, 305 bp, Triticum aestivum
  unsure (1)..(305): unsure at all n locations
  Clone ID: PAT_TA_77062
tcatcatcaacaccttctactccaacaaggagatcttcctccgcgagctcatctncaactcctccgatgccttggacaagatcaggttcgagagcctcacggacaagagcaagctcgatgcgcagcccgagctcttnatccacatcatccccgacaaggcgaccaacacgctcacgatcgtcgacagcggcattggcatgaccaagtcggacctcgtcaacaacctngggaccatcgccaggtcggggaccaaggagttcatggaggccctcgccgncggcgccgacgtgtccatgattgggcag

SEQ ID NO: 77063 - DNA, 654 bp, Triticum aestivum
  unsure (1)..(654): unsure at all n locations
  Clone ID: PAT_TA_77063
gccgctactcccctgcctcccccagnanctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgact

SEQ ID NO: 77064 - DNA, 421 bp, Triticum aestivum
  Clone ID: PAT_TA_77064
gagggactcgagcatggctggctacatgtcaagcaagaagaccatggaggaccccaacaccttcggcaccaggatccaccgcatgctcaagcttggcctgagcattgacgaggacgatgaggcgcctgagaacgacaccgacatgccgcccctggaggacgacgctggtgagagcaagatggaggaggtcgactaagcgccaagtctgcctgtcgtcggatgttcatgccctgcaccgcctagttgtttttatctttagtgtcgacgttggatggtcgctgtatcggttttgtcttttggctggccaaacattaagcgcggctagctgtttgtggtactcgtggaacagttcgttattgttggttctattatatgttagctatatttctataattctgtgctattgcttgcaaaaaaaaaa

SEQ ID NO: 77065 - DNA, 551 bp, Triticum aestivum
  unsure (1)..(551): unsure at all n locations
  Clone ID: PAT_TA_77065
gccgaactcnaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagaggaaggagaa

SEQ ID NO: 77066 - DNA, 618 bp, Triticum aestivum
  Clone ID: PAT_TA_77066
gcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtgaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctcaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagttcgaggccaagcgcgccaagagcaaggcaagcagggagaggaagattgccaggagggaggagagattggctcagggcccgagagatcatgcaccagcaccagcggctgcagctcccgctcaggcagcagcg

SEQ ID NO: 77067 - DNA, 508 bp, Triticum aestivum
  Clone ID: PAT_TA_77067
ggaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatcc

SEQ ID NO: 77068 - DNA, 628 bp, Triticum aestivum
  Clone ID: PAT_TA_77068
attcggacgaggagacggaggtagggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggccaagcgcgccaagagcaaggcaagcagggagaggaagcatgccaggagggaggagagattggctcagggccccagagatcatgcaccagcaccagcggc

SEQ ID NO: 77069 - DNA, 855 bp, Triticum aestivum
  unsure (1)..(855): unsure at all n locations
  Clone ID: PAT_TA_77069
tccccctccgatctcaccgagaaatcgacgcgaaggctctctgcccgtcctcaagatgcagatctttgtgaagaccctcaccggcaagaccatcaccctcgaggtcgagtcgtcggacaccatcgacaatgtcaaggccaaaatccaggacaaggagggcatccctccggaccagcagcgtctcatcttcgctggcaagcagcttgaggatggccgcacccttgctgactacaacatccagaaggagtccaccctccacctggtgctcaggctccgtggtggcatgcagatttttgtgaagaccctcaccggcaagaccatcacccttgaggtcgagtcctcggacactatcgacaacgtcaaggctaagatccaggacaaggagggcatccctccggaccagcagcgtctcatcttcgctggcaagcagctcgaggatggccgcacccttgctgactacaacatccagaaggagtccaccctccacctggtgctcaggctccgtggtggcatgcagatttttgtgaagaccctcaccggcaagaccatcaccctggaggttgagtcctcggacaccatcgacaacgtcaaggcgaagatccaggacaaggagggcatccccccggaccagcagcgtctcatcttcgctggtaagcagcttgaggatggccgcaccctggcggactataacatncagaaggagtccacccttcacctggtgctcaggctcaggggtgggatgcanatttttgtgaagaccctaccggcaagaacattacacttgaggtcgagtcctcggacccaattgacaatntgaaggctaagatncaggacaagggaggcattcctncggac

SEQ ID NO: 77070 - DNA, 540 bp, Triticum aestivum
  Clone ID: PAT_TA_77070
gccgatcccgaaccgggaggaacccggcgcgaggagggcaaaggaagagaagaggagaccaccgagcccagcgcgcgcacacgacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaatgctgctgaaatcactgac

SEQ ID NO: 77071 - DNA, 568 bp, Triticum aestivum
  unsure (1)..(568): unsure at all n locations
  Clone ID: PAT_TA_77071
gtgccagtagtcntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttngatggtaggatnggggcctaccatggtggtgacgggtgacggagaattagggttcgattccggagagggagcctgagaaacggctaccacatncaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggt

SEQ ID NO: 77072 - DNA, 667 bp, Triticum aestivum
  unsure (1)..(667): unsure at all n locations
  Clone ID: PAT_TA_77072
tgcaggnaattcggcacgaggccgctactcccctgcctcccccggnnctcgttagggttttctgttttttcgggggagaaatctcaagaggcggcaccatgctcgtgtaccaggacaagctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaggccgtgaaggtggttgacattgttgacaccttccgtcttcaggagcaacctgcttttgacaagaagcagtttatctctcacatgaagcgctacatcaagaacctcactgccaagcttgaaggggatgacctagatgttttcaagaagaatgttgagtctgccacgaagtatcttcttagcaagctcaaggaccttcagttctttgttggcgagagcatgcatgatgatggcggcgtggtgttcgcgtactacaaggagggagctgctgatccaactttcctgtactttgcacatgggctgaaagaggtcaagtgctaatggcacagtatgctaaaatctttggggtcgtcagtattttttgctctgctctatgtatggtt

SEQ ID NO: 77073 - DNA, 494 bp, Triticum aestivum
  unsure (1)..(494): unsure at all n locations
  Clone ID: PAT_TA_77073
tgcaggnaattcggcacgagggccgcgctccgccgcctcctctcgctccgcctccgcctccgccgtctgttgcatccctgccggccatgtcgatcttcgagtacaacgggagcgccgtggtggcgatggtggggaagaactgcttcgcgatcgcgtgcagctgtaccagcggctggtgtttaagcacaaactgtaccagcttcgggaggagagggacatgaagcccgagaccttcgccagcctcgtctccgccctcctttacgagaaaaggtttgggccatacttctgccaaccaattattgccgggctaggtgaaaaggatcagccatttatatgtaccatggactgcattggtgctaaggaactggcaaaagattttgtggtttctggtactgcttcggaatcactatatggtgcttgngagtccatgtacaaaccagacatggaacccgaagaactatttgagaccatctnacaagcattgctgtcttctg

SEQ ID NO: 77074 - DNA, 563 bp, Triticum aestivum
  Clone ID: PAT_TA_77074
ccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccactaactgccttgctcctcttgctaaggttatcaatgacaggtttggcattgttgagggtttgatgaccacagttcatgccatgactgcaaccc

SEQ ID NO: 77075 - DNA, 508 bp, Triticum aestivum
  unsure (1)..(508): unsure at all n locations
  Clone ID: PAT_TA_77075
cgtctccgatcgactgccagtctccccttcctgccggttcctccccgccgccccaagtatgcagnatctttgtcaagaccctcactggcaagaccatcacccttgaggtcgagtcgtctgataccatcgacaatgtcaaggctaagatccaggacaaggagggcatccccccggaccagcagcgcctcatctttgctggcaagcagctggaggacggcaggacccttgctgactacaacatccagaaggagtccaccctccaccttgtcctccgncttcgtggaggcatgcanatctttgngaagaccctnactggcaagaccattacagcttgangtggagtcatccggacaccatcgacaatgtgaaggcaaagatncacgacaaggagggcattccncccnggaccannagngcctcatntttgcttggcnaagcagnctggaggacngnnngacccnttgcttgactacancatgcnngaangngnccaccctncacccttgtc

SEQ ID NO: 77076 - DNA, 589 bp, Triticum aestivum
  unsure (1)..(589): unsure at all n locations
  Clone ID: PAT_TA_77076
gcagtagtntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatt

SEQ ID NO: 77077 - DNA, 590 bp, Triticum aestivum
  unsure (1)..(590): unsure at all n locations
  Clone ID: PAT_TA_77077
ggaggaacccggcgcgaggnagggcaaaggaagagaagaggagatcaccgagcccagcgcgcgcacaggacagcaggcgccgcgatctcgcacaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgcttgaaatcactgacaagcttggcctgcattctctgcgccagcgacactggtacatccagagcacatgtgctacctct

SEQ ID NO: 77078 - DNA, 587 bp, Triticum aestivum
  Clone ID: PAT_TA_77078
gcactcccccgcccgccgccgccgccgcacagccgcaggtagagaaggcaaggaggaagggaagatgccggcggggcacgggctgcggtcgcggacgcgcgacctgttcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcacgtgcagccatccaggtgcaacgaggagttcctccagaggaagctcaacaacgacaagctgaaggcggaggccaaggtgcgtggtgaggtcatcagcaccaagaggcagccagcaggccccaagcctgggttcatggtggagggcaccaccatcgagacggtcacccccatcccgtacgacgtcgtcaacgatctcaagggtggttactagagcgcttgttgtttcctgagcagaagct

SEQ ID NO: 77079 - DNA, 582 bp, Triticum aestivum
  Clone ID: PAT_TA_77079
gcgaactccaaaccctagtagcgccgccgccgccaggtaagaggcgagatggtgtccggctccggcgtgtgcgccaagcgcgtggtggtggacgcccgccaccacatgctcggccgcctggcctcgatcgtcgccaaggagctgctcaacgggcagcgcgtggtggtggtccgatgcgaggagatctgcatgtccggcggcctcgtccgccagaagatgaagtacctccgcttcctccgcaagaggatgaacaccaagccctcccacggccccatccacttccgcgccccggccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagaggaaggagaaggccaagatctcctacgacaggagaaagcaa

SEQ ID NO: 77080 - DNA, 517 bp, Triticum aestivum
  unsure (1)..(517): unsure at all n locations
  Clone ID: PAT_TA_77080
naattcggcagnaggctctcgcgacctcctgtttccgcccaccttctccggctccggcgccggcgaaccaatcgcggatcgagcgattcctccgatcaggagaggcgagccgggaggaagagcacctacgcgggaggagacgagatggggctcacgttcaccaagctgttcagccgcctgttcgccaagaaggagatgcggatcctgatggtgggtctcgacgccgccggaaagaccaccatcctctacaagctcaagctcggggagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttg

SEQ ID NO: 77081 - DNA, 563 bp, Triticum aestivum
  unsure (1)..(563): unsure at all n locations
  Clone ID: PAT_TA_77081
ctgcaggnaattcggcacgaggnacctctcggctctcccggtcgaagcatccgcatcctcatccatggcccccaaggcagccgagaagaagccggtggagaagaccccggcggggaagaagcccaaggcggagaagaaggtgccggcgtccaaggagggcggcggcgacaagaagggcaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctggccggcgagtccgccaagctggcgcgctacaacaagaagcccaccatcacgtcccgcgagatccagacctccgtccgcctcgtcctccccggcgagctcgccaagcacgccgtctctgagggcaccaaggccgtcaccaagttcacctccgcctgatctggccgtctncgtttgtcttctttgatggatgtatcggtgttgctctgtagtagttagctgttcgtgctctgtcgtgttgtagctt

SEQ ID NO: 77082 - DNA, 555 bp, Triticum aestivum
  unsure (1)..(555): unsure at all n locations
  Clone ID: PAT_TA_77082
ttcggcacgaggaggaacccggcgcgaggnagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctc

SEQ ID NO: 77083 - DNA, 517 bp, Triticum aestivum
  unsure (1)..(517): unsure at all n locations
  Clone ID: PAT_TA_77083
gcaggnaattcggcacgaggccggcgtcttcgtactcgcctctctctcgcgcttccgagctttggcctccgtcctcccctcctcccccgatctctccaccagcgcagcgtagcgccggcttccgccgctccgacccgccgccatgagggagtgcatctcgatccacatcggccaggccggtatccaggtcgggaacgcgtgctgggagctctactgcctcgagcatggcattcagcctgatggacagatgcccggtgacaagaccgttgggggaggtgatgatgctttcaacaccttcttcagtgagactggtgctgggaagcatgtcccccgcgcggtctttgttgatcttgagcccactgtgattgatgaggtgaggactggcacttaccgccagctcttccaccctgagcagcttatcagtggcaaggaggatgcagccaacaactttgcccgtggtcactacaccattggcaaggagattgttgacctatgccttgaccgtatcaggaagctt

SEQ ID NO: 77084 - DNA, 449 bp, Triticum aestivum
  Clone ID: PAT_TA_77084
ttcggcacgagggcgtcttctcctgcgcatctcgggaggtgcttcctagtttccacgatgaagctgatcgcagcctaccttctcgcctatctgggcgggaactcttccccaagtgccgctgacgtcaagaacatccttgactcagttggtgctgaggctgatgaagaaaagcttgagttccttcttgctgaactcaaaggcaaggacatcacagaagtgattgcatctggaagggagaagtttgccgctgtgccttcaggtgggggtgccattgctgtgggagctccagctgctgcatctggtggtgccgcagcacctgctgctgagtcaaagaaggaggagaaggttgaagagaaggaagaatctgatgaagacatgggtttcagtctgttcgactaagcgcttcagttcctcccccctaccctctgtttaccctagtatctgtcgtg

SEQ ID NO: 77085 - DNA, 320 bp, Triticum aestivum
  Clone ID: PAT_TA_77085
attcggcacgaggcgccgccgccgcagccgccttcgtccacgccgccacgatgccgtcgcacaagaccttccggatcaagcagaagctggccaagaagcagcgccagaaccgccccatcccctactggatccgcatgaggaccgacaacaccatcaggtacaacgccaagcgcaggcactggcgccgcaccaagctcggattctaatccggggatgacggcgatgacacccgttgctgccgacgggagaagggtctagggtacctagggtttatgatgtctcgttgtttttgcatgctagcaagtgactccgggatgcca
